United States Patent 11,596,699 (RNA ENCODING AN ANTIBODY) - sequence listing, part 8

SEQ ID NO: 43372 - RNA, 729 nt, Artificial Sequence
  derived and/or modified sequence opt5 from anti-influenza_Chain
caggugcaacugguccagagcggcgccgagguuaagaaacccggguccucugugaaggugagcugcaaggcuuccggaggcaccuucucuagcuacgccaucuccugggucagacaggcgccugggcagggacucgaauggaugggcgggauuaugggaauguuuggcacaacgaacuaugcucaaaaauuccagggccgggugaccaucacagccgacgaguuuaccucugccgcuuacauggaacugcgcagccuuagauccgaggauacagccguuuauuacugugcucggagcucuggguauuacccggaauauuuccaggacuggggacagggcacccuggugacagucuccagcgggaccggaggcucugggggaacgggcuccggcaccgggggaagcacacaaucugugcucacccagcccccuuccgagagcguuucccccggccagacagccucugugaccugcagcgggcacaaacugggagauaaguacgucuccugguaccagcaaaagccuggccagagccccgugcuucugauuuaucaggacaaucgcagaccuucugggaucccggagcgguuuauuggauccaacagcggcaauacggcgacacucaccaucucuggcacacaagcccuggaugaagcugacuacuauugucaggccugggauagcuccaccgcuguguucgggggaggcaccaaacugacaguccucggg

SEQ ID NO: 43373 - RNA, 729 nt, Artificial Sequence
  derived and/or modified sequence opt5 from anti-influenza_Chain
caggugcaacugguccagagcggcgccgagguuaagaaacccggguccucugugaaggugagcugcaaggcuuccggaggcccuuucagaaacuuugccaucaauuggguccggcaggcgccggggcagggacucgaauggaugggcgggauuaucgcuguguucggaaccacaaaguacgcccacaaauuucaaggccgcguuacgauuaccgccgacgauucuacaaacaccgcuuauauggagcugggcagccuuaaguccgaagacacagccguguacuauugugcuagagggccccauuacuauucuagcuacauggaugucuggggagagggcaccacagugaccguuuccagcgggacgggaggcucugggggaaccggcuccggcacagggggaagcaccgacauccagcugacacagucuccuuccagccucucugccuccgugggcgaucgggucaccauuacgugccgcgcgagccaggggaucuccacauaucuggccugguaccaacagaagcccggaaaagugccuaaacuucugaucuacgcugccucuacccuccagagcggcgugcccuccagauucagcgggucuggauccggcacagacuuuacccugaccauuagcucucugcagccugaagaugucgcuacauauuacugucaaaaauauaauagcgccccguccuucggccccgggacgaagguugacaucaaacgg

SEQ ID NO: 43374 - RNA, 729 nt, Artificial Sequence
  derived and/or modified sequence opt5 from anti-influenza_Chain
augagcuacagagugaagcggaugcugaugcuccuggucaccggccuuuuccugucccucucuacauuugccgcuagcgccuccgcgcagaccgggggaucuuucuaugagcccuuuaacaauuacaacacgggccuguggcaaaaagcugacggguauagcaauggaaacauguucaauugcacauggcgcgccaacaauguuuccaugaccucucuuggcgaaaugagacugagccucacauccccuagcuacaacaaguuugauuguggggagaaucggucugugcagaccuauggauacggccuguaugaagugaacaugaaaccggccaagaaugucggcaucguguccagcuucuuuacauacaccgggcccacggacggaaccccuugggaugagauugacaucgaguuccugggcaaagauacaaccaagguucaguuuaacuacuauacaaauggggugggaaaccacgaaaagauugucaaucucggcuucgacgcugccaacucuuaccauaccuaugcuuuugauuggcagcccaacuccaucaaaugguacguggacgggcaacugaagcacacggccacaacccagauuccucagacacccggaaaaaucaugaugaaucuuuggaacggcgcgggcguugaugaguggcuggggagcuauaauggagugaccccucucucucgcucccugcauugggucagauacaccaagcgg

SEQ ID NO: 43375 - RNA, 735 nt, Artificial Sequence
  derived and/or modified sequence opt5 from anti-influenza_Chain
caggugcaacugcagcagagcggcgccgaggucaagaaacccggguccucuguuaaggugagcugcaaaguguccggagucaucuucucuggcagcgcuauuuccugggugagacaggccccugggcaaggacucgaauggaugggcgggaucucuccgcuguuuggaaccacaaacuacgcgcagaaguuccagggccggguuacgauuaccgcugaccagagcacaaauaccacauauauggaggugaacucccuucgcuacgaagauaccgccgucuauuuuugugccagaggccccaaauacuauagcgaguacauggacgugugggggaagggaacaaccguuacggugucuuccggcaccgggggaagcggcgggacaggaucuggcaccggcggguccacagauauccaaaugacccagagcccuucuucccugagcgcuuccgucggagaccgggugacgauuacaugccgcgccucucagggcaucagcuccuaucucgcuugguaccagcaaaagcccgggaaagugccuacccugcuuaucuacgaugccagcacacugagaucuggaguccccucccgguucagcggcucugggagcgcgaccgacuuuacccucacaauuuccucucugcagccugaagauguugccacguauuacugucagcgcuauaauagcgcuccgcccaucaccuucggacaaggcacaagacuggagauuaagcgg

SEQ ID NO: 43376 - RNA, 735 nt, Artificial Sequence
  derived and/or modified sequence opt5 from anti-influenza_Chain
gaggugcagcuggucgaauccggcgccgagguuaagaaacccggguccucugugaaggugagcugcaaggcuuccggaggcaccuucucuagcuacgggaucuccugggucagacaagccccuggacagggccucgaauggaugggggacauuaucggaauguuuggcucuacaaacuaugcgcagaauuuccagggccggcugacgauuaccgcugaugagagcacauccaccgccuacauggaacuuagcucucugcgcuccgaggacacagccguguauuacugugcuagaagcucuggguauuacccggccuaucucccccacuggggacaaggcacccugguuacaguguccagcgggaccggaggcucugggggaacgggcuccggcaccgggggaagcacagagaucguccuuacccaguccccuggcacacugucucucagccccggggaacgggcuacccuguccugccgcgccagccagucuguguccagcucuuaccuggcgugguaccagcaaaaaccuggacaggcccccagacuccugauuuauggcgcuagcucccgggccacggggaucccugaucgcuuuucuggaagcggcuccggcacagacuucacccuuacaaucagcagacuggagccggaagauuuugcuguuuacuauugucagcaguacgggucuagcccccggaccuucggaggcgggaccaaaguggagauuaagcgc

SEQ ID NO: 43377 - RNA, 735 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggaggcaccuucucuagcuacgccaucuccugggucagacaagcgccugggcagggacucgaauggaugggcgggauuaucggaauguuuggcacagcuaacuaugcccagaaauuccagggccgggugacgauuaccgccgacgaguuuacaucuaccgcuuacauggaacugagcucccuucgcagcgaggauacagccguuuauuacugugcuagagggaauuauuacuaugagucuucccuggacuacuggggacaaggcacccucgugacagucagcucugggaccggaggcuccgggggaacgggcagcggcaccgggggaucuacacaguccgugguuacccagccgcccagcguguccgucgccccuggccagacagcgcggauuaccugcgggggaaacaauaucggcucuaaaagcgugcacugguaccaacagaagcccgggcaggccccugugcuggucguuuaugaugacuccgaucgccccagcggaaucccugaaagauucucuggcuccaacagcggcaauacggcuacacuuaccaucucucggguggaggccggggacgaagcugauuacuauugucaggugugggacagcuccucugaucauuacgucuuuggaacaggcaccaaggugaccguucugggg

SEQ ID NO: 43378 - RNA, 735 nt, Artificial Sequence
  derived and/or modified sequence opt5 from anti-influenza_Chain
gaggugcagcugguccaaagcggcgccgaaguuaagaaacccggggcuuccgugaaggugucuugcaaagccagcggauacaccuucacaggcuauuacgucuauugggugagacaggcgccugggcagggacucgaguggaugggcuggaucuccgcuuacaacgggaauacgaacuaugcccagaaguuucaaggacggguuaccauuacagccgacaaaucuaccagcacagcuuacauggaacuguccucucuucgcagcgaggauaccgccguguauuacugugcuagaucccggagccuggacgucuggggccagggcacaaccgugacgguuucuuccgggaccggaggcagcgggggaacaggcucugggaccggaggcuccacagauguggucaugacccagagcccggacucucucgccgugucccugggcgaacgcgcgacgaucaauugcaagagcucccagucugugcuuuacagcuccaacaauaagaacuaucuggccugguaccaacagaaacccgggcagccucccaagcuccugauuuauugggcuagcacaagagagucuggagucccugaucgguucuccggcagcgggucuggaaccgacuuuacacugaccaucagcucccuccaggccgaggauguugcuguguacuauugucaacaguacuauucuacaccccugaccuucggcgggggaacgaaaguggacauuaagcgc

SEQ ID NO: 43379 - RNA, 735 nt, Artificial Sequence
  derived and/or modified sequence opt5 from anti-influenza_Chain
gaggugcagcuggucgaaaccggcgccgagguuaagaaacccgggagcuccgugaaggugccuugcaaaucuagcggauccccguucagaucuaacgcugucagcugggugcggcaagcccccggccaggggcucgaauggguuggaggcauccuggggguguuuggauccccuucuuacgcgcagaaguuccagggccgcgucacaauuacggcugacgagagcaccaauacagugcacauggaacuuagaggccugcgguccgaggauaccgccguuuauuacugugcccgcgggcccacauauuacuauagcuacauggacguguggggaaaaggcaccacagucaccgugucuuccgggacgggaggcagcgggggaaccggcucuggcacagggggauccaccagcuaugugcucacacaaccucccucugaguccgucgcuccuggccagaccgccagaaucacgugcgggggaaacaauauuggccggaacagcguucauugguaccagcagaagccggggcaagcucccgugcugguggucuacgaugacuccgaucgcccuucuggaauccccgaaagauuuagcggcuccaagagcggcaauacagccacccuuauuaucucucggguggagguuggggacgaagcggauuauuacugucagguguggcacuccagcucugaccauuaugucuucggaacaggcaccaaagugaccguucugggg

SEQ ID NO: 43380 - RNA, 735 nt, Artificial Sequence
  derived and/or modified sequence opt5 from anti-influenza_Chain
cagaugcaacuggugcagagcggcgccgaggucaagaaacccggguccucuguuaaggugagcugcaaggcuuccggaggcaccuucucuagcuacgccaucuccugggugagacaggcgccugggcagggacucgaauggaugggcgggauuuuuggaauguucggcacagcuaacuaugcccaaaaguuucagggccgggucacgaucaccgccgacgaguucacaucugcugccuacauggaacugagcucccuugggagcgaggauaccgcuauguauuacugugcccgcagcuccggauauuacccgcaguauuuucaggacuggggccaagggacacuggugaccguuagcucuggaacaggcggguccggaggcaccggcagcgggacgggaggcucuaccgaaauugugaugacacagucccccgggacccucagccuguccccuggacagagagcgacacuuucuugccgggccagccaguccgucucuucuuccuaccuggcuugguaccaacagaaacccggccaggccccucgccuccugauguauggggcuagcucuagagccaccggaauccccgaucgguucagcggcuccggcucugggacggacuuuacacugaccauuagccgccucgagccugaggauuucgcgguguacuauugucaacaguacggauccagcucucugacauuuggcgggggaaccaaacuugaaaucaagaga

SEQ ID NO: 43381 - RNA, 735 nt, Artificial Sequence
  derived and/or modified sequence opt5 from anti-influenza_Chain
caggugcaacugguccagagcggcgccgagguuaagaaacccggguccucugugaaggugagcugcaaggcuuccggagucaccuucucuuacuaugccaugagcugggugagacaggcgccuggccaggggcucgaauggaugggaggcaucuccccgauguuugggacaacgaccuacgcucaaaaauuccagggacggguuacaauuaccgccgacgauucuacaagcaccgccuauauggaggugcgcucccugagaagcgaagacacagcugucuacuauugugcccggucuuccaacuacuaugauagcguguacgacuacuggggccagggcacccuuguuacggugucuuccgggaccggaggcagcgggggaacaggcucugggaccggaggcuccacacagagcgucgugacccaacccccuuccgagucuguggcucccggccagacggcccgcaucacaugcgggggacacaauauuggcagcaacuccguccauugguaucagcagaaaccugggcaagcgcccguucuggugguguacgauaauagcgacagaccuucuggaaucccggaacgguuuuccggcagcaacucugggaauaccgccacacucaccauuagccgcgucgaggcuggagaugaggccgacuauuacugucagguguggggcuccucuagcgaucacuauguuuucggcaccgggacaaaggugacgguccuggga

SEQ ID NO: 43382 - RNA, 738 nt, Artificial Sequence
  derived and/or modified sequence opt5 from anti-influenza_Chain
caggugcaacugguccagagcggcgggggacucguuaagcccggcgggucccugagacuuucuugcgccgcuagcggauucaccuuuuccucuuacagcaugaacugggugcggcaggccccuggcaaagggcuggaguggguguccucuaucagcuccucuagcuccuauauuuacuaugucgacagcgugaagggacgcuucacaaucucuagagauaaugcgaaaaacucccucuaccugcagaugaauagccuucgggcugaagacacggccguuuauuacugugcccgcggcggcgggucuuauggagcuuacgagggcuuugauuacugggggcaaggaacccuggugacagucuccagcggcaccgggggauccggcggcacagggucuggaaccggcgggagcacagaaauugugcucacccaguccccgggaacgcugagccugucucccggcgagagagccacccucuccugccgggcuagccagcgcguuucuagcuaucuggccugguaccagcaaaagccugggcaggcgcccagacuucugaucuauggagccuccacacgggcugccggcauuccugaccgcuucucuggcagcggguccggaaccgauuuuacacucaccaucagcagacuggaacccgaggacucugcuguguacuauugucagcaguacggccggacgccucuuacauucgggggaggcaccaaagucgagaucaagcgc

SEQ ID NO: 43383 - RNA, 738 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggaggcccuuucagaucuuacgccaucagcuggguccggcaagcgccggggcagggacccgaauggaugggcgggauuaucccuauuuuuggaaccacaaaauaugcucccaaauuccagggccgcgugacgaucaccgccgacgauuuugccggcacaguuuacauggagcucuccucucugagaagcgaagacaccgcuauguauuacugugccaagcacaugggguaucaggugcgggagacaauggaugucuggggaaagggcaccacagugaccguuuccagcgggacgggaggcucugggggaaccggcuccggcacagggggaagcaccucuuacgugcuuacacaaccucccuccgucagcguggcuccuggccagaccgcccgcauuacgugcgggggaaacaauaucggcucuaaauccgugcauugguaucagcagaagccggggcaagcgcccguccugguuguguacgacgauagcgacagaccuuccggaauccccgagcgguucucuggcagcaacuccggcaauacagccacccucacaauuagccgcguggaagcuggggaugaggccgacuacuauugucaggucugggauucuuccagcgaccacgcuguguuuggaggcgggacccagcugaccguucuugga

SEQ ID NO: 43384 - RNA, 738 nt, Artificial Sequence
  derived and/or modified sequence opt5 from anti-influenza_Chain
gaggugcagcuggucgaaaccggcgccgagguuaagaaacccggggcuagcgugaagguguccugcaaagccucuggauacacauucacgagcuauuacaugcacugggucagacaagcgccuggccaggggcucgaauggaugggauggaucaaccccaauuccggcgggaccaacuaugcucagaaguuucagggacgggugacaaugacccgcgacacaucuauuagcaccgccuacauggagcuguccagacuucggucugaugacacagccguuuauuacugugcucgcgaaggcaaauggggcccgcaagccgcuuucgauaucugggggcagggaaccauggugacggucagcuccggcaccgggggaagcggcgggacaggaucuggcaccggcggguccacagagauugugaugacccagagcccuggaacgcugucucucucccccggcgagagagccacacugagcugccgggcgucucaguccguuagcuccucuuaucuugccugguaccaacagaagccugggcaggcuccccgccugcucaucuacgacgccagcuccagagcuaccgauauuccugaccgguuuagcggaucuggcuccgggacagauuucacccugaccaucagccgccuggaaccggaggacuuugccguguauuacugucagcaauauggaucuagccucuggacauucggccagggcacgaaggucgaaaucaaaaga

SEQ ID NO: 43385 - RNA, 738 nt, Artificial Sequence
  derived and/or modified sequence opt5 from anti-influenza_Chain
gaggugcagcuggucgaaagcggcgggggacucguucaacccggcgggucccugagacuuucuugcgccgcuagcggauucaccuuuuccaucuacgccaugucuugggugcggcaggcgccuggcaaggggcuggagugggugagcgcuauuuccucuagcggagacuccacauauuacgccgauagcgucaaaggccgcuucacgaucucuagagacaacgcccggaauacccucuaucugcagaugaacucccuucgcgcugaagauacagccguguacuauugugcuagagccuacggcuauaccuuugacccgugggggcagggaacacugguuaccgugagcucuggcacagggggauccggcgggaccggaagcggcacgggcgggucuaccgagauuguccucacacaaagcccccugucccugccugugacccccggagaaccugcguccaucucuugccggagcucccagagccuccugcacucuaauggcuacaacuaccuugauugguaucugcagaagcccgggcaguccccucaacuccugauuuaccuuggaagcaaucgcgccucuggcguuccggacagauucagcggguccggaucuggcacagauuuuacccugaaaaucagccggguggaggcugaggacgucggcguguauuacuguaugcaggcccuccagacgccccugacauucgggggaggcaccaagguggaaaucaaacgc

SEQ ID NO: 43386 - RNA, 738 nt, Artificial Sequence
  derived and/or modified sequence opt5 from anti-influenza_Chain
gaggugcagcuggucgaaaccggcgccgagguuaagaaacccgggagcuccgugaaggugucuugcaaagcuagcggaggcacauucagaacgcacgccaucuccuggguccggcaagcgccugggcagggacucgaauggaugggcgggauuaucgcuauuuuuggaaccgccaacuacgcccagaaguuccagggccgcaucacaauuaccgcugacgagucuacaagcaccgccuauauggaacuguccucucuuagaagcgaggauacagcuguguacuuuugugcccggggcuccggguaucauaucagcaccccguucgacaauuggggacaaggcacgcugguuaccgugucuuccgggacaggaggcagcgggggaaccggcucuggcacagggggauccaccagcuacguccucacgcagcccccuucuguguccguugcgcccggccagacagcccgcauuaccugcgggggaaacaauaucggcagcaaaggggugcacugguaucagcaaaagccuggacaggcucccguccuggugguguacgaugacuccgauagaccuucuggcaucccggagcgguuuagcggcuccaacagcgggaauacagccacccuuaccauuucucgcgucgaagcuggagacgaggccgauuauuacugucagguuugggacuccagcucugaucaugugguguucggcgggggaacaaagcugacgguccucggc

SEQ ID NO: 43387 - RNA, 738 nt, Artificial Sequence
  derived and/or modified sequence opt5 from anti-influenza_Chain
gaggugcagcugguccaaagcggcgccgaaguuaagaaacccggguccucugugaaggugagcugcaaagccuccggaggcaucuucagaucuaacagcauuuccuggguccggcaggccccugggcagggacucgaguggaugggcgggaucuuugcgcuguucggaaccacagacuacgcucagaaguuucaaggccgcgugacgauuaccgccgaugaaucuagcacaaccguuuaucuugagcuguccagccucacaucugaagacaccgccguguacuauugugcuagaggcuccggguacacaacccggaauuauuucgauuacuggggacagggcacgcuggucaccgugagcucugggacaggaggcuccgggggaaccggcagcggcacagggggaucuaccgagaucguucuuacgcaguccccgggcacacugagccucucccccggggagcgcgccacccugucuugcagagcuagccaguccgugagcucuaacuaucugggaugguaccaacagaaaccuggccaggcuccccggcuccugauuuacggggcguccagccgcgccucuggaaucccugacagauuuagcggcggcggguccggaacagauuucacccuuaccaucucucggcuggaacccgaggacuuugcugucuauuacugucagcaauauggcagcuccccucucacauucgggggaggcacgaagguggaaauuaagcgc

SEQ ID NO: 43388 - RNA, 738 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggaggcaucuucaacucuuacgccauuagcugggucagacaagcgccugggcagggacucgaauggaugggcgggaucauugcuaucuuucacaccccgaaauaugcccagaaauuccagggacgggugacaauuacggccgacgaguccaccaauacagcuuacauggaacugcgcucucuuaagagcgaggauaccgcccuguauuacugugcuagaggcuccacauaugacuuuagcucuggccucgauuacugggggcaaggaacccugguuacaguguccagcggcaccgggggaucuggcgggacgggauccggcaccggcgggagcacacaggccggacuuacccagcccccuucugucuccguggcgcccggccagacagcccggauuaccugcgggggaaacaauaucggcagcaaguccguucauugguaucaacagaaaccugggcaggcucccgugcuggucguguacgacgauucugaccgcccuagcggaaucccggagagauucuccggcagcaacucuggcaauacggccacacucaccaucucccggguggaagcuggggaugaggccgacuacuauugucaggucugggauagcucuagcgaccacguuguguuuggaggcgggacaaagcugaccgugcuggga

SEQ ID NO: 43389 - RNA, 741 nt, Artificial Sequence
  derived and/or modified sequence opt5 from anti-influenza_Chain
cagaugcaacuggugcagagcggcgccgaggucaagaaacccggguccucuguuaaggugagcugcaaggcuuccggaggcaccuucucuagcuacgccaucacaugggugagacaggcgccugggcagggacucgaauggaugggcgggauuaucggaauguuuggcuccacgaacuaugcucaaaauuuccagggccgggucaccauuacagccgacgagucuaccagcacagccuacauggaacuguccagccuucgcucugaggauaccgcuguguauuacugugccagauccacaggguauuacccggcuuaucugcaccauuggggacagggcacccucguuacggugagcucugggaccggaggcuccgggggaacaggcagcggcaccgggggaucuacacaguccgcccugacccaaccccggagcgucuccggcucuccugggcagagcgugacgaucuccugcacaggaaccagcucugacguuggcggguacaacuacguguccugguaucagcagcaccccggaaaagcgccuaaacuuaugauuuacgaugucagcaagcgccccucuggcgugccugacagauuuagcggcuccaagucugggaauacagccagccugaccaucuccggacuccaagcugaagaugaggccgacuauuacuguagcucuuauaccuccagcucuacacauguguucggcacggggaccaaagucacaguucuggga

SEQ ID NO: 43390 - RNA, 744 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggaggcccuuucagaucuuacgccaucagcuggguccggcaagcgccggggcagggacccgaauggaugggcgggauuaucccuauuuuuggaaccacaaaauaugcucccaaauuccagggccgcgugacgaucaccgccgacgauuuugccggcacaguuuacauggagcucuccucucugagaagcgaagacaccgcuauguauuacugugccaagcacaugggguaucaggugcgggagacaauggaugucuggggaaagggcaccacagugaccguuuccagcgggacgggaggcucugggggaaccggcuccggcacagggggaagcaccucuuacgugcuuacacaaccucccuccgcuagcggcaccccugggcagcgcgucacgauuucuugcuccggaagcacauucaacaucggcuccaaugccguggacugguauagacagcugccggggaccgcgcccaaacuccugaucuacucuaacaaucagcggccuagcggagugcccgaucgcuuuuccggcagcagaucuggcacauccgccagccuugcuauuucugggcugcaaagcgaggacgaagccgauuacuauugugcugccugggacgauauccucaacgucccuguuuucggaggcgggaccaagcugaccgugcuggga

SEQ ID NO: 43391 - RNA, 744 nt, Artificial Sequence
  derived and/or modified sequence opt5 from anti-influenza_Chain
caggugcaacugguccagagcggcgccgagguuaagaaacccggguccucugugaaggugagcugcaaggcuuccggaggcccuuucagaucuuacgccaucagcuggguccggcaggcgccggggcagggacccgaauggaugggcgggauuaucccuauuuuuggaaccacaaaauaugcucccaaauuccaaggccgcgugacgaucaccgccgacgauuuugccggcacaguuuacauggagcucuccucucugagaagcgaagacaccgcuauguauuacugugccaagcacaugggguaucaggugcgggagacaauggaugucuggggaaagggcaccacagugaccguuuccagcgggacgggaggcucugggggaaccggcuccggcacagggggaagcacccagucugcucuuacacagccugccgcgguguccggcagccccgggcaaucuauuaccaucuccugcacgggaacaagcuccgacgucggcggguacaacuaugugucuugguaccagcagcauccuggaaaagccccgaagcugaugaucuacgaagugagcaaucgccccuccggcgucagcaacagauucucuggcuccaaaagcgggaauaccgcuucucucacaauuagcggacugcaggccgaggaugaggcugacuauuacuguuccucuuauaccagcuccagcaccuacguuuuuggcacagggacgaaggugaccgugcuugga

SEQ ID NO: 43392 - RNA, 744 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggaggcccuuucagaucuuacgccaucagcuggguccggcaagcgccggggcagggacccgaauggaugggcgggauuaucccuauuuuuggaaccacaaaauaugcucccaaauuccagggccgcgugacgaucaccgccgacgauuuugccggcacaguuuacauggagcucuccucucugagaagcgaagacaccgcuauguauuacugugccaagcacaugggguaucaggugcgggagacaauggaugucuggggaaagggcaccacagugaccguuuccagcgggacgggaggcucugggggaaccggcuccggcacagggggaagcaccucuuacgugcuuacacaaccucccuccgucagcggcaccccugggcagcgcgugacgauuucuugcuccggaagcagauccaacgugggcgacaauucugucuauugguaccagcauguuccggagauggcucccaaacugcucguguacaagaacacacagcggccuagcggggugcccgcccgcuucuccggaagcaaaucuggcaccuccgcgagccuggccaucaucggccuucaaucuggggaugaagcugacuauuacugugucgccugggaugacagcguggauggauauguuuuuggcuccgggacaaaggugaccguccuggga

SEQ ID NO: 43393 - RNA, 744 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggaggcccuuucagaucuuacgccaucagcuggguccggcaagcgccggggcagggacccgaauggaugggcgggauuaucccuauuuuuggaaccacaaaauaugcucccaaauuccagggccgcgugacgaucaccgccgacgauuuugccggcacaguuuacauggagcucuccucucugagaagcgaagacaccgcuauguauuacugugccaagcacaugggguaucaggugcgggagacaauggaugucuggggaaagggcaccacagugaccguuuccagcgggacgggaggcucugggggaaccggcuccggcacagggggaagcaccucuuacgugcuuacacaaccucccuccgcuagcggcaccccugggcagcgcgucacgauuucuugcuccggaagcuccucuaacaucggcagcaauuauguguacugguaccagcagcugccggggacagcccccaaacuccugaucuauagagacggacaacggccuuccggcgugcccgaucgcuucagcggcucuaaguccgggaccagcgcgucucuugccauuagcggacugagauccgacgaugaggcugacuacuauugugccacaugggaugacaaccucucuggcccugucuuugggggaggcaccaaacugaccguucugggg

SEQ ID NO: 43394 - RNA, 744 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggaggcaccuucucuuuuuacagcauguccugggucagacaagccccugggcagggacucgaauggaugggcgggaucauuccgauguucggaacaacgaacuaugcgcagaaauuucagggccgggugaccaucacagcuguugagucuaccagcacagccuacauggaaguguccagccugcgcucugaggacaccgccgucuauuacugugcuagaggcgauaaagggauuuauuacuauuacauggacguguggggaaagggcacaaccguuacgguguccagcgggaccggaggcucugggggaacaggcuccggcaccgggggaagcacacaaucugcccuuacccagcccgcuuccgucagcggcuccccugggcagucuaucacgauuagcugcacaggaaccuccagcgaugugggcggguacaauuaugugucuugguaccagcaacaccccggaaaggccccuaaacugaugaucuaugaggucuccaaccggcccagcggcguuucuaaucgcuucagcggcuccaagucugggaacacagcgagccucaccaucuccggacugcaggccgaagacgaggcugauuacuauuguagcucuuacaccuccagcucuacacuuguguuuggcacggggaccaaagugacaguccuggga

SEQ ID NO: 43395 - RNA, 744 nt, Artificial Sequence
  derived and/or modified sequence opt5 from anti-influenza_Chain
augagccuguucggcgacaccaucgccuaccuccugucccuuauugaggauggggaaggaaaggcugagcuggccgaaaaacuccacugcugguuuggcgggaaggaguucgaccuggauucugcgcuugaauggaucaaaaacaagagaugucugacagacauucagaaagcucucaucggagccagcauuugcuuucugaagcccaaggaucaagagcggaaacgcagauucaucacggagccucuguccggcauggggaccacagccaccaagaaaaagggacucauccuggcugaacggaaaaugcgcagaugugugucuuuucaugaggccuucgaaauugcugagggccacgagagcuccgcccuucuguauugccucauggucauguaccugaauccggaaaacuauucuaugcagguuaaacuuggcacacugugugcgcucugcgagaagcaggccagccauucccaccgggcucauagccgcgccgcuagaucuuccgugcccggggugcggcgcgaaaugcagauggucagcgccaugaauaccgcgaagacaaugaacggaaugggcaagggggaggacgugcaaaaacuggccgaggaacugcagaauaacaucggaguucucagaucucugggcgcuucccagaagaauggggagggaauugccaaagaugugauggaaguccuuaagcagagcucuaugggcaacuccgcucuggugcggaaauaccuc

SEQ ID NO: 43396 - RNA, 747 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggaggcccuuucagaucuuacgccaucagcuggguccggcaagcgccggggcagggacccgaauggaugggcgggauuaucccuauuuuuggaaccacaaaauaugcucccaaauuccagggccgcgugacgaucaccgccgacgauuuugccggcacaguuuacauggagcucuccucucugagaagcgaagacaccgcuauguauuacugugccaagcacaugggguaucaggugcgggagacaauggaugucuggggaaagggcaccacagugaccguuuccagcgggacgggaggcucugggggaaccggcuccggcacagggggaagcacccaaucugugcuuacacagccucccuccgucagcgcugccccuggccagaaagugaccauuucuugcuccgggagcuccucuaacaucggaaaugacuacgugagcugguaucagcaacugccgggcacggcgcccaagcuccugaucuacgauaacaauaaacgcccuuccgggauucccgacagauucagcggaucuaaguccggcacaagcgccacccuuggcaucacagggcugcagaccggagaugaggcuaacuacuauugugccaccugggaccggcgcccuacagcuuacgucguuuuuggcgggggaacgaaacucaccgugcugggc

SEQ ID NO: 43397 - RNA, 750 nt, Artificial Sequence
  derived and/or modified sequence opt5 from anti-influenza_Chain
caggugcaacugguccagagcggcgccgagguuaagaaacccggguccucugugagagugagcugcaaggcuuccggaucuaucuuccggaacuacgccaugagcuggguccgccaggcgccuggccaggggcucgaauggaugggaggcauuaucgcuauuuuugggaccccgaaauaugcccaaaaguuccagggaagagugacaaucacggccgacgaguccaccucuacaguuuacauggaacugagcggccuucgguccgaggauaccgcuauguauuacugugcccgcauuccccacuauaauuuuggcagcgggucuuacuucgacuauuggggacagggcacacuggugaccgucuccagcgggacaggaggcucugggggaaccggcuccggcaccgggggaagcacgacagugcucacccagccucccucuguuuccggcgcuccugggcaaagagugacaaucagcugcaccggauccucuagcaacaucggcgccggguacgauguccauugguaccagcagcugcccggaacggcgccuaaacuucugauuuauggcaauuccaaccggccgagcggcgugcccgaccgcuuuucuggguccaagagcggaacaucugccacccucggcaucacagggcugcagaccggagaugaagcugacuacuauuguggcaccugggauagcucccugucugccuacguguucgggacaggcacgaaggucaccguucucgga

SEQ ID NO: 43398 - RNA, 756 nt, Artificial Sequence
  derived and/or modified sequence opt5 from anti-influenza_Chain
gaggugcagcuggucgaaagcggcgccgagguuaagaaacccggguccucugugaaggugagcugcaaagccuccggacacaucuucucuggcuacgccauuagcugggucagacaagcgccugggcagggacucgaauggaugggcgggaucauuccgaucuuuggaaccacaaacuaugcucagaaguuccagggccgggugacgauuaccgccgaccaauccacaucuaccgccuacauggaucugagcaaucuucgcuccgaggacacagcuguuuauuacugugccagagugaaagauggcuauugcacccugacaagcugucccgucgggugguacuuugaccucuggggacggggcacccuggugacgguuucuuccgggaccggaggcagcgggggaacaggcucuggcaccgggggauccacagaaaucgugaugacccagagcccuggcacgcuuucucugucccccggggagcgcgcuacacucagcugcagagccucccagucugucagcuccagcuaucuggcgugguaccagcaaaagccuggacaggcuccccggcugcucaucuucggcgcuucuucccgcgccaccgggauuccugauagauuuagcggaucuggcagcggcacagacuucacccugaccaucucccggcuugagccggaagauuuugcuguguacuauugucagcaguacgggucuagccugacauucggaggcgggacgaagcucgagauuaaacgc

SEQ ID NO: 43399 - RNA, 768 nt, Artificial Sequence
  derived and/or modified sequence opt5 from anti-influenza_Chain
caggugcaacugguccagagcggcgccgagguuaagaaacccggguccucugugaaggugagcugcaaggcuuccggaggcuucuuuucuagcuacgccaucuccugggucagacaggcgccugggcagggacucgaauggaugggcggggugauuccgaucuuccggaccgcuaacuaugcccaaaauuuucagggacgcguuacaauuacggccgacgaguucaccucuuacauggaacugagcucccuuagaagcgaugacacagcuguguauuacugugcccggcugaacuaucacgauucuggcaccuacuauaaugcuccccgcggcugguuugacccuugggggcagggaacacucgucaccguguccagcggcacagggggaucuggcgggaccggauccggcacgggcgggagcaccgauauccagaugacacaaucucccgacucccuggccguuagccuuggagagaaagcgaccauuaacugcaaauccucucagagcauccucaauuccagcaacaauaagaacuaccuggccugguaccagcagaagccuggccaacccccuaaacugcugaucuauugggcuucuacaagagaauccggggugccggaucgguucagcggaucuggcagcgggaccgacuuuacgcucacaauuuccucucugcaggccgaggaugucgcuguguacuauugucagcaauacuauagcuccccucccaccuucggacagggcacaaagguggagaucaaacgc

SEQ ID NO: 43400 - RNA, 768 nt, Artificial Sequence; identical to SEQ ID NO: 43399
  derived and/or modified sequence opt5 from anti-influenza_Chain

SEQ ID NO: 43401 - RNA, 771 nt, Artificial Sequence
  derived and/or modified sequence opt5 from anti-influenza_Chain
aucugcauuggcuaccacgccaacaauagcaccgaacagguggacacaaucauggaaaagaacgucacgguuacccaugcucaagauauucuggagaaaacacacaaugggaagcucugugaccuggauggagugaaaccccuuauccugagagacugcuccguggccggcuggcuccuggggaacccuaugugugaugaguucauuaaugucccggaguggucuuauaucguggaaaaggcgaaccccgcuaaugaccuuugcuacccuggaaacuuuaaugauuaugaggagcugaaacaucuccugagccggaucaaccacuucgaaaagauucagaucauucccaaguccucuuggagcgaccaugaggccuccucuggcguuagcuccgccuguccuuaccaggggacccccagcuuuuuccgcaauguggucuggcugaucaaaaagaacaauacauauccuaccauuaaaagaucuuacaacaauacaaaccaggaagaucuccugauccuuuggggcauucaccacuccaacgacgcugccgagcaaaccaagcuguaucagaauccgacgaccuacaucagcgugggaacaucuacccucaaccagcggcugguucccaaaaucgcuacacgcuccaaggugaauggccagaacgggagaauggacuuuuucuggaccauucuuaagccuaaugaugccaucaacuuugagagcaauggaaacuucauugcgcccgaauacgccuauaaaaucgucaagaaa

SEQ ID NO: 43402 - RNA, 771 nt, Artificial Sequence; identical to SEQ ID NO: 43401
  derived and/or modified sequence opt5 from anti-influenza_Chain

SEQ ID NO: 43403 - RNA, 777 nt, Artificial Sequence
  derived and/or modified sequence opt5 from anti-influenza_Chain
auggugaaaagcaaauaccuggucuucaucuccguguuuucucuccuguucggcguguuuguggucggguucagccaccagggagugaaggccgaggaagagagacccaugggcaccgcuuuuuaugaauccuucgacgccuuugaugacgagcgguggucuaaagcggggguuuggacaaacggacaaauguucaaugcuacgugguacccugaacaggugaccgccgauggccuuaugcgccugacaauugccaagaaaaccacaagcgcuagaaacuauaaggccggggagcuccggaccaaugacuuuuaccauuauggacuguucgaggucuccaugaagccggcuaaaguggaaggcacaguuucuagcuuuuucaccuacacgggcgagugggauugggacggggaucccugggacgaaaucgauauugaguuucuuggaaaggacaccacacgcauccaguucaacuauuucaccaauggcguugggggaaacgaguuuuacuacgaucugggcuucgacgccuccgagagcuuuaauacauaugcguucgaauggagagaagauucuauuaccugguacgucaacggggaggccgugcacacggcuacagaaaauaucccucagacaccccaaaagaucaugaugaaccucuggccuggagugggcgucgacggcuggaccgggguuuuugacggagauaauacccccguguauuccuacuaugacugggugcgguacaccccucugcagaacuaucagauucaucag

SEQ ID NO: 43404 - RNA, 777 nt, Artificial Sequence; identical to SEQ ID NO: 43403
  derived and/or modified sequence opt5 from anti-influenza_Chain

SEQ ID NO: 43405 - RNA, 783 nt, Artificial Sequence
  derived and/or modified sequence opt5 from anti-influenza_Chain
gacauccagaugacccaaagccccuccucugugagcgccuccgucggcgauagaguuacaauuacgugccgggcuucucaggacaucagcaccuggcuggccugguaccagcagaagccugggaaagcgccgaagcuccugauuuaugcugccuccucucuucaaagcggagugcccucccgcuucagcggcucuggguccggaacagauuuuacccugacaaucagcucucuccagccugaggacuucgccaccuacuuuugucagcaggcuaacuccuuucccccuacauucggcugcgggaccaaacuggaaauuaagggaggcggcgggagcggaggcgggggaucuggcgggggaggcuccggcgggggaggcagcgaggugcaacuugucguguccgggggaggccugguuaaacccgggggaucucucagacugagcugugccgcuuccggccugagcuuccucaaugccuggaugucuugggugcggcaggcgccuggcaagugccuggaaugggucgggcgcaucaaguccaacacggauggaggcaccacagacuaugccgcuccggugaaagggagauuuagcaucucucgggaugacagcaagaauaugcuuuuccugcacauguccucucuccgcaccgaggauacagccguuuacuauugugcuaccgacggacccuacagcgaugacuuuagauccggcuaugccgcgcgguaccgcuacuucgggauggauguguggggccagggaacgacagucaccgugagcucu

SEQ ID NO: 43406 - RNA, 783 nt, Artificial Sequence; identical to SEQ ID NO: 43405
  derived and/or modified sequence opt5 from anti-influenza_Chain

SEQ ID NO: 43407 - RNA, 789 nt, Artificial Sequence
  derived and/or modified sequence opt5 from anti-influenza_Chain
augggcuucgugcuguuuagccagcuccccuccuuccugcuugucucuacccugcuccuguuucuuguuaucagccacuccugcagagcccaaaacgggggaucuuacccuuauaagagcggcgaguaccggacaaaauccuucuuuggguauggauacuaugaagugcgcaugaaggcugccaaaaaugugggcauugucucuagcuucuuuacguacaccgggccguccgacaacaaucccugggaugagaucgacauugaguuccugggaaaggauacaaccaaagugcaguuuaacugguauaagaauggcguuggcgggaacgaauaccuccauaaucugggauucgacgcgagccaggauuuucacacauacggcuucgaauggagaccugacuauaucgauuuuuacguggacgggaagaaagucuaucggggaacccgcaacauucccgugacaccuggcaagaucaugaugaaucuguggcccgggaucggaguugaugaguggcucggcagauacgacggccggaccccucugcaggcugaguaugaauacgugaaauauuacccgaacgggcgcucuaaacuugucgugaauacgcccuucguggccgucuucuccaacuuugauagcucucaaugggagaaggccgacugggcuaauggauccguuuucaacuguguguggaagccuagccaggugaccuuuucuaauggcaagaugauucugacacucgauagagaauacgucgaccaucaccaucaccaccauaaagacgagcug

SEQ ID NO: 43408 - RNA, 789 nt, Artificial Sequence; identical to SEQ ID NO: 43407
  derived and/or modified sequence opt5 from anti-influenza_Chain

SEQ ID NO: 43409 - RNA, 840 nt, Artificial Sequence
  derived and/or modified sequence opt5 from anti-influenza_Chain
auggcccaggugggcagaggggcuagcccccugucccgggcccgcgucccuccgcucccccacccucuggacggagagcaucuuccccacgauccugcgggcgggggacauggcaaggcuucuagccaagacgcccccguugggcagcugccuggacaccucgccagaccggcuuucuuucauuaccugaaaaacuccuuccuugugugcucucugaccacaguguuugcccucgcugucgccacguucgcgggcuaugcccuggcucgguuucgcuuccccggcgccgaacuguuugggggaagcgugcucguuacccaggugaucccuggcauucuguuccuuauccccauuuacaucauguauauuuacguccagaauugggugagauccgcucuggggcucgagguucggcuggugggaucuuauggcgggcuugucuuuacauacaccgccuucuuugugccucugagcaucuggauccuccgcggauucuuugcguccauucccaaggaacuggaggaagccgcuaugguggauggcgccacaccguuccaggcuuuccacagagucauccugccucucgcccugcccggccuugccgcuaccgcgguuuauauuuuucugacagccugggacgagcuccuguucgcucaagugcuuaccacggaggccaccgccacagugccugucgggauccggaacuuugugggaaauuaccagaaccgcuacgaucugguuauggcugccgcgaccguggcuacacuccccguccuggugcuguucuuuuucguucagagacaacucauucagggccugaccgccggggccgugaaagga

SEQ ID NO: 43410 - RNA, 840 nt, Artificial Sequence; identical to SEQ ID NO: 43409
  derived and/or modified sequence opt5 from anti-influenza_Chain

SEQ ID NO: 43411 - RNA, 843 nt, Artificial Sequence
  derived and/or modified sequence opt5 from anti-influenza_Chain
auggccgacaacaugaccacaacgcagaucgaggugggccccggggcuaccaaugccacaauuaacuucgaagcgggaauccuggagugcuacgaaagauuuagcuggcaacgggcucucgauuauccuggccaggaccgccugcacagacuuaagcggaaacuggagucccgcauuaagacccauaauaaaucugaaccggagaacaagagaaugagccucgaggaacggaaagccaucggggucaagaugaugaagguucugcuuuucauggaucccuccgccggaauugagggcuuugaaccuuacugugugaaaaaucccucuacaagcaagugcccuaacuaugacuggaccgauuaucccccuacaccggggaaauaccuggacgauaucgaggaggaacccgagaauguggaccacccuaucgaagucgugcuccgcgauaugaacaauaaggacgcuagacagaaaauuaaggaugagguuaacacccagaaggaaggaaaauuccggcugacgaucaagcgcgacauuagaaaugugcugucccuccggguccuggugaacggcaccuuucuuaaacaucccaauggcgauaagucucugagcacacuccaccgccugaacgccuacgaccaaaaugggggacuuguugcuaaacugguggccaccgacgauagaacagucgaggacgagaaggauggccaucggauccucaacucccuguucgaacgcuuugacgaggggcacagcaaaccuauuagagcggccgaaaccgcugugggagugcugucucaguucggccaggagcaccggcucucccccgaagagggggauaac

SEQ ID NO: 43412 - RNA, 843 nt, Artificial Sequence; identical to SEQ ID NO: 43411
  derived and/or modified sequence opt5 from anti-influenza_Chain

SEQ ID NO: 43413 - RNA, 858 nt, Artificial Sequence
  derived and/or modified sequence opt5 from anti-influenza_Chain
augugcaccaugccccugaugaagcucaaaaagaugaugagacggacagccuuccugcuuagcgugcugaucggcuguuccaugcucgggucugaccgcagcgauaaagcuccucacugggagcuggucugguccgacgaauuugauuacucuggacuuccggaccccgagaagugggauuaugacguuggcgggcauggauggggcaaccaggaacugcaauacuauacgagagcccggauugagaaugcgcgcgucgggggaggcgugcucaucauugaagcuagacacgagccuuacgagggccgggaauauaccagcgcccgccuggugacaagagggaaagccuccuggaccuacggacgguucgagauccgcgcuagacugcccucuggccgggggacauggccugccauuuggaugcuccccgaucgccagaccuauggaagcgcuuacuggccugacaacggcgaaaucgauaucauggagcaugugggguuuaauccggacguugugcacggaacaguccauaccaaggccuacaaccaucugcuuggcacgcagagaggcggguccauucgggugcccaccgcgcgcacagauuuccacguuuaugccaucgaguggaccccugaagagauuagaugguuuguggacgauagccuguacuaucgguuccccaaugaaagacucacagacccugaggcugacuggcgccacuggcccuuugaucagccguuccaccugaucaugaacauugccgucggaggcgcuuggggagggcaacagggcguggacccugaagccuuucccgcgcagcuuguggucgauuacguucggguguauagauggguggag

SEQ ID NO: 43414 - RNA, 858 nt, Artificial Sequence; identical to SEQ ID NO: 43413
  derived and/or modified sequence opt5 from anti-influenza_Chain

SEQ ID NO: 43415 - RNA, 900 nt, Artificial Sequence
  derived and/or modified sequence opt5 from anti-influenza_Chain
aacgugcccgaguggagcuacaucgucgaaaaggccaauccugcuaacgaccugugcuauccgggcaauuucaacgauuacgaggaacucaaacaucugcuuuccagaauuaaucacuuugagaagauccagggguauauucccgaagccccucgggacggacaagcguacguucgcaaagauggcgagugggugcugcucucuaccuuccugagaagcgacaagacacacacgugucccccuugccccgcuccugagcuucucgggggaccguccguguuucuguuucccccuaaacccaaggauacccugaugaucucucggacaccugaagucaccugugugguuguggacgucagccaugaggaucccgaagugaaguucaacugguauguugacggcguggagguccacaaugccaaaacaaagccgcgcgaggaacaguacaacuccaccuauagaguggugucuguccugacaguucuccaucaggauuggcugaaugggaaagaguacaagugcaaagugagcaacaaggcccuuccugcucccauugaaaagaccaucuccaaagccaagggacagccucgggagccccaaguguacacgcugcccccuagccgcgaagagaugaccaaaaaucaggucucucucacaugucuggugaagggcuucuauccguccgacaucgcuguugagugggaaagcaacggccagcccgagaauaacuacaaaaccacaccucccgugcuugauucugacggguccuuuuuccuguauagcaagcucaccgucgauaaaucuagauggcagcaaggaaauguguuuuccugcagcguuaugcacgaagcccugcacaaccauuacacgcagaagucccugucucucagcccuggcaag

SEQ ID NO: 43416 - RNA, 900 nt, Artificial Sequence; identical to SEQ ID NO: 43415
  derived and/or modified sequence opt5 from anti-influenza_Chain

SEQ ID NO: 43417 - RNA, 927 nt, Artificial Sequence
  derived and/or modified sequence opt5 from anti-influenza_Chain
auggugaacagacgggaccugaucaaguggagcgccgucgcucucggcgccggggcgggacuggcuggccccgccccugccgcucacgccgcugaucuugagugggaacaguacccgguucccgccgcgccugggggaaaucgcuccuggcaacugcuccccucucauagcgacgauuucaacuauaccggcaaaccucagacauuuagagggcgguggcuggaccagcacaaggauggaugguccggccccgccaauucucuuuacagcgcucgccauuccuggguggccgacggcaaccugauuguggaggggagacgggcuccugauggacgcgucuauugcggcuacgugacgucuagaaccccgguugaauauccccucuacacagaggugcugaugcgggucagcgggcugaaacucuccagcaauuucuggcugcuuucucgcgacgaugugaacgaaaucgacguuauugaguguuauggaaaugagucccugcacggcaagcauaugaacaccgccuaccacaucuuucagagaaauccuuucacagaacucgcgcggagccaaaaaggguacuuugccgauggaucuuauggcuacaacggcgagaccggacagguguucggggacggcgcugggcagccccugcuucgcaauggauuucacagauauggcguccauuggauuuccgccacagaguucgauuuuuacuucaacgggcggcuggugcgcagacucaaucggagcaacgaccugagagacccucgcucucgguuuuucgaucagcccaugcaccugauccucaauaccgaaucccaucaauggagaguggaccgcggaaucgagccgacggaugcugaacuggccgacccuagcauuaacaacaucuauuaccggugggucagaaccuaucaggccguu

SEQ ID NO: 43418 - RNA, 927 nt, Artificial Sequence; identical to SEQ ID NO: 43417
  derived and/or modified sequence opt5 from anti-influenza_Chain

SEQ ID NO: 43419 - RNA, 960 nt, Artificial Sequence
  derived and/or modified sequence opt5 from anti-influenza_Chain
aucugcauuggcuaccacgccaacaauagcaccgaacagguggacacaaucauggaaaagaacgucacgguuacccaugcucaagauauucuggagaaaacacacaaugggaagcucugugaccuggauggagugaaaccccuuauccugagagacugcuccguggccggcuggcuccuggggaacccuaugugugaugaguucauuaaugucccggaguggucuuauaucguggaaaaggcgaaccccgcuaaugaccuuugcuacccuggaaacuuuaaugauuaugaggagcugaaacaucuccugagccggaucaaccacuucgaaaagauucagaucauucccaaguccucuuggagcgaccaugaggccuccucuggcguuagcuccgccuguccuuaccaggggacccccagcuuuuuccgcaauguggucuggcugaucaaaaagaacaauacauauccuaccauuaaaagaucuuacaacaauacaaaccaggaagaucuccugauccuuuggggcauucaccacuccaacgacgcugccgagcaaaccaagcuguaucagaauccgacgaccuacaucagcgugggaacaucuacccucaaccagcggcugguucccaaaaucgcuacacgcuccaaggugaauggccagaacgggagaauggacuuuuucuggaccauucuuaagccuaaugaugccaucaacuuugagagcaauggaaacuucauugcgcccgaauacgccuauaaaaucgucaagaaaggcgauucugcuauugugaaguccgagguggaauacgggaauugcaacacgaaaugucaaacaccuaucggagccaucaauagcuccaugcccuuucauaacauucacccgcugaccaucggcgagugcccuaaguaugucaaaucuaauaagcucguucuggcuacagggcugcggaacagcccccuc

SEQ ID NO: 43420 - RNA, 960 nt, Artificial Sequence; identical to SEQ ID NO: 43419
  derived and/or modified sequence opt5 from anti-influenza_Chain

SEQ ID NO: 43421 - RNA, 960 nt, Artificial Sequence; identical to SEQ ID NO: 43419
  derived and/or modified sequence opt5 from anti-influenza_Chain

SEQ ID NO: 43422 - RNA, 978 nt, Artificial Sequence
  derived and/or modified sequence opt5 from anti-influenza_Chain
acccugugcaucggcuaccacgccaacaauagcacagacacgguggauaccguccucgagaagaacguuacagugacccauuccgugaaucugcuugaagacaaacacaacgggaagcuguguaaacucagaggagucgcuccccugcaucuuggcaagugcaauauugccggguggauccugggaaacccugagugugaaucucucagcacagcguccucuuggagcuauauuguggagaccuccucuagcgauaauggcacaugcuacccgggggacuucaucgauuaugaggaacugcgggagcagcuguccagcguuucuuccuuugaacgcuucgagauuuuucccaaaaccagcucuuggccuaaccacgacuccaauaagggagugacggcugccuguccccaugccggcgcuaagagcuucuacaaaaaccucaucuggcuggucaagaaaggcaauucuuauccuaaacuuuccaagagcuacaucaacgauaaggggaaggaagugcugguucucuggggcauucaccaccccuccaccucugccgaccaacagagccuguaucagaaugcugaugccuacguguuugucggaacauccagauacagcaaaaaguucaaaccugagaucgcgauucggccgaaggugcgcgaccaggaggggagaaugaacuauuacuggacccuuguggaacccggagauaaaaucacauuugaggccaccggcaaucuggucguuccucgguaugcuuucgccauggaacgcgacgcugggucuggaauuaucauuuccgauacgcccgugcaugacugcaacacaaccugucaaacaccuaagggcgccaucaacaccagccuccccuuucagaauauccacccgauuaccaucggcaaaugcccuaaguacgugaagucuacaaaacugagacuggcgacggggcuccggaacguccccagcauucagucccgc

SEQ ID NO: 43423 - RNA, 978 nt, Artificial Sequence; identical to SEQ ID NO: 43422
  derived and/or modified sequence opt5 from anti-influenza_Chain

SEQ ID NO: 43424 - RNA, 960 nt, Artificial Sequence; identical to SEQ ID NO: 43419
  derived and/or modified sequence opt5 from anti-influenza_Chain

SEQ ID NO: 43425 - RNA, 990 nt, Artificial Sequence
  derived and/or modified sequence opt5 from anti-influenza_Chain
augugcagcuccauccccucucugagagagguguucgccaacgacuuucggauuggcgcugccgucaauccuguuacccucgaagcgcagcaaagccugcuuauccgccacgugaacucccugacagcugagaaucauaugaaguucgaacaccuccagccggaggaagggagauuuacguucgauauugccaucaaaucuagcaccucccccuuuucuagccauggagugcggggccacacacuggucuggcauaaccagaccccuuccuggguguuccaggacagccaagggcacuuuguuggacgcgaugugcuucuggagagaaugaagucucacauuuccacagucgugcagcgguacaaaggcaagguuuauuguugggacgugaucaaugaggccgucgcugaugaagggagcgaguggcuccgcagcuccaccuggagacagaucauuggagacgauuucauccagcaagccuuucuguacgcucaugaagccgaccccgaggcgcuccuguucuauaacgauuacaaugagugcuuuccugaaaaacgggagaagauuuauacacuggugaagucucuucgcgacaaaggcauccccauucacggcaucgggaugcaggcccauuggucucugaacagaccuacccucgaugaaauucgggcugccaucgagcgcuacgcuucccugggagugauccuucacauuacggaacuggacaucagcauguucgaguuugaugaccacagaaaggaccucgccgcgccgaccaaugagauggucgaacggcaggccgagcgcuaugaacagauuuucucccuguucaaagaguacagagauguuauccaaaacgugacauuuuggggcauugcugacgaucauaccuggcuggaccacuuccccgugcaggggcggaagaauuggccucuccuguuugaugaacagcauaaccccaaaccugccuucuggagagucgugaauauc

SEQ ID NO: 43426 - RNA, 990 nt, Artificial Sequence; identical to SEQ ID NO: 43425
  derived and/or modified sequence opt5 from anti-influenza_Chain

SEQ ID NO: 43427 - RNA, 1002 nt, Artificial Sequence
  derived and/or modified sequence opt5 from anti-influenza_Chain
augaagaacagagugaucagccugcucauggccucccugcuucugguccucucuguuauuguggcucccuucuacaaagccgaggcggcuaccguggucaauacaccuuuuguggccguuuucagcaacuuugacuccucucagugggaaaaggccgauugggcuaauggcagcguguucaacugcgucuggaaaccgucccaagugacguuuucuaaugggaagaugauccugacccuugaccgggaguauggaggcagcuaccccuauaaauccggggaauaccgcacaaagagcuucuuuggauauggcuacuaugagguuagaaugaaggccgcuaaaaacguggggauugucucuuccuucuuuaccuacacaggaccuagcgauaauaaccccugggacgaaaucgauauugaguuccugggcaaggacaccacaaaagugcaguuuaauugguacaagaacggcgugggaggaaaugaguaucuccacaaccugggcuucgaugccucucaggacuuucauaccuacggguucgaauggcggccugauuauaucgacuucuacgucgaugggaaaaagguuuaucgcggcacgagaaauauccccgugaccccugggaagauuaugaugaaccuguggccgggaaucggcguggacgaguggcucggccgguacgaugggcgcacaccccugcaggcggaauaugaguacgucaaauacuauccuaauggagugccccaagacaacccuacccccacaccgaccauugccccuuccacgcccacaaacccuaaucuuccccugaagggcgacguuaacggggauggacacgugaauagcucugacuacucccucuuuaaaagauaucugcuucgggucaucgaucgcuuccccgugggcgaccagagcguugcugaugugaacagagacgggcggauugauuccaccgaccugacaaugcucaagcgcuaccugaucagagccauuccuucucug

SEQ ID NO: 43428 - RNA, 1002 nt, Artificial Sequence; identical to SEQ ID NO: 43427
  derived and/or modified sequence opt5 from anti-influenza_Chain

SEQ ID NO: 43429 - RNA, 1041 nt, Artificial Sequence
  derived and/or modified sequence opt5 from anti-influenza_Chain
aucugcauuggcuaccacgccaacaauagcaccgaacagguggacacaaucauggaaaagaacgucacgguuacccaugcucaagauauucuggagaaaacacacaaugggaagcucugugaccuggauggagugaaaccccuuauccugagagacugcuccguggccggcuggcuccuggggaacccuaugugugaugaguucauuaaugucccggaguggucuuauaucguggaaaaggcgaaccccgcuaaugaccuuugcuacccuggaaacuuuaaugauuaugaggagcugaaacaucuccugagccggaucaaccacuucgaaaagauucagaucauucccaaguccucuuggagcgaccaugaggccuccucuggcguuagcuccgccuguccuuaccaggggacccccagcuuuuuccgcaauguggucuggcugaucaaaaagaacaauacauauccuaccauuaaaagaucuuacaacaauacaaaccaggaagaucuccugauccuuuggggcauucaccacuccaacgacgcugccgagcaaaccaagcuguaucagaauccgacgaccuacaucagcgugggaacaucuacccucaaccagcggcugguucccaaaaucgcuacacgcuccaaggugaauggccagaacgggagaauggacuuuuucuggaccauucuuaagccuaaugaugccaucaacuuugagagcaauggaaacuucauugcgcccgaauacgccuauaaaaucgucaagaaaggcgauucugcuauugugaaguccgagguggaauacgggaauugcaacacgaaaugucaaacaccuaucggagccaucaauagcuccaugcccuuucauaacauucacccgcugaccaucggcgagugcccuaaguaugucaaaucuaauaagcucguucuggcuacagggcugcggaacagcccccucggauacauuccugaagcgccccgcgacggccaggccuaugugagaaaggacggcgagugggugcugcuuuccaccuuccug

SEQ ID NO: 43430 - RNA, 1041 nt, Artificial Sequence; identical to SEQ ID NO: 43429
  derived and/or modified sequence opt5 from anti-influenza_Chain

SEQ ID NO: 43431 - RNA, 1047 nt, Artificial Sequence
  derived and/or modified sequence opt5 from anti-influenza_Chain
augaacaucaagaaaaccgccgucaagagcgcucuggccgucgcggcugccgccgcugcccucacaacgaauguuuccgcuaaagacuucucuggcgccgagcuguacacccuugaagaggugcaguaugggaaguuugaagcgagaaugaaaauggccgcugccagcggaacaguguccucuauguuccuguaccaaaacggcagcgagauugcugaugggcggcccugggucgaaguggacaucgagguucucggaaagaauccuggcuccuuucagucuaacauuaucaccgggaaggccggagcgcagaaaacaagcgagaagcaccaugccguguccccggcugccgaucaggcuuuccacaccuauggccuggaauggacacccaauuacguccgcuggaccguggacggccaagagguuagaaaaacggaagggggacaggugagcaaccuuaccggcacacaggggcugcgguuuaaucucuggucuuccgagagcgccgccugggucggacaguucgaugagucuaagcugccucuguuucaauucauuaacugggugaaaguguauaaguacacccccggccagggggaaggaggcuccgacuuuacacucgauuggaccgacaauuucgauacguuugacggcagccgcugggggaagggagauuggacauucgacggcaacagagucgaucugaccgacaaaaauaucuauucucgggacgggaugcuuauccuggcucucacacgcaagggacaggaguccuuuaacggccagguuccuagagaugacgaacccgcgccucaaagcuccucuagcgccccggcuuccucuagcuccgugcccgccagcucuagcuccgugccugccucuagcuccagcgcuuucgugcccccuucuuccagcucugccaccaaugcgauucaugggaugcggaccacacccgcuguggccaaagagcaccgcaaccugguuaaugccaagggagcuaaagugaacccgaacggccauaagagauaccgggucaauuucgaacac

SEQ ID NO: 43432 - RNA, 1047 nt, Artificial Sequence
  derived and/or modified sequence opt5 from anti-influenza_Chain
gaggugcagcuggucgaaagcggcgggggaguugugcaacccggcagaucccuccggcugucuugcgccgcuagcggguucgccuuucacaaccgcgcgaugcauugggugagacaggcuccuggaaagggccuugagugggucgcccugaucuacuucgacggguccaaacaguauuacgccgauucugugaagggacgguuuaccauuagccgcgacaauuccaaaaacacaguuuuccuccagaugaauagccugagaccggaagauacggcuguguauuacugugccguccccggcccuaucuuuggcauuuucccgccuuggucuuauuuugaccacugggggcaaggaauccuugugaccguuuccagcgcuucuacaaagggccccuccguguucccucuggccccgagcucuaaauccaccagcgggggaacagcggcccucggcugccuggucaaggauuacuuucccgagccugugaccgugucuuggaacuccggggcucugacaagcggaguccauaccuuccccgccguucuccaguccucuggccuguauagccuuuccagcguggugacggucccuucuuccagccugggcacccagacauacauuuguaaugugaaccacaagcccucuaauaccaaaguugacaagaaaguggaacccaagagcugcgauaaaacacauaccuguccucccugcccugcucccgagcuccuugggggacccuccgucuuucuguucccuccgaagcccaaggacacgcugaugaucucucggacaccugaggugaccuguguuguggucgaugugagccacgaagaccccgaggucaaauuuaacugguacguggauggcguugaagugcacaaugccaagacaaaaccucgcgaggagcaguauaacuccaccuacagagucgugagcguucucaccgugcugcaucaagacuggcugaaugggaaggaauauaaaugcaaggucucuaacaaagcgcuccccgccccgaucgagaagacaauuuccaaggcuaaagga

SEQ ID NO: 43433 - RNA, 1047 nt, Artificial Sequence; identical to SEQ ID NO: 43432
  derived and/or modified sequence opt5 from anti-influenza_Chain

SEQ ID NO: 43434 - RNA, 1047 nt, Artificial Sequence; identical to SEQ ID NO: 43431
  derived and/or modified sequence opt5 from anti-influenza_Chain

SEQ ID NO: 43435 - RNA, 1161 nt, Artificial Sequence
  derived and/or modified sequence opt5 from anti-influenza_Chain
augaacaaguuccugaauaaaaaguggagccucauccugaccaugggcgggauuuuucuuauggccacacugucccucaucuucgcuacgggcaaaaaggccuuuaacgaccagaccucugcggaggauauucccagccuggcugaagccuucagagacuacuuuccuaucggagccgcuauugagccgggguauacaaccggacaaaucgccgaacuuuacaaaaagcacgugaauaugcuggucgcugagaacgccaugaagcccgcgucccuccagccuacagaaggcaauuuccagugggccgaugcugaccggaucguucaguuugccaaagagaacgggauggagcugcgcuuccauacccugguguggcacaaucaaacacccaccggauuuucucucgauaaggaaggcaaaccuaugguggaggaaacggacccccagaagagagaggagaaccggaaacugcuucugcagcgccucgaaaauuauauuagagcugucgugcugcgguacaaggaugacaucaagagcugggauguugugaacgaggucauugaaccuaaugacccgggcgggaugcgcaacucccccugguaucagaucaccggaacagaguacauugaaguggccuucagagcgacccgggaggccggcgggucugauaucaaacuuuauauuaaugacuacaacacagaugacccuguuaagcgcgacauccuguacgagcucgugaaaaaucugcuggaaaagggaguccccaucgauggcguggggcaucaaacccacauugacaucuauaacccucccguggagagaauuaucgaaagcauuaaaaaguuugcuggacucggccuggauaacaucaucacggagcuugacauguccauuuacagcuggaaugaucggucugacuauggcgauuccaucccggacuacauucugacacuccaggccaaacgcuaucaggaacuguucgaugcucuuaaggagaacaaggacaucgucagcgccguuguguuuugggggauuucugauaaauacuccuggcugaauggauucccugugaagagaaccaacgcuccccuccuguucgaccggaauuuuaugccuaaacccgccuucugggcgaucgucgaccccagccgccugagagag

SEQ ID NO: 43436 - RNA, 1161 nt, Artificial Sequence; identical to SEQ ID NO: 43435
  derived and/or modified sequence opt5 from anti-influenza_Chain

SEQ ID NO: 43437 - RNA, 1221 nt, Artificial Sequence
  derived and/or modified sequence opt5 from anti-influenza_Chain
augagaaacgugguccggaagccccugaccaucggccucgcccugacacuucugcucccuauggggaugacggcuaccagcgccaaaaaugcggacuccuacgcuaagaaaccgcacauuucugcccugaacgcuccccagcuugaucaacgcuauaagaaugaguucacaaucggagccgccguugaaccuuaccagcugcagaacgagaaagacgugcagaugcucaagagacauuuuaauagcauuguggcugaaaacgucaugaagcccaucuccauucaaccugaggaaggcaaauucaauuuugagcaggccgaucggaucgugaaguucgcgaaagccaacgggauggacauccgcuuucacacccugguuuggcauucucaggugccccagugguucuuucuggauaaggagggaaaaccuauggucaaugaaacagacccggugaagagagagcaaaacaagcagcuccugcuuaaacggcuggaaacccacauuaagacaaucguugagcgcuauaaagaugacauuaaguacugggauguggucaaugagguggugggcgacgaugggaaacucagaaacagccccugguaucagaucgcuggaauugacuacaucaaggucgccuuccaggcugcccggaaauauggcggcgauaauauuaagcuguacaugaacgacuacaauaccgaaguugagccuaagcgcacggcgcuuuauaaccuggugaaacaacucaaggaagagggggugcccaucgacggaaucggccaucagucccacauucagaucggguggccuucugaagccgagauugagaaaaccaucaacauguuugcugcccugggacuggauaaucaaauuacagaacucgacgucagcauguacggcuggcccccgagagcuuauccuaccuacgaugccauccccaagcagaaauuccuggaccaggccgcucgguaugaucgccuuuuuaagcuguacgagaagcucuccgacaaaaucagcaacgugacauucugggggauugcggauaaucacaccuggcuggacucuagagccgauguuuauuacgacgcuaacggaaauguggucguggauccuaacgcccccuacgccaagguugaaaaaggcaagggcaaagacgcucccuuuguguucgggccugacuauaaggucaagccggccuacugggcgaucauugaucauaaa

SEQ ID NO: 43438 - RNA, 1221 nt, Artificial Sequence; identical to SEQ ID NO: 43437
  derived and/or modified sequence opt5 from anti-influenza_Chain

SEQ ID NO: 43439 - RNA, 1233 nt, Artificial Sequence
  derived and/or modified sequence opt5 from anti-influenza_Chain
cugagcagaaucaaccacuucgagaagauucagaucauucccaaauccucuuggagcgaccaugaagccuccucuggcgugagcuccgcuugcccuuaccaagggaccccgagcuuuuuccggaaugucguuuggcucaucaagaaaaacaauacauaucccacgauuaagcgcucuuacaacaauaccaaccaggaggaucugcuuauccuguggggaauccaccauuccaaugacgccgcggaacagacaaaacucuaucagaacccuaccacauacauuagcgugggcaccucuacacugaaucaaagacuugugcccaagaucgcuacccgguccaaggucaacgggcagaauggacgcauggacuuuuucuggacgauucugaaaccuaacgaugccaucaauuuugagagcaacggcaauuucauugcccccgaauaugcuuacaagaucgugaaaaagggguauauuccugaggccccgagagauggacaggcuuacguucggaaagacggcgagugggugcuccugucuaccuuucugcgcuccgauaagacacacaccugucccccuugccccgccccugaacuccugggcgggcccagcgucuuccuuuuuccgccuaagcccaaagacacacugaugaucucuagaaccccugaggugacguguguuguggucgaugugucccaugaagaccccgaggugaaguucaacugguacgucgauggaguugaggugcacaacgcgaaaacaaagccccgggaggaacaguauaauagcaccuaccgcguggucuccgugcucacaguucugcaccaagacuggcuuaacggcaaagaauauaagugcaaagugucuaauaaggcccugccugcuccgaucgagaagaccauuagcaaagccaaggggcagcccagagaaccucaggucuacacccugcccccuucccgggaggagaugacaaagaaccaggugagccucacgugucugguuaagggauuuuaucccucugauaucgcuguggaaugggaguccaauggccaaccggaaaacaauuacaaaaccacaccucccguccucgacagcgacgggucuuucuuucuguauagcaaacuuaccguggauaagucccgcuggcagcagggaaacgucuucucuugcagcgugaugcaugaggcccugcacaaucauuacacacaaaaaucccucagccugucuccuggcaag

SEQ ID NO: 43440 - RNA, 1233 nt, Artificial Sequence; identical to SEQ ID NO: 43439
  derived and/or modified sequence opt5 from anti-influenza_Chain

SEQ ID NO: 43441 - RNA, 1293 nt, Artificial Sequence
  derived and/or modified sequence opt5 from anti-influenza_Chain
auggacgaucacgccgagaaguuccuguggggcguggcuaccagcgccuaccagaucgaaggggcgacacaagaggacggaagaggccccuccauuugggaugcuuuugcccggcgcccuggggccaucagagacggaucuacgggcgaaccggcuugcgaucauuaucggcgcuacgaggaagacauugcccucaugcagagccugggggucagagcuuaucgguucuccguugccuggccccgcauccuuccugagggaagaggccggauuaaccccaaaggccuggcguuuuacgaucgccucguggacagacugcuugccucugggaucaccccuuuccugacacucuaucacugggaucugccccuggcucucgaggaacggggaggcuggcgcagcagagagaccgccuuugcuuucgccgaauacgcggaggccguggcucgggcccuggcugaccgcgucccguuuuucgccacacuuaaugagccuugguguuccgccuuucuggggcauuggaccggagaacacgcucccggccucagaaaccuggaggcggcccuucgggcugcccaucaucugcuccuggggcacggacuggccguggaagcucucagagccgcgggcgcucgccggguuggcaucgugcugaauuucgccccugccuauggggaggaucccgaagcugucgacguggccgauagauaccacaaccgcuacuuucuugacccuauucugggaaagggcuaucccgagucuccguuccgggacccucccccuguucccauccucagcagagaucuggagcuuguggcucgcccccuggacuuucucggggucaauuacuaugccccugugcggguggcgccgggaacaggcacccugcccgucagauaccugccucccgaagggccugccacggcuaugggaugggagguuuaucccgaaggccuccaccaucugcuuaaacgccugggccgggaggugccguggccucucuacgugaccgaaaacggggccgcuuaucccgaucuguggacaggagaggccgucguggaggacccugaaagaguugcguaccuugaggcccacguggaagcugcccugcgcgcucgggaggaaggcgucgaucucagaggguacuucguguggucccugauggacaauuucgagugggccuuuggauauacccggcgcuucggccuguacuauguugauuuucccagccagagacggauuccuaagagaucugcccucugguaccgcgagcggaucgcuagagcgcagaca

SEQ ID NO: 43442 - RNA, 1293 nt, Artificial Sequence
  derived and/or modified sequence opt5 from anti-influenza_Chain
augaccgagaacgccgaaaaguuccuguggggcguggcuacaagcgccuaccagaucgagggggcgacgcaagaagacggaagaggccccuccauuugggaugcuuuugcccagcggccuggggccauccgcgacggaucuaccggcgagccggcuugcgaucacuauagacgguacgaagaggacauugcccucaugcagagccuggggguccgcgcuuauagauucuccguugccuggccccggauccuuccugagggacgcggcagaauuaaucccaaaggccuggcguuuuacgaucggcucguggaccgccugcuugccucugggaucacaccuuuccugacccucuaucauugggaucugccccuggcucucgaagagagaggaggcuggcggagccgcgaaacagccuuugcuuucgccgaguacgcggaggccguggcuagagcccuggcugaccgggucccguuuuucgccacccuuaacgaaccuugguguuccgccuuucuggggcacuggacaggagagcaugcucccggccuccgcaaucuggaagcggcccuuagagcugcccaccaucugcuccuggggcacggacuggccguggaggcucuccgggccgcgggcgcuagacgcguuggcaucgugcugaacuucgccccugccuauggggaagaucccgaggcugucgacguggccgaucgguaccacaauagauuuuuccuugacccuauucugggaaagggcuaccccgagucuccguuucgcgauccucccccuguucccauccucagccgggaccuggaacuuguggcuagaccccuggacuuccucggggucaacuauuacgccccugugcgcguggcgccgggaaccggcacgcugcccguccgguaucugccucccgaggggccugccaccgcuaugggaugggaaguuuaccccgagggccucuaucaucugcuuaaaagacugggccgcgaagugccguggccucucuacgugacagagaauggggccgcuuaucccgaucuguggaccggagaggccgucguggaagacccugagcggguugcguaccuugaagcccacguggaggcugcccugagagcucgcgaagagggcgucgaucuccggggguacuucguguggucccugauggacaacuuugagugggccuucggauauacaagacgguuuggccuguacuauguugauuuccccagccagcgccggauuccuaagagaucugcccucugguacagagaacgcaucgcucgggcgcaaacc

SEQ ID NO: 43443 - RNA, 1293 nt, Artificial Sequence
  derived and/or modified sequence opt5 from anti-influenza_Chain
auggccgagaacgcugaaaaguuccuguggggcguggccaccagcgcguaccagaucgagggggcuacacaagaagacggaagaggccccuccauuugggauacguuugcccggcgcccuggggccaucagagacggaucuaccggcgagccggcuugcgaucacuaucaucgguacgaagaggacauugcccucaugcagagccugggggucggaguuuaucgcuucuccguggcuuggcccagaauccuuccugagggccggggccgcauuaaucccaaagggcuggccuuuuacgauagacucguggaccggcugcuugcggccggaaucacaccuuuccugacccucuaucacugggaucugccccaggcucuggaagaccgcggcggguggagaucucgggagacagccuuugcuuucgccgaauacgcggaggccgucgcucgcgcccucgcugauagagugccguuuuucgccacccugaacgagccuugguguagcgccuuucuuggacauuggacaggcgaacacgcucccgggcugcggaaucucgaggcggcccugcgcgcugcccaucaccuucugcucggacacggccuggccguugaagcucugagagccgcgggcgcuaagcggguggggaucguccucaacuucgccccuguguauggagaggaccccgaagccguugauguggcugacagauaccauaaucgcuacuuucuggauccuauucuuggccggggguaucccgaguccccguuccaggacccucccccuacccccaaccugucuagagaccucgagcuggucgcccgcccccuugauuuucugggagugaauuacuaugcuccugugcgggucgccccgggcacggggccccucccuguuagauaccugcccccugaaggacccgugaccgcgaugggcugggagguguauccggaaggccuguaccaccuccugaaacgccuugggcgggaggucccuuggccccuguauaucacagaaaacggagccgcuuacccugaccucuggaccggcgaggccgugguugaggaucccgaaagaguggcuuaccuggaggcccaugucgaagcggcccuucgcgcucgggaggaagggguggaccugagaggauauuucguuuggagccucauggauaauuucgagugggccuuuggcuacacacgccgguucgggcuguauuacguggacuuuccuucccaaagacggauucccaagcgcagcgcucugugguauagagagcggaucgccagagcccagcuc

SEQ ID NO: 43444 - RNA, 1293 nt, Artificial Sequence; identical to SEQ ID NO: 43441
  derived and/or modified sequence opt5 from anti-influenza_Chain

SEQ ID NO: 43445 - RNA, 1293 nt, Artificial Sequence; identical to SEQ ID NO: 43442
  derived and/or modified sequence opt5 from anti-influenza_Chain

SEQ ID NO: 43446 - RNA, 1293 nt, Artificial Sequence; identical to SEQ ID NO: 43443
  derived and/or modified sequence opt5 from anti-influenza_Chain

SEQ ID NO: 43447 - RNA, 1296 nt, Artificial Sequence
  derived and/or modified sequence opt5 from anti-influenza_Chain
auguucaagcccaacuaccacuuuuucccuaucaccggcuggaugaaugacccgaacgggcugaucuuuuggaaaggaaaguaucauauguucuaccaguauaaucccagaaaaccugaguggggcaacauuugcugggggcacgccgugagcgaugaccucguccauuggcggcaccuucccguugcucuuuacccugaugacgaaacacauggaguguuuuccggcucugccguggagaaggaugggaaaauguuccuggucuauacguacuaucgcgaccccacccacaauaagggagaaaaggagacacaauguguggcgaugagcgaaaacggccucgauuuuguuaaauacgacggcaauccugugauuuccaagccgcccgaggaggggacccacgcuuucagagauccuaaagucaaccggucuaauggagaauggcgcauggugcugggcagcgggaaggacgagaaaaucggaagaguucuucuguacacauccgaugaccucuuucauuggaaguaugaaggcgugauuuucgaggaugagaccacaaaggaaaucgagugccccgaccugguccggaucggggaaaaagacauucugaucuacucuauuaccagcacgaacuccgugcucuuuagcaugggagagcugaaggaaggcaaacuuaauguggagaagcgcggccugcucgaucacgggaccgacuucuaugccgcccagacauuuuucggaaccgauagagucguugugaucggcuggcugcagucuuggcuucggacagggcuguacccuaccaaacgcgagggauggaacggcgugaugucccuccccagagaacuguaugucgagaauaacgaacugaaggugaaaccgguugacgagcuccuggcucugcggaagcgcaagguguucgaaacggccaaaagcgggacauuucugcucgaugucaaggaaaauucuuacgagauugugugugaguucuccggagagaucgaacugagaaugggcaacgagagcgaagagguugugauuaccaaaucucgggacgagcuuaucgucgauacaacccgcuccggcgugagcgggggagaagucagaaaguccaccguggaggacgaagcuacaaaccggaucagagccuuucuggauucuugcagcguugaguucuuuuucaaugacuccauugcguuuagcuuccgcauccauccugagaacguguauaauauucucucugucaaauccaaccaggugaagcuggaaguuuuugagcuggaaaauaucuggcuc

SEQ ID NO: 43448 - RNA, 1296 nt, Artificial Sequence; identical to SEQ ID NO: 43447
  derived and/or modified sequence opt5 from anti-influenza_Chain

SEQ ID NO: 43449 - RNA, 1323 nt, Artificial Sequence
  derived and/or modified sequence opt5 from anti-influenza_Chain
gaggugaagcuggucgaaagcggcgggggacucguucagcccggcgggucccugagacuuucuugcgccaccagcggauucacauuuuccgacuacuauaugucuugggugcggcaaagcccuggcaaagcucuggaguggcucggguucacgcgcuccagagugcugggauacaccacagauuauucugccagcgucaagggccgguuuaccaucucccgcgacaacagccagucuauucuuuaccugcagaugaacucccucagaggcgaagauagcgcgacauauuacugugcucgggaccgcccgauggauuauugggggcagggaaccucugugacaguuuccagcgccaaaaccacgcccccuucuguguacccccuggccccuggcuccgcugcccaaaccaauagcauggucacacuggggugccucgugaagggauacuuccccgagccuguuaccgugacauggaacuccggcucucugagcuccgggguccacaccuuuccggcugugcuucagagcgaccuguauacgcucucuuccagcgugacaguccccucuagcaccuggccuuccgaaacaguuaccuguaauguggcccaucccgcgucuagcaccaaaguggauaagaagaucgucccuagagacugcggauguaaacccugcauuuguacagugccggagguuuccagcguguucaucuuuccucccaagccuaaagauguccugacgauuacccuuacacccaaggugaccugcguuguggucgacaucucuaaagaugaccccgaggugcaguucuccugguuugucgaugacguggaaguucacacagcccagacccaaccucgggaggaacaguucaauagcacguuucgcucuguguccgagcugccgaucaugcaucaggacuggcucaacggcaaggaguucaaguguagagucaauagcgcugccuuucccgcuccuauugagaaaacaaucuccaagaccaaaggccggcccaaggccccucagguguacaccauucccccgccuaaagaacaaauggcgaaggauaaaguuucucugacaugcaugaucaccgacuucuuccccgaagauauuacaguggaguggcaguggaacgggcagccugccgaaaauuauaagaacacgcaacccaucauggacaccgauggaagcuacuuugucuauuccaagcugaaugugcagaaaucuaacugggaggcuggcaauacauucaccuguagcgugcuccacgaggggcugcauaaccaccacacagaaaagucccuuagccauucuccuggaaaa

SEQ ID NO: 43450 - RNA, 1323 nt, Artificial Sequence; identical to SEQ ID NO: 43449
  derived and/or modified sequence opt5 from anti-influenza_Chain

SEQ ID NO: 43451 - RNA, 1329 nt, Artificial Sequence
  derived and/or modified sequence opt5 from anti-influenza_Chain
gaggugcagcugcaacagagcggccccgaacucgucaagccuggggccuccguuaaaaugucuugcaaggcuagcggauacaccuucacauccuaugugaugcacugggugaaacagaagccgggccaggggcuggaguggaucggauacauuaaccccuauaaugacggcacgagauacaacgaaaaauuucgggucaaggccacccuuacaucugauaagagcuccucuaccgcguauauggagcugagcucccucacaagcgaagacucugcuguguacuauugugcccgcagagggcugaucaccacaccuacccuugauuacuggggacaaggcacgacccugacaguuuccagcgccaaaaccacacccccuucuguguacccccucgcuccuggcuccgccgcucagaccaauagcauggucacgcuggggugccuggugaagggauauuucccggagcccguuacagugaccuggaacucuggcucccucagcuccgggguccauacauuuccugccgugcugcagucugaccuuuacacccugagcuccagcgugaccguccccucuuccacauggccuagcgagacgguuaccuguaauguggcgcaccccgccucuagcacaaaaguggauaagaaaauugucccgcgggacugcggauguaagccuugcaucuguaccgugcccgaaguuuccucuguguucauuuuuccucccaagcccaaagauguccucacaaucacccugacgccuaaggugacaugcguuguggucgacaucagcaaagaugacccggaggugcaguucuccugggucgaugacguggaaguucauaccgcucaaacccagccccgcgaggagcaguuuaacagcacauucagaucuguguccgaacuuccuauuaugcaccaggauuggcugaauggcaaggaguuuaaaugucgggucaacagcgccgcuuuccccgccccuaucgaaaagaccauuucuaaaacaaaggggcgccccaaggcgccgcaaguguauacgaucccucccccuaaagagcagauggccaaggacaaaguuucccugaccugcaugauuacagacuuuuuccccgaagauaucaccguggaguggcaguggaauggacaaccugcugagaacuacaagaauacacagcccauuauggacaccgauggcagcuauuuugucuacuccaaacucaacgugcagaagucuaauugggaagccggcaacacguucaccuguagcgugcugcaugaggggcuccacaaucaccauacagaaaagucccugucucacagcccgggaaaa

SEQ ID NO: 43452 - RNA, 1329 nt, Artificial Sequence; identical to SEQ ID NO: 43451
  derived and/or modified sequence opt5 from anti-influenza_Chain

SEQ ID NO: 43453 - RNA, 1332 nt, Artificial Sequence
  derived and/or modified sequence opt5 from anti-influenza_Chain
aacgugcccgaguggagcuacaucgucgaaaaggccaauccugcuaacgaccugugcuauccgggcaauuucaacgauuacgaggaacucaaacaucugcuuuccagaauuaaucacuuugagaagauccaaauuauccccaaaucuagcugguccgaccacgaagccucuagcgggguuuccucugcguguccuuaucaaggaacccccagcuucuuucggaacgugguguggcugauuaagaaaaauaacacauacccuacgaucaagcgcuccuauaauaacaccaaucaggaggaucuccugauccuuuggggcauucaucacagcaacgacgcugccgagcagacaaagcuguaccagaaucccaccacauauaucucugucgggaccuccacacucaaccaaagacuggugccuaaaauugccacccggagcaagguuaauggacagaacggccgcauggauuucuuuuggacgauccugaaaccgaacgacgcuauuaauuucgaaucuaacgggaauuuuaucgcccccgaguacgcuuacaagauugugaaaaagggauauaucccugaagcccccagagauggccaggcguacguccggaaggacggcgagugggugcuccuguccaccuuccuucgcagcgauaaaacacauaccugcccucccuguccggccccugagcugcucgggggacccucuguuuuucuguucccucccaagcccaaagacacacuuaugaucuccagaaccccugaagugacgugcgucgugguggaugucagccacgaggacccggaaguuaaguuuaacugguauguggauggcguggagguccacaaugcuaaaacaaagccccgggaggaacaguacaacuccaccuaucgcgugguuucugugcugacaguccuccaucaagacuggcugaaugggaaagaguacaaguguaaggugagcaacaaagcccugccugcucccauugaaaagaccaucuccaaagccaagggacagccuagagagccccagguuuauacccucccgccuagccgggaagagaugacgaaaaaucaggugucucugacaugccuugucaagggcuucuaccccuccgacauugcgguggaaugggagagcaacgggcaaccugagaauaacuacaagaccacacccccuguccuggauucugacggcagcuuuuuccucuauuccaaacugaccguggauaagucucgcuggcagcagggaaauguuuucagcuguuccgugaugcacgaagcccuucauaaccacuacacacagaaaagccugucucucucccccggcaag

SEQ ID NO: 43454 - RNA, 1332 nt, Artificial Sequence; identical to SEQ ID NO: 43453
  derived and/or modified sequence opt5 from anti-influenza_Chain

SEQ ID NO: 43455 - RNA, 1341 nt, Artificial Sequence
  derived and/or modified sequence opt5 from anti-influenza_Chain
caggugcaacugcaggagagcggccccgggcucgucaagccuuccgaaacccugucucuuacaugcacgguuagcggaggccugaucgggaccggauccuacuauuggggcuggauuagacagacaccggggaaaggaauggaguggaucggcucuauuagcuacuccggcucuaccuauuaccaccccagccucaagucccgggugacaaucagcgacgauaccucuaaaaaccagcuguuccuuaagcugcgcuccgugacagccgcugacaccgcccaauauuacugugcgagauauaauugggggauucgguacuuugauuucuggggacgcggcacgcucgucaccgugagcucugcuuccacaaaagggccuagcguuuuuccccuggccccuugcucuagauccaccagcgaauccacagccgcucugggaugucucgugaaggacuacuuccccgagccugucaccgugucuuggaacagcggcgcccugacguccgggguucauacauuuccggcugugcuucagagcucuggacuguauucccucagcucugucgugaccgugcccagcuccucucugggcacaaagaccuauaccugcaaugucgaucacaaaccuagcaacacaaagguugacaaaacgcgggaauccaaguacgggcccccuugucccagcugcccggccccugaguuccuuggcggacccucuguguuucuguucccucccaaacccaaggauacccucaugaucucccgcacaccugaggugaccugugucgugguugacgugagccaggaagauccggagguccaguuuaauugguacguggacggcguugaagugcauaacgcgaagacaaaacccagagaggagcaauucaauucuaccuaucgggucguguccguccugacggugcugcaccaggauuggcucaacgggaaggaauacaaaugcaagguuagcaauaaaggacugccuuccucuaucgagaagacaauuagcaaagccaagggccagccccgcgaaccucagguguauacccuucccccggcucaagaggaaaugaccaagaaccaggucucccugacaugucucgugaaaggguuuuacccuucugacaucgccguugagugggagagcaauggacagcccgaaaacaauuacaagaccacaccucccgugcuggauuccgacggcagcuucuuucuuuauucuagacugacggucgacaaaucccgguggcaagagggcaacguguucagcugcucugugaugcaugaagcucuccacaaucacuacacccagaagucccugagccugucucucgggaaa

SEQ ID NO: 43456 - RNA, 1341 nt, Artificial Sequence; identical to SEQ ID NO: 43455
  derived and/or modified sequence opt5 from anti-influenza_Chain

SEQ ID NO: 43457 - RNA, 1344 nt, Artificial Sequence
  derived and/or modified sequence opt5 from anti-influenza_Chain
gaggugcagcugcaagaaagcggccccgggcucgucaagccuucccagacccugucucuuacaugcaacguuagcggaggcuccaucacgggggacuacaaauggucuuggauuagacagccgcccggaaagggccuggaguggaucgggcacauucauagcaccggaacaaccuauuacaauccuucccuccggucucgcaucacaauuagcauggauaccuccaaaaacaaucugagccuuagacugacaucugugaccgcugcugacacggccguguauuacugugcgucccacacccucacaagcggccauuauccccgggauuucgacuuuuggggccaggggacccuggucacagugucuuccgcuagcaccaagggaccuucuguuuucccccuggccccuugcucccgcagcacguccgaaucuacagccgcucucggcugucuggugaaagauuacuuuccggagcccgucaccgugagcuggaacuccggggcccuuacaagcggaguucacaccuucccugcugugcugcaaucuuccggccucuauagccugucuagcgucgugaccgugacauccucuaauuuugggacgcagaccuacacaugcaacgucgaccauaagcccagcaauaccaagguugauaaaacaguggaaagaaaguguugcguggaguguccucccugcccggccccucccgucgcgggaccuuccguguuccuuuuuccucccaaacccaaggacacccugaugaucagccggacgccggagguuacauguguggucguggauguuucucacgaagaccccgaggugcaguucaacugguacgucgauggcauggaagugcacaaugccaaaaccaagccucgcgaggagcaguuuaacuccaccuucagagucgugagcguucucacagugguccaucaagacuggcugaauggcaaggaauauaaaugcaaggugucuaacaaagggcugcccgcuccuaucgagaagaccauuuccaaaacaaagggacagccccgggaaccgcagguuuacacgcucccucccagccgcgaggaaaugaccaaaaaucaggugucccugacaugucuugucaagggcuuuuauccuucugauaucgccguggagugggagagcaacgggcaacccgaaaauaacuacaagaccacaccucccaugcuggacuccgacggaucuuucuuucucuauagcaaacugaccguggauaaguccagauggcagcagggcaacguuuucagcugcucugucaugcacgaggcccuucauaaucacuacacgcaaaaaucccugagccucucugggaag

SEQ ID NO: 43458 - RNA, 1350 nt, Artificial Sequence
  derived and/or modified sequence opt5 from anti-influenza_Chain
caggugcaacugcagcagagcggcgccgaggucaagaaacccggguccucuguuaaggugagcugcaaaguguccggagucaucuucucuggcagcgcuauuuccugggugagacaggccccugggcaaggacucgaauggaugggcgggaucucuccgcuguuuggaaccacaaacuacgcgcagaaguuccagggccggguuacgauuaccgcugaccagagcacaaauaccacauauauggaggugaacucccuucgcuacgaagauaccgccgucuauuuuugugccagaggccccaaauacuauagcgaguacauggacgugugggggaagggaacaaccguuacggugucuuccgcuagcaccaagggcccuucugucuucccccuggccccuuccagcaaaucuacauccgggggaaccgcugcccucggcugccuggugaaggauuauuuucccgaaccugugacagucagcuggaacuccggggcgcuuaccucuggaguucacacguucccggccgugcugcaaagcuccggccucuacagccugucuuccguggucacagugcccagcucuagccugggcacccagacauacaucuguaauguuaaucauaaaccuuccaacaccaagguggacaaacgggucgagcccaagucuugcgauaagacccacacauguccucccugcccggcuccugagcuccuugggggacccagcguguuucuguucccucccaaacccaaggacacgcugaugauuucccgcaccccugaaguuacauguguggucguggaugucagccaugaggacccggaagugaaauuuaauugguauguugauggcguggagguccacaacgccaagaccaaacccagagaggaacaguacaauucuacauaucgggugguuuccgugcucaccguccugcaucaggacuggcuuaacgggaaggaguacaaaugcaaggugagcaauaaggcucugccugcccccaucgaaaagacgaucucuaaggcgaaaggacaaccucgcgagccccagguguauacacucccgccuuccagagaagagaugaccaagaaccagguuagccugaccugucuggucaaaggcuucuaccccuccgauauugccguggagugggaaucuaaugggcaaccugagaacaauuauaagacaacacccccugugcucgacagcgauggauccuuuuuccuguacucuaaacuuaccgucgacaaaagccgguggcagcagggcaacguguuuuccugcagcguuaugcacgaagcucugcacaaccauuacacgcagaagucucucucccugagccccggcaaa

SEQ ID NO: 43459 - RNA, 1350 nt, Artificial Sequence
  derived and/or modified sequence opt5 from anti-influenza_Chain
caggugcaacugguccagagcggcgccgagguuaagaaacccggguccucugugaaggugagcugcaaggcuuccggaggcaccuucucuagcuacgccaucuccugggucagacaggcgccugggcagggacucgaauggaugggcgggauuaugggaauguuuggcacaacgaacuaugcucaaaaauuccagggccgggugaccaucacagccgacgaguuuaccucugccgcuuacauggaacugcgcagccuuagauccgaggauacagccguuuauuacugugcucggagcucuggguauuacccggaauauuuccaggacuggggacagggcacccuggugacagucuccagcgccucuaccaaagggcccuccguguuuccucucgcgcccagcucuaaguccacgagcggaggcaccgccgcucuggggugccuuguuaaggauuacuucccugagcccgugacagucuccuggaacucuggagcccugaccagcggcgugcacacauuuccugcugugcuccaauccagcggccuguacucucuguccagcgucguuaccgugccgucuagcucccucgggacgcagacauauauuuguaaugugaaucauaaacccucuaacaccaaggucgacaaacgcguggagccuaagagcugcgauaaaacacacaccugucccccuugccccgccccggaacugcuuggaggcccuuccguuuuccuguuucccccuaagcccaaggacacccucaugaucagcagaacacccgaggugacgugugucgugguugaugugucucaugaagacccugaggucaaauucaauugguacguggauggggucgaggugcacaacgcgaagaccaaaccgcgggaggaacaguauaauuccacauaccgcguugugagcguccugaccgugcuucaucaggacuggcugaacggaaaggaauauaaaugcaagguuucuaauaaagcccuccccgcuccuauugagaagacaaucuccaaggccaaaggccaacccagagaaccucagguguacacccugcccccgagccgggaggagaugacgaagaaccaggucucccugacaugucucgugaaaggguuuuauccuucugauaucgcuguggaaugggagagcaauggacaacccgaaaacaauuacaagaccaccccucccguucuggacuccgauggcucuuucuuucuuuacagcaaacugacagucgacaagucccgcuggcagcagggcaacguguucagcugcucugugaugcacgaggcccuccacaaucauuauacccagaagucccugagccuuucuccugggaaa

SEQ ID NO: 43460 - RNA, 1350 nt, Artificial Sequence
  derived and/or modified sequence opt5 from anti-influenza_Chain
gaggugcagcuggucgaaagcggcgcugagguuaagaaacccggguccucugugaaggugagcugcaaggcuuccggaggcaccuucucuagcuacgggaucuccugggucagacaagccccuggacagggccucgaauggaugggggacauuaucggaauguuuggcucuacaaacuaugcgcagaauuuccagggccggcugacgauuaccgcugaugagagcacauccaccgccuacauggaacuuagcucucugcgcuccgaggacacagccguguauuacugugcuagaagcucuggguauuacccggccuaucucccccacuggggacaaggcacccugguuacaguguccagcgcuucuaccaaagggccuuccgucuuuccccuugccccuagcuccaaaucuacgagcggaggcaccgcggcccuggggugccucgugaaggauuacuuccccgagccuguuacaguguccuggaacagcggagcucugaccucuggcguccauacauuuccggccgugcugcaguccagcggccucuacucucugagcuccguggucaccguucccucuagcucccuugggacgcagacauauaucuguaaugugaaccacaagccuagcaauaccaaaguggacaagcgggucgaacccaaaucuugcgauaagacacauaccuguccucccugcccggcuccugagcugcucggaggccccuccguguuccuguuuccucccaaacccaaggacacccuuaugauuagccgcacaccugaaguuacguguguggucguggauguuucucacgaggacccggaggugaaguucaacugguacgucgaugggguggaaguccauaaugccaaaaccaagcccagagaggaacaguauaacuccacauaccgggugguuagcgugcugaccguccuccaccaagacuggcugaauggaaaagaguauaagugcaaaguguccaacaaggcgcugccugcccccaucgagaaaacaaucucuaaggcuaagggccagccucgcgaaccccagguuuacacccucccgccuagcagagaggaaaugacgaaaaaucaggugucccugacaugucuugucaagggguuuuaucccucugauauugccguggagugggaaagcaacggacaaccugagaauaacuacaaaaccacacccccugugcuggacuccgauggcagcuucuuucucuacucuaagcugaccguugacaaaucccgguggcagcagggcaaugucuucagcugcucugugaugcacgaagcccuucauaaccacuauacccaaaagucccugagccucucucccgggaag

SEQ ID NO: 43461 - RNA, 1350 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggaggcaccuucucuagcuacgccaucuccugggucagacaagcgccugggcagggacucgaauggaugggcgggauuaucggaauguuuggcacagcuaacuaugcccagaaauuccagggccgggugacgauuaccgccgacgaguuuacaucuaccgcuuacauggaacugagcucccuucgcagcgaggauacagccguuuauuacugugcuagagggaauuauuacuaugagucuucccuggacuacuggggacaaggcacccucgugacagucagcucugccuccaccaaagggccgagcguguucccccuggcgccuucuuccaagagcacguccggaggcaccgccgcucuugggugccugguuaaggauuacuuucccgaaccugugacagucucuuggaacagcggagcccucaccuccggcgugcacacauuccccgcugugcugcagagcucuggccuguauucccucagcucugucguuaccgugccuagcuccucucuggggacgcagacauacaucuguaaugugaaccauaaaccgagcaauaccaaggucgacaaacggguggagcccaaguccugcgauaaaacacacaccuguccucccugcccugcccccgaacuucugggaggcccgagcguuuuucucuucccucccaagccuaaggacacccugaugauuucucgcacacccgaggugacgugugucgugguugaugugucccaugaggaccccgaagucaaauuuaacugguauguggauggggucgaggugcacaaugcgaagaccaaaccuagagaggaacaguacaacagcacauaucggguugugucuguccuuaccgugcugcaucaagacuggcucaauggaaaggaauacaaaugcaagguuuccaacaaagcccugccggcucccaucgagaagacaaucagcaaggccaaaggccagccucgcgagccccagguguauacccugccucccuccagagaagagaugacgaagaaucaggucucucucacaugucuggugaaaggguucuacccgagcgauauugcuguggaaugggaguccaacggacaaccugaaaauaacuacaagaccacacccccuguucuugacucugauggcagcuuuuuccuguauuccaaacucaccgucgacaagagccgguggcagcagggcaauguguuuucuugcuccgugaugcacgaggcccugcacaaccauuacacccaaaagagccuuucucugucccccgggaaa

SEQ ID NO: 43462 - RNA, 1350 nt, Artificial Sequence
  derived and/or modified sequence opt5 from anti-influenza_Chain
gaggugcagcugguccaaagcggcgccgaaguuaagaaacccggguccucuaugaaggugagcugcaaggcuuccggaucuaucuucagcaacuacggcauuuccugggugagacaggccccugggcagggacucgaguggaugggcgggaucauuccgaucuuuggagcggcuaauuaugcccagaaauuccaaggccgggucaccauuacagccgacgaaucuacgagcaccguguacauggagguucgcucccugagaagcgaagauacagcuguguauuacugugcccggcgccagcagcuuuauaaaggcuacuaucaccauugggggcagggaacccuggucacagugucuuccgcuagcaccaagggccccucuguuuuuccucucgcccccuccagcaagucuacauccgggggaaccgcggcccugggcugccuugugaaagacuacuucccugagcccgucacggugagcuggaacuccggggcucugaccucuggagugcacacauuuccugccguccuccaaagcuccggccuguacagccugucuuccguugugaccgugccgagcucuagccucggcacacagaccuauaucuguaaugucaaccauaagcccuccaauacgaaaguggauaagaaaguugagccuaagucuugcgacaagacacacaccugucccccuugccccgcuccggaacugcuugggggaccuagcguguuccuguuucccccuaaacccaaggauacacucaugaucuccagaacccccgaggucaccugugugguuguggacgucagccaugaagauccugaggugaaauucaacugguacgucgacggcguggagguucacaaugccaagacaaaaccgcgggaggaacaguauaacucuacguaccgcguggucuccgugcugaccguucuucaccaggauuggcugaaugggaaggaauauaaaugcaaggugagcaacaaggcgcuccccgccccuauugagaaaacaaucucuaaggcuaaaggacaacccagagaaccucaggucuacacccugcccccgucccgggaggagaugacaaagaaucaggugagccugaccugucucgugaaaggcuuuuauccuuccgacauugccguugaaugggagucuaacgggcaacccgaaaauaacuacaagacgacaccucccguccuggauagcgacggauccuucuuucuuuacucuaagcugaccguggauaaaagccgcuggcagcagggcaauguguucuccugcagcgucaugcaugaggcucuccacaaccauuauacccagaagucucugucccuuagcccuggcaaa

SEQ ID NO: 43463 - RNA, 1350 nt, Artificial Sequence
  derived and/or modified sequence opt5 from anti-influenza_Chain
caggugcaacugguccagagcggcgccgggguuaagaaacccggauccucuaugaaggugagcugcaaggcuuccggcucuaucuucagcaacuacgggauuuccugggugagacaggccccuggacagggccucgaguggaugggagggaucauuccgaucuuuggcgcggcuaauuaugcccaaaaauuccagggccgggucaccauuacagccgacgaaucuacgagcaccguguacauggagguucgcucccugagaagcgaagauacagcuguguauuacugugcccggcgccagcagcuuuauaaaggguacuaucaccauuggggacaaggcacccuggucacagugucuuccgcuagcaccaaggggcccucuguuuuuccucucgcccccuccagcaagucuacauccggaggcaccgcggcccuggggugccuugugaaagacuacuucccugagcccgucacggugagcuggaacuccggagcucugaccucuggcgugcacacauuuccugccguccuccagagcuccggccuguacagccugucuuccguugugaccgugccgagcucuagccucgggacacagaccuauaucuguaaugucaaccauaagcccuccaauacgaaaguggauaagaaaguugaaccuaagucuugcgacaagacacacaccugucccccuugccccgcuccggagcugcuuggaggcccuagcguguuccuguuucccccuaaacccaaggauacacucaugaucuccagaacccccgaggucaccugugugguuguggacgucagccaugaagauccugaggugaaauucaacugguacgucgacgggguggaaguucacaaugccaagacaaaaccgcgggaggagcaguauaacucuacguaccgcguggucuccgugcugaccguucuucaccaagauuggcugaauggaaaggaauauaaaugcaaggugagcaacaaggcgcuccccgccccuauugagaaaacaaucucuaaggcuaaaggccagcccagagaaccucaggucuacacccugcccccgucccgggaggaaaugacaaagaaucaagugagccugaccugucucgugaaaggguuuuauccuuccgacauugccguugagugggagucuaacggacagcccgaaaauaacuacaagacgacaccucccguccuggauagcgacggcuccuucuuucuuuacucuaagcugaccguggauaaaagccgcuggcagcagggcaauguguucuccugcagcgucaugcaugaggcucuccacaaccauuauacccaaaagucucugucccuuagcccugggaaa

SEQ ID NO: 43464 - RNA, 1350 nt, Artificial Sequence
  derived and/or modified sequence opt5 from anti-influenza_Chain
caggugcaacugguccagagcggcgcugagguuagaaagcccggguccucugugaaagugagcugcaaggucuccggaggcaucauucggaaauacgcuaucaacugggugcgccaggccccugggcagggacucgaauggaugggcgggauuaucgcgauuuucaauaccgcuaacuaugcccaaaaguuucagggaagaguuacaaucacggccgacgagucuaccagcacaguguacauggaacuguccucucuucggagcgaggauaccgcucuguauuacugugcccgcggcaugaauuauuacuccgacuauuucgauuacuggggccaggggagccucgucacagugucuccggcuuccaccaaaggacccagcguuuuuccucuggcccccucuuccaagagcacaucuggcgggaccgcggcccuuggaugccuggugaaggacuacuucccugaacccgucacgguguccuggaacagcggcgcucucaccuccggggugcacacauuuccugccguccugcagucuagcggacuguauucccucagcucuguugugaccgugccguccagcucucugggcacacaaaccuacaucuguaaugucaaccauaaacccagcaauacgaagguggauaaaaagguugagccuaaauccugcgacaagacacacaccugucccccuugccccgcuccggagcuucugggcgggccuucuguguuccucuuucccccuaagcccaaagauacacugaugauuagcagaacccccgaagucaccugugugguuguggacgucucccaugaggauccugaagugaaguucaacugguaugucgacggaguggagguucacaaugccaaaacaaagccgcgggaggaacaguacaacagcacguaucgcguggucucugugcuuaccguucugcaucaggauuggcucaauggcaaagaguacaagugcaaaguguccaacaaggcgcugcccgccccuaucgaaaagacaauuagcaaagcuaaggggcagcccagagagccucaagucuauacccugcccccgucucgggacgaacucaccaaaaaucaggugucccugacaugucuugugaagggauuuuacccuagcgauaucgccguugagugggaguccaacggccagcccgaaaauaacuacaaaacgacaccucccguccuggacucugacgggagcuucuuucucuauuccaagcugaccguggauaagucucgcuggcaacagggaaacguguucagcugcuccgucaugcacgaggcccuucacaaucauuacacccagaaaagccugucucucuccccuggcaag

SEQ ID NO: 43465 - RNA, 1350 nt, Artificial Sequence; identical to SEQ ID NO: 43464
  derived and/or modified sequence opt5 from anti-influenza_Chain

SEQ ID NO: 43466 - RNA, 1350 nt, Artificial Sequence; identical to SEQ ID NO: 43462
  derived and/or modified sequence opt5 from anti-influenza_Chain

SEQ ID NO: 43467 - RNA, 1350 nt, Artificial Sequence; identical to SEQ ID NO: 43463
  derived and/or modified sequence opt5 from anti-influenza_Chain

SEQ ID NO: 43468 - RNA, 1350 nt, Artificial Sequence; identical to SEQ ID NO: 43458
  derived and/or modified sequence opt5 from anti-influenza_Chain

SEQ ID NO: 43469 - RNA, 1350 nt, Artificial Sequence; identical to SEQ ID NO: 43459
  derived and/or modified sequence opt5 from anti-influenza_Chain

SEQ ID NO: 43470 - RNA, 1350 nt, Artificial Sequence; identical to SEQ ID NO: 43460
  derived and/or modified sequence opt5 from anti-influenza_Chain

SEQ ID NO: 43471 - RNA, 1350 nt, Artificial Sequence; identical to SEQ ID NO: 43461
  derived and/or modified sequence opt5 from anti-influenza_Chain

SEQ ID NO: 43472 - RNA, 1353 nt, Artificial Sequence
  derived and/or modified sequence opt5 from anti-influenza_Chain
gaggugcagcuggucgaaagcggcgcugagguuaagaaacccggguccucugugaaggugagcugcaaggcuuccggaggcccuuucagaucuuacgccaucagcuggguccggcaagcgccggggcagggacccgaauggaugggcgggauuaucccuauuuuuggaaccacaaaauaugcucccaaauuccagggccgcgugacgaucaccgccgacgauuuugccggcacaguuuacauggagcucuccucucugagaagcgaagacaccgcuauguauuacugugccaagcacaugggguaucaggugcgggagacaauggaugucuggggaaagggcaccacagugaccguuuccagcgcuucuacgaaagggccuuccguguucccccuugccccuagcucuaaguccaccagcggaggcacagcggcccuggggugccucgucaaagacuacuuuccggagcccgugaccgugucuuggaacuccggagcucugacaagcggcguccauaccuucccugccguucuucaauccucuggccuguauagccucuccagcguggugacgguccccucuuccagccuggggacacagaccuacauuuguaaugugaaccacaagccuucuaauacaaaaguugauaagcgcguggaacccaagagcugcgacaaaacccauaccuguccgccuugccccgcuccugagcugcucggaggccccuccgucuuucuguuucccccuaagccgaaagauacacuuaugaucucuagaacgcccgaagugaccuguguuguggucgacgugagccacgaggauccugaggucaaguuuaacugguacguggacgggguugaagugcauaaugccaaaacaaagccccgggaggaacaguauaacuccaccuaccgcgucgugagcguucugacagugcuccaccaggauuggcugaauggaaaagaguauaagugcaaggucucuaacaaagcgcuuccugcccccaucgaaaagaccauuuccaaagcuaagggccaaccgagagagccucagguguacacgcugcccccuagccgggaggaaaugaccaaaaaucaggugucucucacaugucugguuaagggguucuaucccuccgacaucgccgucgagugggaaagcaacggacagccugagaauaacuacaagaccacacccccggugcuggauuccgacggcucuuucuuccucuauagcaaacugaccguggacaagucccgcuggcaacagggcaaugucuuuucuugcagcgugaugcacgaagcccuucauaaccacuacacacagaaaucccugagccucucuccugggaag

SEQ ID NO: 43473 - RNA, 1353 nt, Artificial Sequence
  derived and/or modified sequence opt5 from anti-influenza_Chain
caggugcaacugguccagagcggcgcugagguuaagaaacccggguccucugugaaggugagcugcaaggcuuccggaggcccuuucagaucuuacgccaucagcuggguccggcaggcgccggggcagggacccgaauggaugggcgggauuaucccuauuuuuggaaccacaaaauaugcucccaaauuccaaggccgcgugacgaucaccgccgacgauuuugccggcacaguuuacauggagcucuccucucugagaagcgaagacaccgcuauguauuacugugccaagcacaugggguaucaggugcgggagacaauggaugucuggggaaagggcaccacagugaccguuuccagcgcuucuacgaaagggccuuccguguucccccuugccccuagcucuaaguccaccagcggaggcacagcggcccuggggugccucgucaaagacuacuuuccggaacccgugaccgugucuuggaacuccggagcucugacaagcggcguccauaccuucccugccguucuucaguccucuggccuguauagccucuccagcguggugacgguccccucuuccagccuggggacacagaccuacauuuguaaugugaaccacaagccuucuaauacaaaaguugauaagcgcguggagcccaagagcugcgacaaaacccauaccuguccgccuugccccgcuccugagcugcucggaggccccuccgucuuucuguuucccccuaagccgaaagauacacuuaugaucucuagaacgcccgaagugaccuguguuguggucgacgugagccacgaggauccugaagucaaguuuaacugguacguggacgggguugaggugcauaaugccaaaacaaagccccgggaggaacaauauaacuccaccuaccgcgucgugagcguucugacagugcuccaccaggauuggcugaauggaaaagaguauaagugcaaggucucuaacaaagcgcuuccugcccccaucgaaaagaccauuuccaaagcuaagggccagccgagagagccucagguguacacgcugcccccuagccgggaagagaugaccaaaaaucaagugucucucacaugucugguuaagggguucuaucccuccgacaucgccgucgagugggaaagcaacggacagccugagaauaacuacaagaccacacccccggugcuggauuccgacggcucuuucuuccucuauagcaaacugaccguggacaagucccgcuggcagcaaggcaaugucuuuucuugcagcgugaugcacgaagcccuucauaaccacuacacacagaaaucccugagccucucuccugggaag

SEQ ID NO: 43474 - RNA, 1353 nt, Artificial Sequence
  derived and/or modified sequence opt5 from anti-influenza_Chain
gaggugcagcuggucgaaagcggcgccgagguuaagaaacccggguccucugugaaggugagcugcaaggcuuccggaggcaccuucucuuuuuacagcauguccugggucagacaagccccugggcagggacucgaauggaugggcgggaucauuccgauguucggaacaacgaacuaugcgcagaaauuucagggccgggugaccaucacagcuguugagucuaccagcacagccuacauggaaguguccagccugcgcucugaggacaccgccgucuauuacugugcuagaggcgauaaagggauuuauuacuauuacauggacguguggggaaagggcacaaccguuacgguguccagcgccucuaccaaggggcccuccgucuucccucuugcucccagcucuaaauccacaagcggaggcaccgccgcgcuggggugccucgugaaggauuacuuuccugagcccgugacagucuccuggaacucuggagcccugaccagcggcguucacacguucccugcugugcuucaauccagcggccuguauucucucuccagcguggucacagugccgucuagcucccuggggacccagacauacaucuguaauguuaaucauaaacccucuaacaccaagguggacaaacgggucgaaccuaagagcugcgauaagacccacacaugucccccuugccccgccccggagcugcucggaggcccuuccguguuucuguuucccccuaaacccaaggacacgcuuaugauuagccgcacccccgaaguuacauguguggucguggaugucucucaugaggacccugaggugaaauuuaauugguauguugaugggguggaaguccacaacgcuaagaccaaaccgagagaggaacaguacaauuccacauaucgggugguuagcgugcugaccguccuccaucaggacuggcugaacggaaaggaguacaaaugcaaggugucuaauaaggcccuucccgcgccuaucgagaaaacgaucuccaaggccaaaggccaaccccgcgaaccucagguguauacacugcccccgagcagagaggaaaugaccaagaaccagguuucccucaccugucuggucaaaggguucuacccuucugauauugcuguggagugggaaagcaauggacagcccgagaacaauuacaagacaaccccucccgugcuggacuccgauggcucuuucuuccucuauagcaagcugacagucgacaaaucccgguggcaacagggcaacguguuuagcugcucuguuaugcacgaagcccuucacaaucauuacacgcagaagucccugagccucucuccugggaaa

SEQ ID NO: 43475 - RNA, 1353 nt, Artificial Sequence; identical to SEQ ID NO: 43472
  derived and/or modified sequence opt5 from anti-influenza_Chain

SEQ ID NO: 43476 - RNA, 1353 nt, Artificial Sequence; identical to SEQ ID NO: 43473
  derived and/or modified sequence opt5 from anti-influenza_Chain

SEQ ID NO: 43477 - RNA, 1353 nt, Artificial Sequence; identical to SEQ ID NO: 43474
  derived and/or modified sequence opt5 from anti-influenza_Chain

SEQ ID NO: 43478 - RNA, 1356 nt, Artificial Sequence
  derived and/or modified sequence opt5 from anti-influenza_Chain
caggugcaacugguccagagcggcgggggacucguuaagcccggcgggucccugagacuuucuugcgccgcuagcggauucaccuuuuccucuuacagcaugaacugggugcggcaggccccuggcaaagggcuggaguggguguccucuaucagcuccagcagcuccuauauuuacuaugucgacagcgugaagggacgcuucacaaucucuagagauaaugcgaaaaacucccucuaccugcagaugaauagccuucgggcugaagacacggccguuuauuacugugcccgcggcggcgggucuuauggagcuuacgagggcuuugauuacugggggcaaggaacccuggugacagucuccagcgccuccaccaagggcccgucuguguucccccucgcuccuagcuccaaaagcacaucugggggaaccgccgcgcugggcugccugguuaaggacuauuuucccgaaccugugacagucuccuggaacagcggcgcccucaccucuggggugcacacguuccccgcugugcugcagagcuccggacuuuacucucugagcuccgucguuaccgugccuucuucuucccucggcacacagaccuauauuuguaaugugaaccauaagccgagcaauacaaaagucgauaagagaguggagcccaaaucuugcgacaagacccacacguguccucccugcccugcccccgaacugcuugggggaccguccguuuuucuguucccucccaaaccuaaggauacacucaugaucagccggacccccgaggugacaugugucgugguugacgugucccaugaggaucccgaagucaaguuuaacugguacguggacggcgucgaggugcacaaugcuaaaaccaagccucgcgaagaacaguauaacucuaccuacagaguugugagcguccugacagugcugcaucaagauuggcucaaugggaaagaguauaagugcaaaguuuccaacaaggcccugccggcgcccauugagaaaacgaucucuaaggccaagggacagccucgggagccccagguguacacccuuccucccagccgcgaagagaugaccaaaaaucaggucucccugaccugucucgugaagggcuucuacccgagcgacaucgcuguggaaugggagucuaacggccaaccugagaauaacuauaaaacaacacccccuguucuggauuccgacgggagcuuuuuccuuuacucuaagcugacggucgacaaauccagauggcagcagggaaacguguuuagcugcucugugaugcacgaagcccuccacaaucauuauacacaaaagagccugucccugagccccggcaag

SEQ ID NO: 43479 - RNA, 1356 nt, Artificial Sequence
  derived and/or modified sequence opt5 from anti-influenza_Chain
caggugcaacugguccagagcggcgccgagguuaagcagcccggggcuuccgugaaagugucuugcaaggccagcggauacaccuucaacgcguauuacauccacugggucagacaggcuccuggccaagggcucgaauggaugggauggauuaauccgaacuuuggcgggacacauuaugcccggaaauuccagggacgcgugacgaugaccagagacgccuccaucaauacagcuuacauggagcuggaucggcuuauuucugacgauaccgccguuuauuacugugugcgcuggagagcugccgcggucaucauggaccaguuuuauaagauggauguguggggccagggcacacugguuaccgugagcuccgccucuacaaaagggcccagcgucuucccucucgcucccugcucccggagcaccucugaauccacggccgcucugggaugucuugugaaggacuacuuuccugagcccgugaccgucagcuggaacucuggcgcccugacauccgggguucacaccuucccugcggugcuccaaagcucuggacuguacucccugagcuccguggucacagugccgucuagcucccucggcaccaagacguauacaugcaauguugaucauaaacccagcaacaccaagguggacaaaacacgcgaaucuaaguacgggccucccuguccuuccugccccgccccggaguuucugggaggcccuagcgucuuccuuuuucccccuaaacccaaggauacccugaugauuucuagaacccccgaggugacauguguuguggucgacgugagccaggaagauccugagguccaguucaauugguauguggacggcguugaagugcacaacgcuaagacgaaaccgcgggaggagcaguuuaauuccaccuaccgcgucgugucuguucucacagugcugcaucaagauuggcuuaacgggaaggaauauaaaugcaaggucagcaauaaaggacugcccuccagcaucgagaagaccaucucuaaagccaagggccagccuagagaaccccagguguacacacucccucccgcucaagaggaaaugaccaagaaccaggugucccugacgugucugguuaaaggguucuauccgagcgacauugccgucgagugggagucuaauggacagccugaaaacaauuacaagacaacacccccugugcucgacuccgauggcagcuuuuuccuguacucccggcuuaccguggacaaaucucgcuggcaggaggggaacgucuucagcugcuccgugaugcacgaagcccugcacaaccauuauacccaaaagucucucagccugucccuuggaaaa

SEQ ID NO: 43480 - RNA, 1356 nt, Artificial Sequence
  derived and/or modified sequence opt5 from anti-influenza_Chain
gaggugcagcugguccaaagcggcgccgaaguuaagaaacccggggcuuccgugaaggugucuugcaaagccagcggauacaucuucaccggcuauuacauucacugggucagacaggcgccugggcagggacucgaguggaugggccggaucgacccgaacggggcuggaacaacguaugcccagaaguuucaaggccgcgugacccugacaauggauaccuccauuacaaccgccuacauggaacuuucuagacugcgguucgacgauacagcuaucuauuacugugcccgcugggacuggaauuuugaucucuaucugggcugguucgaccccugggggcagggaaccccuguuacgguggcuagcgccuccaccaaaggccccucugucuuuccucuugcgcccagcuccaagagcacaucugggggaaccgccgcucugggcugccucgugaaggauuacuucccugagccgguuacaguguccuggaacagcggggcccugaccucuggaguccauacguuucccgcugugcugcaguccagcggccucuacucucuguccagcguggucacaguuccuuccucuagccuuggcacccagacauauauuuguaaugugaaccacaaacccuccaauaccaagguggacaaaaaggucgaaccuaaaagcugcgauaagacccauacaugucccccgugcgccccugagcugcucgggggacccucuguguuccuguuuccucccaagcccaaagacacgcuuaugaucuccagaaccccugagguuacauguguggucguggauguuagccacgaagacccggaggugaaguucaacugguacgucgauggcguggaaguccauaaugcgaaaaccaagccccgggaggagcaauauaacucuacauaccgcgugguuagcgugcugaccguccuccaccaggacuggcugaaugggaaagaauauaagugcaaaguguccaacaaggcccugccugcucccaucgagaagacgauuucuaaagccaagggacagccuagagaaccccagguuuacacacucccgccuagccgggaggaaaugaccaaaaaucaagugucccugaccugucuugucaagggcuuuuaucccagcgacaucgcuguggagugggagucuaacgggcagccugaaaauaacuacaaaacaacacccccugugcuggauuccgacggcagcuucuuucucuacucuaagcugaccguugauaagucccgcuggcagcaaggaaaugucuucagcugcuccgugaugcacgaggcccuucauaaccacuauacgcagaaaucucugagccucucccccggcaag

SEQ ID NO: 43481 - RNA, 1356 nt, Artificial Sequence; identical to SEQ ID NO: 43479
  derived and/or modified sequence opt5 from anti-influenza_Chain

SEQ ID NO: 43482 - RNA, 1356 nt, Artificial Sequence; identical to SEQ ID NO: 43478
  derived and/or modified sequence opt5 from anti-influenza_Chain

SEQ ID NO: 43483 - RNA, 1356 nt, Artificial Sequence; identical to SEQ ID NO: 43480
  derived and/or modified sequence opt5 from anti-influenza_Chain

SEQ ID NO: 43484 - RNA, 1359 nt, Artificial Sequence
  derived and/or modified sequence opt5 from anti-influenza_Chain
caggugcaacugguccagagcggcgccgagguuaagaaacccggguccucugugagagugagcugcaaggcuuccggaucuaucuuccggaacuacgccaugagcuggguccgccaggcgccuggccaggggcucgaauggaugggaggcauuaucgcuauuuuugggaccccgaaauaugcccaaaaguuccagggaagagugacaaucacggccgacgaguccaccucuacaguuuacauggaacugagcggccuucgguccgaggauaccgcuauguauuacugugcccgcauuccccacuauaauuuuggcagcgggucuuacuucgacuauuggggacagggcacacuggugaccgucuccagcgcuucuacaaaagggccuuccguguuuccccucgccccuagcucuaaguccaccagcggaggcacggcggcccuggggugccuuguuaaggauuacuuccccgaaccugugaccgucuccuggaacucuggagcucugacaagcggcgugcauaccuuuccggccgugcuccaguccagcggccuguacucucuguccagcgucguuacagugcccucuagcucccucgggacccaaacguauaucuguaaugugaaccacaaaccuucuaauacaaaggucgacaaaagaguggagcccaagagcugcgauaaaacccauacauguccucccugcccggcuccugagcugcuuggaggccccuccguuuuccuguuuccucccaagcccaaggacacccucaugaucagccggaccccugaagugacaugugucgugguugaugugucucacgaggacccggaagucaaauucaacugguacguggauggggucgaggugcauaaugccaagacgaaaccccgcgaggaacaguauaacuccaccuacagaguugugagcguccugacagugcuucaccaggacuggcugaauggaaaggaguauaaaugcaagguuucuaacaaagcgcucccugcccccauugaaaagaccaucuccaaggcuaaaggccagccucgggagccccaaguguacacacugccgccuagccgcgaagagaugaccaagaaucaggucucccugacgugucucgugaaaggguuuuaucccucugauauugccguggagugggaaagcaacggacagccugagaauaacuacaagacaacacccccuguucuggacuccgauggcucuuucuuucuuuacagcaaacugaccgucgacaaguccagauggcaacagggcaauguguucagcugcucugugaugcacgaagcucuccauaaccacuauacccagaagucccugagccuuucucccgggaaa

SEQ ID NO: 43485 - RNA, 1359 nt, Artificial Sequence
  derived and/or modified sequence opt5 from anti-influenza_Chain
caggugcaacugguccagagcggcgcugagguuaagaaacccggggcuuccgugaaggugucuugcaaagccagcggauacaucuucaccggcuauuacauucacugggucagacaggcgccugggcagggacucgaauggaugggccggaucgacccgaacggguccggaacaacguaugcucaaaaguuucagggccgcgugacccugacaauggauaccucuauuacaaccgccuacauggagcuuagcagacugcgguucgacgauacagccaucuauuacugugcucgcugggacuggaauuuugaucucuaucugggcugguucgaccccugggggcagggaaccccuguuacgguggccuccgcuucuaccaaaggccccagcgucuuuccucuugcccccuccagcaagucuacauccgggggaaccgcggcccugggcugccucgugaaggauuacuucccugaaccgguuacagugagcuggaacucuggggcucugaccuccggaguccauacguuucccgccgugcugcagagcucuggccucuacucccugagcuccguggucacaguuccuucuagcucccuuggcacccaaacauauauuuguaaugugaaccacaaacccagcaauaccaagguggacaaaaaggucgagccuaaaucuugcgauaagacccauacaugucccccgugcccugcucccgaacugcucgggggaccuuccguguuccuguuuccucccaagcccaaagacacgcuuaugaucagcagaaccccggagguuacauguguggucguggauguuucucacgaggaccccgaagugaaguucaacugguacgucgauggcguggagguccauaaugccaaaaccaagccucgggaggaacaguauaacagcacauaccgcgugguuuccgugcugaccguccuccaccaggacuggcugaaugggaaagaguauaagugcaaagugucuaacaaggcgcugcccgccccuaucgaaaagacgauuagcaaagcuaagggacagcccagagagccgcaaguuuacacacucccucccucccgggaagagaugaccaaaaaucaggugagccugaccugucuugucaagggcuuuuauccuucugacaucgccguggaaugggaguccaacgggcagcccgagaauaacuacaaaacaaccccucccgugcuggauagcgacggaucuuucuuucucuacuccaagcugacaguugauaagagccgcuggcaacagggcaaugucuucuccugcucugugaugcacgaagcccuucauaaccacuauacgcagaaaagccugucccucucuccgggcaag

SEQ ID NO: 43486 - RNA, 1359 nt, Artificial Sequence
  derived and/or modified sequence opt5 from anti-influenza_Chain
gaggugcagcugguccaaagcggcgccgaaguuaagaaacccggggcuuccgugaaggugucuugcaaagccagcggauacaucuucaccggcuauuacauucacugggucagacaggcgccugggcagggacucgaguggaugggccggaucgacccgaacggggcuggaacaacguaugcccagaaguuucaaggccgcgugacccugacaauggauaccuccauuacaaccgccuacauggaacuuucuagacugcgguucgacgauacagcuaucuauuacugugcccgcugggacuggaauuuugaucucuaucugggcugguucgaccccugggggcagggaaccccuguuacgguggcuagcgccuccaccaaaggccccucugucuuuccucuugcgcccagcuccaagagcacaucugggggaaccgccgcucugggcugccucgugaaggauuacuucccugagccgguuacaguguccuggaacagcggggcccugaccucuggaguccauacguuucccgcugugcugcaguccagcggccucuacucucuguccagcguggucacaguuccuuccucuagccuuggcacccagacauauauuuguaaugugaaccacaaacccuccaauaccaagguggacaaaaaggucgaaccuaaaagcugcgauaagacccauacaugucccccgugcccugcccccgagcugcucgggggaccuucuguguuccuguuuccucccaagcccaaagacacgcuuaugaucuccagaaccccggagguuacauguguggucguggauguuagccacgaagaccccgaggugaaguucaacugguacgucgauggcguggaaguccauaaugcgaaaaccaagccucgggaggagcaauauaacucuacauaccgcgugguuagcgugcugaccguccuccaccaggacuggcugaaugggaaagaauauaagugcaaaguguccaacaaggcccugcccgcuccuaucgagaagacgauuucuaaagccaagggacagcccagagaaccgcagguuuacacacucccucccagccgggaggaaaugaccaaaaaucaagugucccugaccugucuugucaagggcuuuuauccuagcgacaucgcuguggagugggagucuaacgggcagcccgaaaauaacuacaaaacaaccccucccgugcuggauuccgacggcagcuucuuucucuacucuaagcugacaguugauaagucccgcuggcagcaaggaaaugucuucagcugcuccgugaugcacgaggcccuucauaaccacuauacgcagaaaucucugagccucuccccgggcaag

SEQ ID NO: 43487 - RNA, 1359 nt, Artificial Sequence
  derived and/or modified sequence opt5 from anti-influenza_Chain
caggugcaacugguccagagcggcgccgagguuaagaaacccggggcuuccgugaaggugucuugcaaagccagcggauacaccuucaacgcgcaccauaugcacugggucagacaggcuccuggccaggggcucggauggaugggcuggaucgacccgaauaacgaugggacaauuuaugcccaaaaguuucagggacgggugacgcugaccauggacacauccauccauaccgccuacauggaacuuucuggccugcgcuaugaugacacagcuauuuacuauuguguuagaugggccuggaauuucgacuuuuuccucggcugguuugaucccugggggcagggaacccuggugacagucgcuagcgccuccaccaaaggcccuucuguguucccccuugcgccuagcuccaagagcacgucugggggaaccgccgcucugggcugccucguuaaggauuacuuucccgagccugugacagucuccuggaacagcggggcccugaccucuggagugcacacauucccggcugugcugcaguccagcggccucuauucucuguccagcgucguuaccgugcccuccucuagccuuggcacgcaaacauacaucuguaaugugaaccauaaaccuuccaauaccaaggucgacaaaaagguggaacccaaaagcugcgauaagacacacaccuguccucccugcccggccccugagcugcucgggggacccucuguuuuucuguucccucccaagcccaaagacacccuuaugauuucccggacaccugaagugacgugugucgugguugaugugagccacgaggacccggaggucaaguuuaacugguacguggauggcgucgaagugcauaaugcgaaaaccaagccccgcgaggaacaguauaacucuacauacagaguugugagcguccugaccgugcuccaccaggacuggcugaaugggaaagaguauaagugcaaaguuuccaacaaggcccugccugcucccaucgagaagacaaucucuaaagccaagggacagccucgggaaccccaaguguacacccucccgccuagccgcgaggaaaugacgaaaaaucaggucucccugacaugucuugugaagggcuucuaucccagcgacauugcuguggagugggaaucuaacgggcagccugagaauaacuacaaaaccacacccccuguucuggauuccgacggcagcuuuuuccucuauucuaagcugaccgucgauaaguccagauggcaacagggaaacguguucagcugcuccgugaugcaugaggcccuucacaaucacuacacccagaaaucucugagccucucccccggcaag

SEQ ID NO: 43488 - RNA, 1359 nt, Artificial Sequence
  derived and/or modified sequence opt5 from anti-influenza_Chain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccgggggacagcgauacaauuuacucccccucuuuucagggacaagucacgaucagcgcugacaacuccauuagcaccgccuaucuucaguggucuucccugaaagcgagcgauacagcuaucuacuauugugccucuggcccuggcuacuccggguaucacuacggaugguucgacaccuggggccaggggacacucgugaccguuagcucugccuccacaaagggacccagcguguuuccucuggcucccuccucuaagagcaccuccggcgggacggccgcucuuggaugccuggucaaagauuacuucccugagccggugaccguuagcuggaauagcggcgcccucacauccggcgugcauaccuuucccgcgguccugcagagcucugggcuguauagccucuccucuguggugacagucccuagcuccagccugggaacccaaacguacaucuguaacguuaaucacaagcccucuaacacaaaaguggacaagaaaguggaaccuaaguccugcgauaagacccauacaugucccccgugcccugcccccgagcuucugggcgggccuagcgucuuccucuuuccucccaaacccaaggacacccugaugauuucucggaccccggaggugacauguguuguggucgaugugucccacgaagaccccgagguuaaauucaauugguauguggauggagucgaagugcauaacgcuaagacgaaaccucgcgaggagcaguacaauagcaccuauagagucguguccguucuuacagugcugcaccaggacuggcucaacggcaaggaauacaaaugcaaggucucuaauaaggcccugcccgcuccuaucgagaaaaccauuagcaaggccaaagggcagccccgggaaccgcaaguguauacacugccucccucccgcgaggaaaugaccaagaaccagguuucucucacgugucuggugaaaggauuuuacccuagcgauaucgcggucgagugggaguccaauggccagcccgaaaacaauuacaagacaaccccucccgugcuugacagcgacggcucuuucuuucuguauuccaagcucaccguggauaaaagcagauggcaacaggggaacguuuucucuugcuccgucaugcacgaggcccugcauaaucacuacacacagaagucucuuucucugagcccgggaaaa

SEQ ID NO: 43489 - RNA, 1359 nt, Artificial Sequence
  derived and/or modified sequence opt5 from anti-influenza_Chain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccgggggacgcugaugccauuuacagccccuccuuucagggacaagucacaaucucugcggacaacagcauuuccacggcuuaucuucaguggagcucucugaaagccuccgauaccgccaucuacuauugugcuagcggcccuggcuacucuggguaucacuacggaugguucgacacauggggccaggggacccucgugacaguuuccagcgccucuaccaagggacccuccguguuuccucuggcucccagcuccaagucuacaagcggcgggaccgccgcgcuuggaugccuggucaaagauuacuucccugagccggugacgguuuccuggaauagcggcgcccucaccucuggcgugcauacauuucccgcuguccugcaguccagcgggcuguauucucucagcuccguggugaccgucccuucuagcucccugggaacacaaaccuacaucuguaacguuaaucacaagcccagcaacacgaaaguggacaagaaaguggaaccuaagucuugcgauaagacacauaccugucccccgugcccugcccccgagcuucugggcgggccuuccgucuuccucuuuccucccaaacccaaggacacacugaugauuagccggaccccggaggugaccuguguuguggucgaugugucucacgaagaccccgagguuaaauucaauugguauguggauggagucgaagugcauaacgcuaagacaaaaccucgcgaggagcaguacaauuccacguauagagucgugagcguucuuaccgugcugcaccaggacuggcucaacggcaaggaauacaaaugcaaggucuccaauaaggcccugcccgcgccuaucgagaaaacaauuucuaaggccaaagggcagccccgggaaccgcaaguguauacccugccucccagccgcgaggaaaugacaaagaaccagguuucccucaccugucuggugaaaggauuuuacccuucugauaucgcugucgagugggagagcaauggccagcccgaaaacaauuacaagacgacaccucccgugcuugacuccgacggcagcuucuuucuguauucuaagcucaccguggauaaauccagauggcaacaggggaacguuuucagcugcucugucaugcacgaggcccugcauaaucacuacacccagaagucccuuagccugucuccgggaaaa

SEQ ID NO: 43490 - RNA, 1359 nt, Artificial Sequence; identical to SEQ ID NO: 39233
  derived and/or modified sequence opt5 from anti-influenza_Chain

SEQ ID NO: 43491 - RNA, 1359 nt, Artificial Sequence
  derived and/or modified sequence opt5 from anti-influenza_Chain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccgggggacgcugauacaauuuacagccccuccuuucagggacaagucacgaucucugccgacaacagcauuuccaccgcguaucuucaguggagcucucugaaggcuuccgauacagccaucuacuauugugccagcggcccuggcuacucuggguaucacuacggaugguucgacaccuggggccaggggacacucgugaccguuuccagcgcuucuacaaaaggacccuccguguuuccucuggcccccagcuccaagucuaccagcggcgggacggcugcccuuggaugccuggucaaagauuacuucccugagccggugaccguuuccuggaauagcggcgcgcucacaucuggcgugcauaccuuucccgccguccugcaguccagcgggcuguauucucucagcuccguggugacagucccuucuagcucccugggaacccaaacguacaucuguaacguuaaucacaagcccagcaacacaaaaguggacaagaaaguggaaccuaagucuugcgauaagacccauacaugucccccgugcccugcucccgagcuucugggcgggccuuccgucuuccucuuuccucccaaacccaaggacacccugaugauuagccggaccccggaggugacauguguuguggucgaugugucucacgaagaccccgagguuaaauucaauugguauguggauggagucgaagugcauaacgccaagacgaaaccucgcgaggagcaguacaauuccaccuauagagucgugagcguucuuacagugcugcaccaggacuggcucaacggcaaggaauacaaaugcaaggucuccaauaaggcucugcccgccccuaucgagaaaaccauuucuaaggcgaaagggcagccccgggaaccgcaaguguauacacugccucccagccgcgaggaaaugaccaagaaccagguuucccucacgugucuggugaaaggauuuuacccuucugauaucgccgucgagugggagagcaauggccagcccgaaaacaauuacaagacaaccccucccgugcuugacuccgacggcagcuucuuucuguauucuaagcucaccguggauaaauccagauggcaacaggggaacguuuucagcugcucugucaugcacgaggcucugcauaaucacuacacacagaagucccuuagccugucuccgggaaaa

SEQ ID NO: 43492 - RNA, 1359 nt, Artificial Sequence
  derived and/or modified sequence opt5 from anti-influenza_Chain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccggggagcuccgacacaauuuacucucccagcuuucagggacaagucacgaucuccgcugauaacagcauuucuaccgccuaucuucagugguccagccugaaagcgucugacacagcuaucuacuauugugccuccggcccuggcuacagcggguaucacuacggaugguucgauaccuggggccaggggacacucgugaccguuucuuccgccagcacaaagggacccuccguguuuccucuggcucccucuagcaaguccaccagcggcgggacggccgcucuuggaugccuggucaaagacuacuucccugagccggugaccguuucuuggaacuccggcgcccucacaagcggcgugcauaccuuucccgcgguccugcagucuagcgggcuguauucccucucuagcguggugacagucccuuccagcucucugggaacccaaacguacaucuguaauguuaaucacaagcccuccaacacaaaaguggauaagaaaguggaaccuaagagcugcgacaagacccauacaugucccccgugcccugcccccgagcuucugggcgggccuucugucuuccucuuuccucccaaacccaaggauacccugaugauuucccggaccccggaggugacauguguuguggucgacgugagccacgaagaucccgagguuaaauucaauugguauguggacggagucgaagugcauaacgcuaagacgaaaccucgcgaggagcaguacaauuccaccuauagagucgugucuguucuuacagugcugcaccaggauuggcucaacggcaaggaauacaaaugcaaggucagcaauaaggcccugcccgcuccuaucgagaaaaccauuuccaaggccaaagggcagccccgggaaccgcaaguguauacacugccucccucucgcgaggaaaugaccaagaaccagguuagccucacgugucuggugaaaggauuuuacccuuccgacaucgcggucgagugggagagcaauggccagcccgaaaacaauuacaagacaaccccucccgugcuugauucugacggcuccuucuuucuguauagcaagcucaccguggacaaaucuagauggcaacaggggaacguuuucuccugcagcgucaugcacgaggcccugcauaaucacuacacacagaagucucuuagccuguccccgggaaaa

SEQ ID NO: 43493 - RNA, 1359 nt, Artificial Sequence
  derived and/or modified sequence opt5 from anti-influenza_Chain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccgggggacagcgaugcuauuuacucccccucuuuucagggacaagucacaaucagcgccgacaacuccauuagcacggcguaucuucaguggucuucccugaaagcuagcgauaccgccaucuacuauugugccucuggcccuggcuacuccggguaucacuacggaugguucgacacauggggccaggggacccucgugacaguuagcucugcuuccaccaagggacccagcguguuuccucuggcccccuccucuaagagcacauccggcgggaccgcugcccuuggaugccuggucaaagauuacuucccugagccggugacgguuagcuggaauagcggcgcgcucaccuccggcgugcauacauuucccgccguccugcagagcucugggcuguauagccucuccucuguggugaccgucccuagcuccagccugggaacacaaaccuacaucuguaacguuaaucacaagcccucuaacacgaaaguggacaagaaaguggaaccuaaguccugcgauaagacacauaccugucccccgugcccugcucccgagcuucugggcgggccuagcgucuuccucuuuccucccaaacccaaggacacacugaugauuucucggaccccggaggugaccuguguuguggucgaugugucccacgaagaccccgagguuaaauucaauugguauguggauggagucgaagugcauaacgccaagacaaaaccucgcgaggagcaguacaauagcacguauagagucguguccguucuuaccgugcugcaccaggacuggcucaacggcaaggaauacaaaugcaaggucucuaauaaggcucugcccgccccuaucgagaaaacaauuagcaaggcgaaagggcagccccgggaaccgcaaguguauacccugccucccucccgcgaggaaaugacaaagaaccagguuucucucaccugucuggugaaaggauuuuacccuagcgauaucgccgucgagugggaguccaauggccagcccgaaaacaauuacaagacgacaccucccgugcuugacagcgacggcucuuucuuucuguauuccaagcucaccguggauaaaagcagauggcaacaggggaacguuuucucuugcuccgucaugcacgaggcucugcauaaucacuacacccagaagucucuuucucugagcccgggaaaa

SEQ ID NO: 43494 - RNA, 1359 nt, Artificial Sequence
  derived and/or modified sequence opt5 from anti-influenza_Chain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccgggggacacagauacgauuuacagccccuccuuucagggacaagucaccaucucugcugacaacagcauuuccacagccuaucuucaguggagcucucugaaagcguccgauaccgcuaucuacuauugugccagcggcccuggcuacucuggguaucacuacggaugguucgacacauggggccaggggacccucgugacaguuuccagcgccucuaccaagggacccuccguguuuccucuggcucccagcuccaagucuacgagcggcgggaccgccgcucuuggaugccuggucaaagauuacuucccugagccggugacaguuuccuggaauagcggcgcccucaccucuggcgugcauacauuucccgcgguccugcaguccagcgggcuguauucucucagcuccguggugaccgucccuucuagcucccugggaacgcaaacauacaucuguaacguuaaucacaagcccagcaacaccaaaguggacaagaaaguggaaccuaagucuugcgauaagacacauaccugucccccgugcccugcccccgagcuucugggcgggccuuccgucuuccucuuuccucccaaacccaaggacacccugaugauuagccggacaccggaggugacguguguuguggucgaugugucucacgaagaccccgagguuaaauucaauugguauguggauggagucgaagugcauaacgcuaagaccaaaccucgcgaggagcaguacaauuccacauauagagucgugagcguucuuaccgugcugcaccaggacuggcucaacggcaaggaauacaaaugcaaggucuccaauaaggcccugcccgcuccuaucgagaaaacaauuucuaaggccaaagggcagccccgggaaccgcaaguguauacccugccucccagccgcgaggaaaugacgaagaaccagguuucccucacaugucuggugaaaggauuuuacccuucugauaucgcggucgagugggagagcaauggccagcccgaaaacaauuacaagaccaccccucccgugcuugacuccgacggcagcuucuuucuguauucuaagcucacaguggauaaauccagauggcaacaggggaacguuuucagcugcucugucaugcacgaggcccugcauaaucacuacacccagaagucccuuagccugucuccgggaaaa

SEQ ID NO: 43495 - RNA, 1359 nt, Artificial Sequence
  derived and/or modified sequence opt5 from anti-influenza_Chain
gaggugcagcugguccaaagcggcgccgaaguuaagaaacccggggagucccucaagaucucuugcaaagugagcggauacuccuucaccucucaguggauuggcugggugagacagaugccugggaagggacuggaauggaucggcaugauguauccgggggagagcgacacaauuuacucccccucuuuucagggacaagucacgaucagcgcugauaacuccauuagcaccgccuaucuucaguggucuucccugaaagcgagcgacacagcuaucuacuauugugccucuggcccuggcuacuccggguaucacuacggaugguucgauaccuggggccaggggacacucgugaccguuagcucugccuccacaaagggacccagcguguuuccucuggcucccuccucuaagagcaccuccggcgggacggccgcucuuggaugccuggucaaagacuacuucccugaaccggugaccguuagcuggaacucuggcgcccucacauccggcgugcauaccuuucccgcgguccugcagagcucugggcuguauagccucuccucuguggugacagucccuagcuccagccugggaacccaaacguacaucuguaauguuaaucacaagcccucuaacacaaaaguggauaagaaaguggagccuaaguccugcgacaagacccauacaugucccccgugcccugcccccgagcuucugggcgggccuagcgucuuccucuuuccucccaaacccaaggauacccugaugauuucucggaccccggaagugacauguguuguggucgacgugucccacgaggaucccgaaguuaaauucaauugguauguggacggagucgaggugcauaacgcuaagacgaaaccucgcgaggaacaguacaauagcaccuauagagucguguccguucuuacagugcugcaccaggauuggcucaacggcaaggaguacaaaugcaaggucucuaauaaggcccugcccgcuccuaucgaaaagaccauuagcaaggccaaagggcagccccgggagccgcaaguguauacacugccucccucccgcgaagagaugaccaagaaccagguuucucucacgugucuggugaaaggauuuuacccuagcgacaucgcggucgagugggaauccaauggccagcccgagaacaauuacaagacaaccccucccgugcuugauagcgacggcucuuucuuucuguauuccaagcucaccguggacaaaagcagauggcaacaggggaacguuuucucuugcuccgucaugcacgaagcccugcauaaucacuacacacagaaaagccuuucucugagcccgggaaaa

SEQ ID NO: 43496 - RNA, 1359 nt, Artificial Sequence; identical to SEQ ID NO: 43484
  derived and/or modified sequence opt5 from anti-influenza_Chain

SEQ ID NO: 43497 - RNA, 1359 nt, Artificial Sequence; identical to SEQ ID NO: 43485
  derived and/or modified sequence opt5 from anti-influenza_Chain

SEQ ID NO: 43498 - RNA, 1359 nt, Artificial Sequence; identical to SEQ ID NO: 43486
  derived and/or modified sequence opt5 from anti-influenza_Chain

SEQ ID NO: 43499 - RNA, 1359 nt, Artificial Sequence; identical to SEQ ID NO: 43487
  derived and/or modified sequence opt5 from anti-influenza_Chain

SEQ ID NO: 43500 - RNA, 1359 nt, Artificial Sequence; identical to SEQ ID NO: 43488
  derived and/or modified sequence opt5 from anti-influenza_Chain

SEQ ID NO: 43501 - RNA, 1359 nt, Artificial Sequence; identical to SEQ ID NO: 43489
  derived and/or modified sequence opt5 from anti-influenza_Chain

SEQ ID NO: 43502 - RNA, 1359 nt, Artificial Sequence; identical to SEQ ID NO: 39233
  derived and/or modified sequence opt5 from anti-influenza_Chain

SEQ ID NO: 43503 - RNA, 1359 nt, Artificial Sequence; identical to SEQ ID NO: 43491
  derived and/or modified sequence opt5 from anti-influenza_Chain

SEQ ID NO: 43504 - RNA, 1359 nt, Artificial Sequence; identical to SEQ ID NO: 43492
  derived and/or modified sequence opt5 from anti-influenza_Chain

SEQ ID NO: 43505 - RNA, 1359 nt, Artificial Sequence; identical to SEQ ID NO: 43493
  derived and/or modified sequence opt5 from anti-influenza_Chain

SEQ ID NO: 43506 - RNA, 1359 nt, Artificial Sequence; identical to SEQ ID NO: 43494
  derived and/or modified sequence opt5 from anti-influenza_Chain

SEQ ID NO: 43507 - RNA, 1359 nt, Artificial Sequence; identical to SEQ ID NO: 43495
  derived and/or modified sequence opt5 from anti-influenza_Chain

SEQ ID NO: 43508 - RNA, 1365 nt, Artificial Sequence
  derived and/or modified sequence opt5 from anti-influenza_Chain
caggugcaacuggucgagagcggcgggggaguugugcagcccggcagaucccuccggcugucuugcgccgcuagcggguucgccuuucacaaccgcgcgaugcauugggugagacaggcuccuggaaagggccuugaaugggucgcccugaucuacuucgacggguccaaacaguauuacgccgauucugugaagggacgguuuaccauuagccgcgacaauuccaaaaacacaguuuuccuccaaaugaauagccugagaccggaggauacggcuguguauuacugugccguccccggcccuaucuuuggcauuuucccgccuuggucuuauuuugaccacugggggcagggaauccuugugaccguuuccagcgcuucuacaaagggccccuccguguucccucuggccccgagcucuaaauccaccagcgggggaacagcggcccucggcugccuggucaaggauuacuuucccgaaccugugaccgugucuuggaacuccggggcucugacaagcggaguccauaccuuccccgccguucuccaguccucuggccuguauagccuuuccagcguggugacggucccuucuuccagccugggcacccagacauacauuuguaaugugaaccacaagcccucuaauaccaaaguugacaagaaaguggagcccaagagcugcgauaaaacacauaccuguccucccugcccugcucccgaacuccuugggggacccuccgucuuucuguucccuccgaagcccaaggacacgcugaugaucucucggacaccugaggugaccuguguuguggucgaugugagccacgaggaccccgaagucaaauuuaacugguacguggauggcguugaggugcacaaugccaagacaaaaccucgcgaggaacaauauaacuccaccuacagagucgugagcguucucaccgugcugcaucaggacuggcugaaugggaaggaguauaaaugcaaggucucuaacaaagcgcuccccgccccgaucgaaaagacaauuuccaaggcuaaaggacagccucgggagccccagguguacacgcugccucccagccgcgaagagaugaccaagaaucaagugucucuuacaugucugguuaaaggcuucuauccuuccgauaucgccgucgaaugggagagcaacgggcagcccgagaauaacuacaagaccacaccgccugugcucgacuccgacggaucuuucuuucuguauagcaaacuuaccguggauaaguccagauggcagcaaggcaacgucuucucuugcagcgugaugcacgaagcucugcauaaucacuacacgcagaagucccucagccugucucccggcaaa

SEQ ID NO: 43509 - RNA, 1365 nt, Artificial Sequence
  derived and/or modified sequence opt5 from anti-influenza_Chain
gaggugcagcuggucgaaagcggcgggggaguugugcaacccggcagaucccuccggcugucuugcgccgcuagcggguucgccuuucacaaccgcgcgaugcauugggugagacaggcuccuggaaagggccuugagugggucgcccugaucuacuucgacggguccaaacaguauuacgccgauucugugaagggacgguuuaccauuagccgcgacaauuccaaaaacacaguuuuccuccagaugaauagccugagaccggaagauacggcuguguauuacugugccguccccggcccuaucuuuggcauuuucccgccuuggucuuauuuugaccacugggggcaaggaauccuugugaccguuuccagcgcuucuacaaagggccccuccguguucccucuggccccgagcucuaaauccaccagcgggggaacagcggcccucggcugccuggucaaggauuacuuucccgagccugugaccgugucuuggaacuccggggcucugacaagcggaguccauaccuuccccgccguucuccaguccucuggccuguauagccuuuccagcguggugacggucccuucuuccagccugggcacccagacauacauuuguaaugugaaccacaagcccucuaauaccaaaguugacaagaaaguggaacccaagagcugcgauaaaacacauaccuguccucccugcccugcucccgagcuccuugggggacccuccgucuuucuguucccuccgaagcccaaggacacgcugaugaucucucggacaccugaggugaccuguguuguggucgaugugagccacgaagaccccgaggucaaauuuaacugguacguggauggcguugaagugcacaaugccaagacaaaaccucgcgaggagcaguauaacuccaccuacagagucgugagcguucucaccgugcugcaucaagacuggcugaaugggaaggaauauaaaugcaaggucucuaacaaagcgcuccccgccccgaucgagaagacaauuuccaaggcuaaaggacagccucgggaaccccagguguacacgcugccucccagccgcgaggaaaugaccaagaaucaggugucucuuacaugucugguuaaaggcuucuauccuuccgauaucgccgucgagugggagagcaacgggcaacccgaaaauaacuacaagaccacaccgccugugcucgacuccgacggaucuuucuuucuguauagcaaacuuaccguggauaaguccagauggcagcagggcaacgucuucucuugcagcgugaugcacgaggcucugcauaaucacuacacgcaaaagucccucagccugucucccggcaaa

SEQ ID NO: 43510 - RNA, 1365 nt, Artificial Sequence
  derived and/or modified sequence opt5 from anti-influenza_Chain
gaggugcagcugguccaaagcggcgggggaguugugcagcccggcaagucccucagacugucuugcgccgcuagcgggcuuaccuucuccucuuacgccgugcacuggguccggcaggcgccuggaaaaggccuggaaugggugacacucaucagcuaugacggggcuaaccaguacuaugccgauuccguuaagggacgcuuuacgauuucuagagacaauagcaaaaacaccguguaccugcaaaugaacucccuucggccggaggauacagccgucuauuacugugcugugcccggcccuguuuucggcaucuuucccccuuggagcuauuucgacaauugggggcagggcauucuggugaccgucucuuccgccagcacaaagggacccucuguguuuccucucgcuccguccagcaaaucuaccuccgggggaacagccgcgcugggcugccuggugaaggauuacuuccccgaaccugucaccguuagcuggaacuccggggcccucacgucuggagugcauaccuuucccgcugugcugcagagcuccggccuuuacagccugucuuccgucgugacaguuccuagcucuagccucggcacccagacauauaucuguaaugugaaucacaagcccuccaacaccaaagucgacaagaaaguggagccgaagucuugcgauaaaacgcauacauguccucccugcccugcccccgaacugcuugggggacccagcguuuuccuguuuccuccgaagcccaaggacacccucaugauuucccgcacaccugaggugaccugugucguggucgaugugagccacgaggaccccgaaguuaaauucaauugguacguggauggcgucgaggugcauaacgcuaagaccaaaccuagagaggaacaauauaauucuacauaccggguuguguccguccugacggugcugcaccaggacuggcucaacgggaaggaguauaaaugcaaggugagcaauaaagcccugcccgcgccgaucgaaaagaccaucucuaaggccaaaggacagccucgcgagccccagguuuacacacuuccucccuccagagaagagaugaccaagaaccaagucagccugacaugucucgugaaaggcuuuuauccuuccgauauugcuguggaaugggagucuaaugggcagcccgagaacaacuacaagaccacgccgccuguccuggacagcgacggauccuucuuucuuuacucuaaacugacaguggauaagagccgguggcagcaaggcaauguuuucuccugcagcgugaugcacgaagcccuccauaaccacuauacccagaagucucugucccugagccccggcaaa

SEQ ID NO: 43511 - RNA, 1365 nt, Artificial Sequence
  derived and/or modified sequence opt5 from anti-influenza_Chain
caggugcaacuggucgagagcggcgggggaguugugcagcccggcaagucccucagacugucuugcgccgcuagcgggcuuaccuucuccucuuacgccgugcacuggguccggcaggcgccuggaaaaggccuggaaugggugacacucaucagcuaugacggggcuaaccaguacuaugccgauuccguuaagggacgcuuuacgauuucuagagacaauagcaaaaacaccguguaccugcaaaugaacucccuucggccggaggauacagccgucuauuacugugcugugcccggcccuguuuucggcaucuuucccccuuggagcuauuucgacaauugggggcagggcauucuggugaccgucucuuccgccagcacaaagggacccucuguguuuccucucgcuccguccagcaaaucuaccuccgggggaacagccgcgcugggcugccuggugaaggauuacuuccccgaaccugucaccguuagcuggaacuccggggcccucacgucuggagugcauaccuuucccgcugugcugcagagcuccggccuuuacagccugucuuccgucgugacaguuccuagcucuagccucggcacccagacauauaucuguaaugugaaucacaagcccuccaacaccaaagucgacaagaaaguggagccgaagucuugcgauaaaacgcauacauguccucccugcccugcccccgaacugcuugggggacccagcguuuuccuguuuccuccgaagcccaaggacacccucaugauuucccgcacaccugaggugaccugugucguggucgaugugagccacgaggaccccgaaguuaaauucaauugguacguggauggcgucgaggugcauaacgcuaagaccaaaccuagagaggaacaauauaauucuacauaccggguuguguccguccugacggugcugcaccaggacuggcucaacgggaaggaguauaaaugcaaggugagcaauaaagcccugcccgcgccgaucgaaaagaccaucucuaaggccaaaggacagccucgcgagccccagguuuacacacuuccucccuccagagaagagaugaccaagaaccaagucagccugacaugucucgugaaaggcuuuuauccuuccgauauugcuguggaaugggagucuaaugggcagcccgagaacaacuacaagaccacgccgccuguccuggacagcgacggauccuucuuucuuuacucuaaacugacaguggauaagagccgguggcagcaaggcaauguuuucuccugcagcgugaugcacgaagcccuccauaaccacuauacccagaagucucugucccugagccccggcaaa

SEQ ID NO: 43512 - RNA, 1365 nt, Artificial Sequence
  derived and/or modified sequence opt5 from anti-influenza_Chain
caggugcaacuggucgagagcggcgggggaguugugcagcccggcaaguccccuagacucucuugcgccgcuagcgggccgaccuucuccucuuacgccgugcacuggguccggcaggcgcccggaaaaggccuggaaugggugacacuuaucagcuaugacggggcuaaccaguacuaugccgauuccguuaagggacgcuuuacgauuucuagagacaauagcaaaaacaccguguaccugcaaaugaacucccuccggccugaggauacagccgucuauuacugugcugugcccggcccuguuuucggcaucuuucccccuuggagcuauuucgacaauugggggcagggcauucuggugaccgucucuuccgccagcacaaagggaccgucuguguuuccccuugcuccuuccagcaaaucuaccuccgggggaacagccgcgcugggcugccucgugaaggauuacuuccccgaaccugucaccguuagcuggaacuccggggcccugacgucuggagugcauaccuuucccgcugugcugcagagcuccggccucuacagccugucuuccgucgugacaguuccgagcucuagccuuggcacccagacauauaucuguaaugugaaucacaagccuuccaacaccaaagucgacaagaaaguggagcccaagucuugcgauaaaacgcauacauguccucccugccccgccccugaacugcucgggggaccgagcguuuuccuguuucccccuaagcccaaggacacccuuaugauuucccgcacaccugaggugaccugugucguggucgaugugagccacgaggaccccgaaguuaaauucaauugguacguggauggcgucgaggugcauaacgcuaagaccaaaccgagagaggaacaauauaauucuacauaccggguuguguccguccugacggugcuccaccaggacuggcugaacgggaaggaguauaaaugcaaggugagcaauaaagcccugccugcgcccaucgaaaagaccaucucuaaggccaaaggacagccucgcgagccccagguuuacacacucccucccuccagagaagagaugaccaagaaccaagucagccugacaugucuugugaaaggcuuuuauccguccgauauugcuguggaaugggagucuaaugggcagccugagaacaacuacaagaccacgccucccguccuggacagcgacggauccuucuuucucuacucuaaacugacaguggauaagagccgguggcagcaaggcaauguuuucuccugcagcgugaugcacgaagcccuucauaaccacuauacccagaagucucugucccucagccccggcaaa

SEQ ID NO: 43513 - RNA, 1365 nt, Artificial Sequence; identical to SEQ ID NO: 39217
  derived and/or modified sequence opt5 from anti-influenza_Chain

SEQ ID NO: 43514 - RNA, 1365 nt, Artificial Sequence
  derived and/or modified sequence opt5 from anti-influenza_Chain
caggugcagcugguccagagcggcgccgagcucaagagacccggggcuuccguuaaagugucuugcaagaccagcggauacuccuucaacaauuauggcaucaacugggugcggcaggccccugggcagggacuggaauggaugggcuggauuucugcguacacagggaauacgcacuaugcuaaaaacuuugagggacgcgucacccuuacaaccgacacaagcaccuccacagccuacauggaagugagaucucugcggagcgaugacuccgccguuuauuucugugcucgcgccaugauccaaggcguggucacccucuaccugagaccgggcgauuauugggggcagggaacgcuugugaccguuagcucugcuuccacaaagggccccagcguguuuccucuggcccccucuuccaaaagcaccucugggggaacagcggcccucggcugccuggucaaggacuacuucccugagcccgugaccguguccuggaauagcggggcucugacguccggaguccauacauuuccugccguucuccagucuagcggccuguacucccuuagcucuguggugaccgucccguccagcucucugggcacacagaccuauauuuguaacgugaaucacaagcccagcaacaccaaaguugauaagaaaguggaaccuaaguccugcgacaaaacacauacgugucccccuugccccgcuccggagcuccugggaggaccuucugucuuccuuuuucccccuaagcccaaggauacccugaugaucagccggacacccgaggugaccuguguuguggucgacgugucccacgaagauccugaggucaaauucaauugguacguggacggcguugaagugcauaacgccaagacaaaaccgcgcgaggagcaauauaauagcaccuacagagucgugucuguucucacggugcugcaccaggauuggcugaacgggaaggaauauaaaugcaaggucuccaauaaagcgcuccccgccccuauugagaagacaaucagcaaggcuaaaggacagccccgggaaccucagguguacacccugcccccgucucgcgaggaaaugaccaagaaccaagugucccuuacaugucugguuaaaggcuuuuauccuagcgacaucgccgucgagugggaguccaaugggcagcccgaaaacaacuacaagaccacaccucccgugcucgauucugacgggagcuucuuucuguacuccaaacuuacgguggacaagucuagauggcagcaaggcaaugucuucagcugcuccgugaugcacgaggcucugcauaaccacuauacccaaaagagccucucucuguccccuggcaaa

SEQ ID NO: 43515 - RNA, 1365 nt, Artificial Sequence; identical to SEQ ID NO: 43508
  derived and/or modified sequence opt5 from anti-influenza_Chain

SEQ ID NO: 43516 - RNA, 1365 nt, Artificial Sequence; identical to SEQ ID NO: 43509
  derived and/or modified sequence opt5 from anti-influenza_Chain

SEQ ID NO: 43517 - RNA, 1365 nt, Artificial Sequence; identical to SEQ ID NO: 43510
  derived and/or modified sequence opt5 from anti-influenza_Chain

SEQ ID NO: 43518 - RNA, 1365 nt, Artificial Sequence; identical to SEQ ID NO: 43511
  derived and/or modified sequence opt5 from anti-influenza_Chain

SEQ ID NO: 43519 - RNA, 1365 nt, Artificial Sequence; identical to SEQ ID NO: 43512
  derived and/or modified sequence opt5 from anti-influenza_Chain

SEQ ID NO: 43520 - RNA, 1365 nt, Artificial Sequence; identical to SEQ ID NO: 39217
  derived and/or modified sequence opt5 from anti-influenza_Chain

SEQ ID NO: 43521 - RNA, 1365 nt, Artificial Sequence; identical to SEQ ID NO: 43514
  derived and/or modified sequence opt5 from anti-influenza_Chain

SEQ ID NO: 43522 - RNA, 1368 nt, Artificial Sequence
  derived and/or modified sequence opt5 from anti-influenza_Chain
gaggugcagcugguccaaagcggcgggggaguugugcagcccagacggucccuccgccugucuugcgccgcuagcggcuucaccuuuuccucuuacgccaugcacugggugagacaggcgccugggaagggacuugaaugggucgcugugaucagcuaugacggccggaacaaauacuaugccgauuccguuaaggggcgcuucacagugucuagagacaauagcaaaaacacgcuguaccuccagaugaauagccugcgggccgaggauaccuccgucuauuacugugcucgcgaacuucugauggacuauuacgaucauauuggauacucuccgggccccacauggggccaagggacccucgugacaguuuccagcgccucuaccaagggaccuuccguguuuccccuggcuccuagcucuaaauccacaagcggcgggaccgccgcgcugggaugccucgucaaggacuauuuccccgagccugugacgguguccuggaacucuggcgcccugaccagcgggguccacacauuuccggcuguucuucaguccagcggacuguacucucucuccagcguggugaccguccccucuagcucccugggcacacagaccuauaucuguaaugugaaccauaagccuucuaauacgaaaguugauaagagaguggaacccaaaagcugcgacaagacacacaccuguccucccugcccggccccugagcuucugggcgggcccuccgucuuccucuuuccucccaaacccaaggauacacugaugauuagccggaccccugaggugaccuguguuguggucgacgugucucaugaagauccggaggucaaguucaacugguacguggacggaguugaagugcacaaugcuaaaacaaagccccgcgaggagcaguauaacuccacguacagagucgugagcguucugaccgugcuccaccaagauuggcugaauggcaaagaauauaagugcaaagucucuaacaaggcccuuccugcgcccaucgagaaaacaauuuccaaggccaaggggcagccucgggaaccccagguguacacccugccgccuagccgcgaggaaaugaccaaaaaucaggugucccucacaugucugguuaagggauuuuaccccucugacaucgcugucgagugggagagcaacggccaaccugaaaauaacuauaaaacgacacccccugugcuugacuccgaugggucuuucuuucuguacagcaagcucaccguggacaaauccagauggcagcagggaaacgucuucagcugcucugugaugcaugaggcccugcacaaucauuauacccaaaagucccugagccucucucccggcaag

SEQ ID NO: 43523 - RNA, 1371 nt, Artificial Sequence
  derived and/or modified sequence opt5 from anti-influenza_Chain
auggugauccagagaaacagcauucugcuccugaucauuaucuucgccuccucuauuucuaccugccgguccaaugucaucgacgauaaccuuuuuaagcaaguuuacgacaauauccuggagcaggaguucgcucacgauuuucaggccuaucucucuuaccugagcaaaaacauugaauccaauaacaauaucgacaagguggauaaaaacggcauuaaggugaucaauguccuuucuuucggggcgaaaggagacggcaagaccuaugauaacauugcuuuugaacaggccuggaaugaggccuguagcucccgcacgcccgugcaauucguugugccuaagaacaaaaauuaccugcucaagcagaucaccuuuagcgggccgugcagaucuuccauuagcgucaaaaucuucggaucucuggaggcuuccagcaagaucucugacuauaaagaucggcgccuguggauugccuuugacuccgugcagaaccucguugugggcgggggaggcacaaucaauggcaacgggcaggucugguggcccagcuccuguaagauuaacaagucucugccuugcagagaugcucccaccgcccuuacauucuggaauuguaaaaaccugaaggugaauaaccucaaaagcaagaaugcgcaacagauccauauuaaauuugaauccugcaccaacguggucgccagcaaucugaugaucaacgcuucugccaaguccccuaauacagacggaguucacgugagcaacacccaguacauccagauuucugauacgaucauuggcaccggggacgacuguaucagcauuguguccggaucucaaaauguccaggcuacaaacauuaccugcggccccgggcauggaaucagcaucggcucccuuggcagcgggaauagcgaggccuauguguccaacguuacagugaaugaagcgaaaaucauuggagccgagaacggcguccggaucaagaccuggcaagggggaagcggccaggcuucuaacauuaaguuccugaauguggaaaugcaggauguuaaauacccuaucauuaucgaccagaacuacugugaucgcguggagccgugcauccagcaauuuuccgccguccaggugaagaaugucguguaugagaacauuaaagggacgagcgcuacaaagguugccaucaaauucgacuguuccaccaauuuccccugcgaaggaauuaucauggagaacauuaaucucgugggcgaaucuggcaagccuagcgaggccacaugcaagaacguccacuuuaauaacgcugaacaugugacaccccacuguaccucccuggagaucucugaggaugaagcgcugcucuacaauuau

SEQ ID NO: 43524 - RNA, 1371 nt, Artificial Sequence; identical to SEQ ID NO: 43523
  derived and/or modified sequence opt5 from anti-influenza_Chain

SEQ ID NO: 43525 - RNA, 1380 nt, Artificial Sequence
  derived and/or modified sequence opt5 from anti-influenza_Chain
augaagcuguggcucaacuggaucuuccuggugacccuucugaaugacauucagugcgaggucaaacucguugaaagcggcgggggacuggugcaacccggcgggucccuuagacugucuugugccacaagcggauuuacguucuccgauuacuauaugucuugggugcggcagagcccuggcaaggcucucgaguggcugggguuuacccgcuccagaguccugggauacacaaccgacuauucugccagcgugaaaggccgguucacaaucucccgcgauaacagccagucuauucucuaccugcagaugaacucccuuagaggcgaagacagcgcgaccuauuacugcgcucgggaucgcccgauggacuauugggggcaaggaacaucuguuaccguguccagcgccaagacgacacccccuucugucuacccccuggccccuggcuccgcugcccagaccaauagcauggugacccucgggugucugguuaaaggauacuuucccgagccugugacagucaccuggaacuccggcucucuuagcuccggggugcacacguucccggcugugcugcagagcgaucucuauacacugucuuccagcgucaccguucccucuagcacauggccuuccgaaaccgugaccugcaauguggcccaucccgcgucuagcacaaaggucgacaagaaaaucgugccuagagauuguggaugcaagcccuguauuugcacgguuccggagguguccagcgucuuuaucuucccucccaaaccuaaggacgugcugaccaucacacucacccccaaaguuacauguguggucguggauauuucuaaggacgaucccgagguccaguuuuccugguucguggacgacguugaagugcacaccgcccaaacgcagccucgggaggaacaguuuaauagcacauuccgcucugucuccgagcugccgaucaugcaucaggauuggcuuaacggcaaggaguuuaaaugcagagugaauagcgcugccuuccccgcuccuauugaaaagaccaucuccaaaaccaagggccggcccaaagccccucaaguuuacacaauucccccgccuaaggagcagauggcgaaagacaaggugucucugaccuguaugaucacagauuucuuucccgaagacauuacggucgaguggcaguggaacgggcaaccugccgaaaauuauaagaacacccagcccaucauggauacagacggaagcuacuucguguauuccaaacucaaugugcagaagucuaacugggaggcuggcaauaccuuuacaugcagcguucugcacgaggggcuucauaaccaccacaccgaaaaaucccugagccauucuccuggaaag

SEQ ID NO: 43526 - RNA, 1380 nt, Artificial Sequence; identical to SEQ ID NO: 43525
  derived and/or modified sequence opt5 from anti-influenza_Chain

SEQ ID NO: 43527 - RNA, 1386 nt, Artificial Sequence
  derived and/or modified sequence opt5 from anti-influenza_Chain
auggaguggagcuggaucuuccuguuucuccuguccggcaccgccggggugcacucugaaguccagcuucaacagagcggacccgagcugguuaagccuggcgcuuccgugaaaaugucuugcaaggccagcggguacacauucacguccuaugugaugcauugggucaaacagaagccgggacagggccucgaauggauuggguacaucaaccccuauaaugacggaaccagauacaacgagaaauuucgggugaaggcgacacugaccucugauaagagcuccagcacagcuuauauggaacuuucuucccugaccagcgaggacucugccguuuacuauugugcccgcagaggccucauuacaaccccuacgcuggauuacuggggccaagggaccacacugaccguguccagcgcuaaaacaacgcccccuucugucuacccccucgccccuggauccgcugcccagaccaauagcauggugacacugggcugccuuguuaagggguauuucccggagcccgugaccgucacauggaacuccggaucucugagcuccggcgugcacaccuuuccugcggugcuccagagcgaccuguacacccuuucuuccagcgucacaguucccucuagcacguggccuuccgaaaccgugacauguaauguggcccaucccgcuucuagcaccaaagucgauaagaaaaucgugccgcgggacugcggguguaagccuugcauuuguacaguucccgagguguccagcgucuucaucuuuccucccaagcccaaagaugugcugaccaucacgcucacaccuaagguuaccugcguggucguggacauuucuaaagaugacccggaaguccaguucuccuggguggaugacguugaggugcacaccgcccaaacacagccccgcgaggaacaguuuaacagcaccuucagaucugucuccgagcugccuaucaugcaucaggauuggcugaauggaaaggaauuuaaaugucgggugaacagcgcugccuuccccgcgccuauugagaagacaaucuccaaaacgaagggccgccccaaggccccgcaaguuuauaccauuccucccccuaaagaacagauggcuaaggacaaagugucucucacaugcaugaucaccgacuuuuuccccgaggauauuacagucgaguggcaguggaauggccaaccugccgaaaacuacaagaauacccagcccaucauggacacggaugggagcuauuucguguacuccaaacugaacgugcagaagucuaauugggaggcuggaaacaccuuuacauguagcguucuucacgaaggccugcacaaucaucacaccgagaagucccucagccauucuccggggaaa

SEQ ID NO: 43528 - RNA, 1386 nt, Artificial Sequence
  derived and/or modified sequence opt5 from anti-influenza_Chain
caggugcaacugguccagagcggcgccgagguuaagaaacccggggcuuccgugaaggugucuugcaaaaccagcggauacacauucacggccuauaccauccacugggucagacaggcgccuggccagcggcucgaauggaugggguggauuaacgcuggaaauggccauacaaaguacucccaacgcuuuaaagggagagugaccaucacacgggacaccucugcccgcacaaccuauauggagcugagaagccuuacguccgaagauaccgcccuguacuucugugcucggggaccggagacauauuacuaugacaagaccaacuggcucaauucucaccccgaugaauacuuucagcauuggggccacggcacacagguuaccgugagcuccgccagcacgaaggggccuucugucuucccccuggcuccuuccagcaaaucuacauccggaggcaccgccgcgcuugggugccuggugaaggacuacuuucccgagccuguuacagugagcuggaacucuggagcccucaccuccggcguccauaccuucccggcugugcugcagagcuccgggcuguauucucucagcuccguggucacaguucccucuagcucccugggaacgcaaaccuacauuuguaaugugaaccacaaaccuagcaauacaaagguggauaaaaaggucgagcccaagucuugcgacaaaacccacacauguccucccugcccggccccugaacuucugggcggccccagcguguuucucuucccucccaagcccaaagauacccugaugaucucccgcacgccugagguuacauguguggucguggacguuucucaugaagauccggaggugaaguuuaacugguaugucgacgggguggagguccacaaugcuaaaaccaagcccagagaggaacaguacaacagcaccuaucgggugguuuccgugcuuacaguccugcaucaggauuggcucaauggaaaagaauacaagugcaaggugagcaacaaagcccugccugcgcccauugagaagaccaucucuaaagccaagggccagccucgcgaaccccaaguuuauacacugccgccuuccagagacgagcucacgaaaaaucaggugagccugaccugucuugucaagggguucuaccccucugauaucgcuguggagugggaauccaacggacagccugagaauaacuacaagacaacacccccugugcuggacagcgacggcuccuuuuuccucuauucuaaacugaccguugauaagagccgguggcaacaggggaacgucuuuuccugcucugugaugcacgaagcccuucacaaucauuacacccagaaaagccugucccucagccccggaaag

SEQ ID NO: 43529 - RNA, 1386 nt, Artificial Sequence; identical to SEQ ID NO: 43528
  derived and/or modified sequence opt5 from anti-influenza_Chain

SEQ ID NO: 43530 - RNA, 1386 nt, Artificial Sequence; identical to SEQ ID NO: 43527
  derived and/or modified sequence opt5 from anti-influenza_Chain

SEQ ID NO: 43531 - RNA, 1398 nt, Artificial Sequence
  derived and/or modified sequence opt5 from anti-influenza_Chain
augcugcccagcaccgugcagacacucacgcugcuucugaccuccggcgggguccuccugucucuuuacguuagcgccucccugucuuaucuccuguacagcgacgugcugcucaaguucuccucuacaaaaaccacagcuccuaccaugagccuggagugcacaaacgccuccaaugcgcaaaccgugaaccacagcgcuacgaaggaaaugaccuuuccgcccccugagcccgaauggacauauccuagacuuucuugucagggauccaccuuccagaaagcccugcucaucagcccccaucgguuuggcgagauuaagggaaauucugccccucugaucauucgcgaaccguucgucgcuugcgggcccaaagaguguagacacuuugcccuuacacauuacgcugcccagccuggcggguauuacaacggaacccggaaggaucgcaauaagcugagacaccucguguccguuaaacugggcaagauccccacgguggagaacagcauuuuccauauggcggccuggucuggcuccgcuugccacgacgggcgggaauggacauauaucggagucgauggcccugacaaugaugcccuggugaaaaucaaguacggggaggcuuacaccgacacauaucacagcuacgcccauaacauucuccgcacccaagaauccgcguguaauugcaucggaggcgauuguuaucugaugauuaccgacgggucugccagcggaaucuccaaaugcagauuucuuaagauucgggagggccgcaucauuaaggagauccugcccacaggcagaguugaacacacggaggaauguaccugcggguucgcuagcaacaaaacaaucgagugugccugccgggauaauucuuacaccgcuaagcgcccguuugugaaacucaacgucgaaacagacaccgccgagauuagacugaugugcacgaagacauaucuugauaccccucggcccgacgauggauccaucgccggcccuugugagagcaauggggacaaauggcugggaggcauuaaagggggauucgugcaucagcgcauggcuucuaagaucggcagaugguacagccggaccauguccaagacaaacagaaugggcauggaacucuaugugaaguacgacggggaucccuggaccgacucugaugcgcugacacugagcggagucaugguuuccauugaggaacccggcugguacagcuuuggguucgagaucaaagacaagaaaugcgaugugccuuguaucggaauugaaauggugcacgacggcgggaaggauacguggcacucugccgcuaccgccaucuauugccucaugggcuccggacagcugcuuugggacacagucaccggcguggauauggcccug

SEQ ID NO: 43532 - RNA, 1398 nt, Artificial Sequence; identical to SEQ ID NO: 43531
  derived and/or modified sequence opt5 from anti-influenza_Chain

SEQ ID NO: 43533 - RNA, 1407 nt, Artificial Sequence
  derived and/or modified sequence opt5 from anti-influenza_Chain
auggacuggaccuggagauuccuguuuguggucgccgcugccacaggcguucagagccaagugcagcucgugcaguccggggcggaggucaagaaacccggaucuagcgugaagguuuccugcaaggcuucuggcgggacgcugaacaauuacgccaucagcugggugcggcaggccccuggacaaggccuugaauggaugggagggauuuccccgaucuucggcacccugaacuaugcugagcgcuuucagggcagagucacaauuaccgccgauguguucacaaauaccguuuacauggaacucucuagccugcgguccgaggacacagcuguguauuuuugugcccgcgggugcggauacaacuguuauuacuucgauggcugggggcagggaacccuugucacggugagcucugcguccaccaagggccccagcguguuuccucuggcccccucuuccaaaagcacaucugggggaaccgcugcccucggcugccuggucaaggacuauuucccugaacccguuacaguguccuggaauagcggcgcucugaccuccggggugcacacguuuccugccguccuccagucuagcggacuguacucccuuagcucugugguuacagugccguccagcucucugggcacccaaacauacaucuguaacgucaaucauaagcccagcaacaccaaaguggauaagaaaguugagccuaaguccugcgacaaaacccacacaugucccccuugccccgcgccggagcuccuugggggaccuucuguguuccuguuucccccuaagcccaaggauacgcugaugauuagcagaacccccgaagucacauguguggucguggacguuucccaugaggauccugaagugaaauucaauugguaugucgacggcguggagguucacaacgccaagaccaaaccgcgggaggaacaguacaauagcacauaucgcguggucucugugcucaccgugcugcaucaggauuggcugaacgggaaggaguacaaaugcaagguuuccaauaaagcucuccccgccccuaucgaaaagacgaucagcaaggcuaaaggacagcccagagagccucaagucuauacacugcccccgucucgggacgaacuuaccaagaaccaggugucccugaccugucucgugaaaggcuuuuacccuagcgauauugccgucgagugggaguccaauggccagcccgaaaacaacuauaagacaaccccucccgugcuggacucugacgggagcuucuuccuuuacuccaaacugacaguugauaagucucgcuggcaacagggaaauguguuuagcugcuccgucaugcacgagggccuccacaaccauuacacgcagaaaagccugucucuguccccugggaaa

SEQ ID NO: 43534 - RNA, 1407 nt, Artificial Sequence; identical to SEQ ID NO: 43533
  derived and/or modified sequence opt5 from anti-influenza_Chain

SEQ ID NO: 43535 - RNA, 1407 nt, Artificial Sequence; identical to SEQ ID NO: 43533
  derived and/or modified sequence opt5 from anti-influenza_Chain

SEQ ID NO: 43536 - RNA, 1413 nt, Artificial Sequence
  derived and/or modified sequence opt5 from anti-influenza_Chain
gacggcgugaagccccugauccucagagauugcagcgucgccggguggcugcuuggaaacccuaugugugacgaguucauuaauguuccggaaugguccuacaucguggagaaagcuaaccccgccaaugaucugugcuauccuggcaacuuuaaugacuacgaagaacucaagcaccuccuuucucggauuaaccauuucgagaaaauccagauuauccccaagagcuccuggucugaucacgaggcgagcuccggggugucuagcgcuuguccuuaucaaggaacccccuccuuuuuccgcaaugucguguggcugaucaaaaagaacaauacauacccuacgauuaagagaagcuauaacaauaccaaccaggaggaccuccugauccuguggggcauucaucacucuaaugaugccgccgaacagacaaaacucuaccagaacccgaccacauauaucuccguugggaccagcacacugaaucaacggcuugugcccaagauugcuacccgcucuaaagucaacggacagaacggcagaauggacuuuuucuggacgauccugaagccuaaugaugccauuaacuuugaguccaauggcaacuucaucgcucccgaauacgccuacaaaaucgugaagaagggguauauuccugaggcgccccgggacggacaggccuacguucgcaaagauggcgagugggugcuccugagcaccuuucuuagaucugacaagacacauaccugcccgccuugucccgcuccugaacugcucgggggacccuccgucuuccuguuucccccuaaaccgaaggauacacugaugaucagccggacccccgaggugacgugcguggucguugacgugucccacgaagacccugaggugaaauucaauugguaugucgauggcguggaaguucacaacgccaagacaaaaccccgcgaggagcaguacaauucuaccuauagaguggucagcgugcucacaguucugcaucaagacuggcuuaacgggaaggaauacaaguguaaaguguccaauaaggcucugccugcccccauugagaaaaccaucagcaaggcgaaaggacagccgcgggaaccucaggucuauacccugcccccuucucgcgaggaaaugacaaagaaccaggugucccugacgugccuugucaagggcuuuuaccccagcgauauugccguggagugggagucuaauggccaaccugaaaacaauuacaaaaccacacccccgguucuggacagcgauggguccuucuuccucuauucuaagcugaccguggacaaaagcagauggcagcagggaaacgucuuuuccuguagcgugaugcacgaggcucugcauaaucacuacacacaaaagucucucucccugagcccuggcaaa

SEQ ID NO: 43537 - RNA, 1413 nt, Artificial Sequence; identical to SEQ ID NO: 43536
  derived and/or modified sequence opt5 from anti-influenza_Chain

SEQ ID NO: 43538 - RNA, 1416 nt, Artificial Sequence
  derived and/or modified sequence opt5 from anti-influenza_Chain
auggacuggaccuggagauuccuguuuguggucgccgcugccacaggcguucagugccaagugcagcucgugcagagcggggcggaggucaagaugcccggauccucugugaaaguuagcuguaagacguccggcguguucuuuucuagccacgcuaucuccuggguccggcaggccccugggcaaggacuggaauggaugggcgggauuucuccgauguucggaaccacacauuacgcccagaaauuucagggccgcgugaccaucacagcugaucagagcaccacaaccgccuauauggagcuuacgucccugaccagcgaagacacagcuguuuacuauugcgccagagauggcgcggggucuuacuauccccucaacugguucgacccuuggggacaaggcacccuggugacagucuccagcgccucuaccaaggggcccuccguguuuccucuugcucccagcucuaaauccacgagcggaggcacagccgcucuggggugucucgugaaggauuacuucccugagccggucaccguuuccuggaacucuggagcccugacaagcggcgugcacaccuuucccgcggugcugcaguccagcggccucuauucucuguccagcgucgugaccguuccuucuagcucccuugggacacagacguacauuugcaaugugaaucauaagcccucuaacaccaaagucgacaagcggguggaaccuaaaagcugugauaagacacacaccugucccccgugcccugcccccgagcugcucggaggcccuuccguuuuccuguuuccucccaaacccaaggacacacuuaugaucagccgcaccccggaggugacgugcgucguggucgaugugucucaugaagaccccgagguuaaguucaauugguacguggauggggucgaagugcacaacgcuaaaacaaagccuagagaggagcaguauaauuccaccuaccggguugugagcguccugaccgugcuccaccaagacuggcugaacggaaaagaauauaaguguaaagugucuaauaaggcccugcccgcuccuauugagaaaacaaucuccaaggccaagggccagccccgcgaaccgcagguuuacacccucccucccagcagagaugagcugacaaagaaccaagucucccuuacgugccuggugaagggguuuuauccuucugacaucgccguggaaugggagagcaauggacagcccgagaacaauuacaaaaccacaccucccguccucgacuccgauggcucuuucuuccuguauagcaaacuuaccguggacaaaucccgguggcagcagggcaacguuuuuagcuguucugugaugcaugaagggcugcacaaucauuacacacaaaagucccucagccugucuccgggaaag

SEQ ID NO: 43539 - RNA, 1416 nt, Artificial Sequence; identical to SEQ ID NO: 43538
  derived and/or modified sequence opt5 from anti-influenza_Chain

SEQ ID NO: 43540 - RNA, 1416 nt, Artificial Sequence; identical to SEQ ID NO: 43538
  derived and/or modified sequence opt5 from anti-influenza_Chain

SEQ ID NO: 43541 - RNA, 1419 nt, Artificial Sequence
  derived and/or modified sequence opt5 from anti-influenza_Chain
augaccgagagcgccaugacauccagagcuggccgggggcgcggagccgaccugguggcggcugucguucagggccacgccgccgcuucugaugccgcuggggaccucagcuuccccgauggauuuaucuggggcgccgcgacggccgcuuaccaaauugaaggggccuggagagaggacggacggggccugugggauguguucucccauaccccuggcaagguggcuucugggcacacaggagacaucgccugcgaucauuaucaccgcuacgcggacgaugucagacuuauggccggccugggggaccggguguaucgcuuuagcguugcuuggccgagaauugugcccgauggauccggcccugucaaccccgccgggcucgacuucuacgaucggcugguggacgaacuucugggacauggcaucaccccuuaucccacacucuaccacugggaccugccucagacccuggaggaucgcggcgggugggcugccagagacacagccuaucgguuugcugaauacgcgcucgccguucaccgcagacugggagaucgggugcgcuguuggauuacccuuaaugagccgugggucgcugccuuccuggccacgcauagaggcgcucccggggccgcggacgugccucgguuuagagcugugcaccaucuccugcuuggacacggccuggggcuccgccugcggucugccggagccggccagcugggccucacccugagccuuucccccgucaucgaggcuagaccugggguucgcggaggcgggcggagaguggaugcccuggcuaaccgccaguuccucgaccccgcccugcggggaagauacccggaagaggugcuuaaaaucauggcgggccacgcccgccuggggcauccuggccgggaucucgaaacaauucaccaacccgucgaccugcugggagugaauuauuacagccauguuagacucgcugccgagggcgagccugcuaaccgccugcccgggucugaaggaauccgguuugagagacccaccgccgugacagcguggccuggcgaucggccggacgggcuucgcacccugcuccugagacuuucccgggauuaucccggagucggccugauuaucacggaaaauggggccgcuuucgacgacagagccgauggcgaccgcgugcacgauccugagcggauuagauaccucacagcuacccugcgcgccguucaugacgccaucauggcuggagcggaucugagaggcuauuuuguguggagcguccucgacaacuucgaaugggccuacggguaucacaagcggggaauuguguacgucgauuacacaaccaugcgcagaaucccccgggagucugcucugugguaucgcgacgugguuagacggaauggccuucgcaacggggag

SEQ ID NO: 43542 - RNA, 1419 nt, Artificial Sequence; identical to SEQ ID NO: 43541
  derived and/or modified sequence opt5 from anti-influenza_Chain

SEQ ID NO: 43543 - RNA, 1422 nt, Artificial Sequence
  derived and/or modified sequence opt5 from anti-influenza_Chain
cugagcagaaucaaccacuucgagaagauucagaucauucccaaauccucuuggagcgaccaugaagccuccucuggcgugagcuccgcuugcccuuaccaagggaccccgucuuucuuccggaaugucguuuggcucaucaagaaaaacaauacauaucccacgauuaagcgcagcuacaacaauaccaaccaggaggaucugcuuauccuguggggaauccaccauuccaaugacgccgcggaacagacaaaacucuaucagaacccuaccacauacauuagcgugggcaccucuacacugaaucaaagacuugugcccaagaucgcuacccgguccaaggucaacgggcagaauggacgcauggacuuuuucuggacgauucugaaaccuaacgaugccaucaauuuugagagcaacggcaauuucauugcccccgaauaugcuuacaagaucgugaaaaagggggauucugccauuguuaaauccgagguggaguauggaaacuguaacaccaagugccagacaccuaucggcgcuaucaauagcucuaugccguuucacaacauucauccccucaccaucggcgaauguccuaaguacgucaaauccaauaagcuggugcuggccacagggcucagaaacagcccccugggauacauuccugaggcgccccgggacggccaggccuauguucgcaaagauggggaaugggugcuucuguccaccuuccucagaucugacaagacgcacacaugcccgccuugucccgcuccugagcugcuuggaggccccagcgucuuucuguuucccccuaaaccgaaggauacccucaugaucucccggacacccgaggugaccugcguggucguugacgugagccacgaagauccugaggugaaauuuaauugguacgucgacgggguggaaguucauaacgccaagaccaagccccgcgaggaacaauauaauucuacauacagaguggucuccgugcugacgguucugcaccaggauuggcucaacggaaaagaguauaaguguaaagugagcaauaaggcucugccugcccccauugagaaaaccaucucuaaggcgaagggccagccgcgggaaccucaggucuacacacuucccccuagccgcgaggaaaugaccaaaaaccaagugucccugacaugccucgucaagggcuucuaucccucugacaucgccguggagugggaaagcaaugggcagccugagaacaauuacaaaaccacgcccccgguucuggacuccgauggcagcuuuuuccuuuacucuaagcugacaguggacaaauccagauggcagcaaggaaacgucuucagcuguucugugaugcaugaggcucuccacaaucacuauacccagaagucccugagccuguccccugggaag

SEQ ID NO: 43544 - RNA, 1422 nt, Artificial Sequence; identical to SEQ ID NO: 43543
  derived and/or modified sequence opt5 from anti-influenza_Chain

SEQ ID NO: 43545 - RNA, 1428 nt, Artificial Sequence
  derived and/or modified sequence opt5 from anti-influenza_Chain
auggaguucggccugagcuggguguuucucgucgcccugcuuagagggguucagugccaggugcagcugguggaauccggaggcggggucgugcagcccggacggucucuccgccugagcugugcugccuccggcuucaccuuuucuagauucgggauccacuggguucggcaggcgccuggaaagggccuugaguggauggcugugauuugguacgacggcagcaacaaauuuuaugccgauuccgucaaggggcgcuucacaaucucuagagacaauagcaaaaacacgguguaccugcaaaugaauagccuccgggccgaagauaccgcuguuuauuacugcgccaaggacagccgcggauauuguucuuccauuaucugcuuugagggcgggcuggauaacuggggacagggcacacuggugaccgucagcucugcuuccacaaaagggccgagcguguucccccucgccccuucuuccaagagcaccuccggaggcacagcggcccugggcugucuugugaaggacuacuuucccgaaccugucaccguuucuuggaauagcggggcucugacguccggagugcauaccuuccccgccgugcuccagagcucuggccuguauucccuuagcucugucgugacaguuccuagcuccucucuggggacccagacauacauuugcaacgugaaucacaaaccgagcaacaccaaggucgauaaaagaguggagcccaaguccugugacaaaacgcauacaugcccucccuguccugcucccgagcuccugggaggcccgagcguuuuucuguucccucccaagccuaaggauacccucaugaucucucggacacccgaagugaccugcgucguggucgacgugucccacgaggaucccgaaguuaaauuuaauugguacguggacggggucgaggugcauaacgccaagaccaaaccucgcgaggaacaauauaauagcacauacagaguugugucuguccugacggugcuucaccaggauuggcugaacggaaaggaguauaaauguaagguguccaauaaagcgcucccggcccccaucgaaaagaccauuagcaaggcuaaaggccagccucgggagccccagguuuacacacugccucccucccgcgacgaacuuaccaagaaccaagucucucugacaugccucgugaaaggcuucuauccgagcgacaucgccguggagugggaguccaaugggcagccugaaaacaacuacaagaccacgcccccuguccuggauucugacggauccuucuuucuguauuccaaacucacaguggauaagagcagauggcagcaaggcaauguuuucucuugcuccgugaugcacgaggggcugcauaaccacuacacccaaaagagccuuucucugucccccggaaaa

SEQ ID NO: 43546 - RNA, 1428 nt, Artificial Sequence; identical to SEQ ID NO: 43545
  derived and/or modified sequence opt5 from anti-influenza_Chain

SEQ ID NO: 43547 - RNA, 1428 nt, Artificial Sequence; identical to SEQ ID NO: 43545
  derived and/or modified sequence opt5 from anti-influenza_Chain

SEQ ID NO: 43548 - RNA, 1440 nt, Artificial Sequence
  derived and/or modified sequence opt5 from anti-influenza_Chain
augcccagcgugaagaucggcauuaucggggccggauccgcugucuucucucugagacucguuagcgaccugugcaaaaccccuggccuuuccgggucuacagugacgcugauggauauugacgaggaacggcucgaugccauccugaccauugcgaagaaauacguggaggaagucggagcugaccuuaaguuugagaaaacaaugaaccuggaugacgugaucaucgaugccgacuucguuauuaauaccgccauggugggcgggcacacauaucucgaaaagguccgccagaucggagagaaguacggcuauuacagaggcauugaugcucaagaguuuaacauggugagcgacuauuacaccuucuccaauuauaaccagcugaaauacuuuguugauaucgcccggaagauugaaaaacugucuccgaaggcuugguaccuccaggccgcgaaucccaucuucgaggggacaacccuggugacgcgcaccgucccuauuaaagccgugggauuuugucauggccacuauggggugauggaaaucgucgagaaacuuggacuggaggaagagaagguugacuggcaaguggcuggcgugaaccaugggaucuggcucaauagauuccgguacaacggaggcaaugccuauccccugcuugauaaguggauugaagaaaagagcaaagacuggaagccugaaaaccccuuuaaugaccagcuguccccugcugccaucgauauguaccgcuucuauggcgucaugccgauuggggacacagugagaaacagcucuuggcgguaccaccgcgaucucgagaccaaaaagaaaugguauggagagcccuggggcggggcggacuccgaaaucggauggaagugguaccaggauacacugggcaagguuaccgagauuacgaaaaagguggccaaauuuaucaaggaaaauccuagcgucagacugucugaccucggguccgugcugggaaaagaucuuagcgagaagcaguucguucuggaaguggagaagauccucgaccccgagcggaaaucuggcgaacagcauauuccuuuuaucgaugcucugcuuaacgacaauaaggcccgcuucgucgugaacauucccaacaaaggcaucauucacgggaucgaugacgacgucgugguugaggugccggcucuggucgauaagaauggaauccacccugagaaaauugagcccccucuccccgacagagugguuaaguacuaucugcggccccgcaucaugagaauggaaauggcccuggaggccuuccucacaggcgauauucggaucauuaaggagcugcuuuacagagacccucgcaccaaauccgaugaacaaguggagaaggucaucgaagagauucuggcucucccggagaacgaagagaugcggaaacauuaucugaagaga

SEQ ID NO: 43549 - RNA, 1440 nt, Artificial Sequence; identical to SEQ ID NO: 43548
  derived and/or modified sequence opt5 from anti-influenza_Chain

SEQ ID NO: 43550 - RNA, 1443 nt, Artificial Sequence
  derived and/or modified sequence opt5 from anti-influenza_Chain
augaaguuccccaaagacuuuaugaucggcuacagcuccucuccuuuccaguuugaggccgggauuccgggaagcgaagaucccaacuccgacugguggguguggguccacgauccugagaauaccgcugccggccugguuucuggggacuuccccgaaaacggaccuggcuauuggaaucucaaccaaaaugaucaugaccuggcggagaaacuuggggugaacacaaucagagugggagucgaauggagccggauuuuucccaagccuacguucaaugugaagguuccgguggagcgcgaugagaacggcuccaucguccacguggacguugaugacaaagcuguggaaagacuggaugagcucgccaauaaggaagccgucaaccauuacguggagauguauaaggacuggguggagcggggccgcaaacugauucuuaaucuguaccacuggccccucccucuguggcugcauaaccccaucauggucagacggauggggccugaucgcgcucccucuggauggcucaaugaagagagcguuguggaauuugccaaguaugcugccuacaucgcguggaaaaugggcgagcugccggugaugugguccaccaugaacgaaccuaaugucguguaugagcagggguacauguucguuaagggaggcuuucccccuggguaccuuagccuggaggccgcugacaaagccagacggaacaugauucaggcucacgcccgcgcguaugacaacaucaagagauucucuaagaaacccgugggacucauuuacgccuuucagugguucgaacugcuugagggccccgcugaagucuuugauaaguucaaauccagcaagcuguauuacuucacagacaucgugucuaaaggcuccagcauuaucaauguugaguaucggcgcgaucucgccaacagacuggacuggcugggggugaauuacuauucucggcucgucuacaagauuguggaugacaaaccuaucauccugcacggauacggcuuucuuugcacccccgggggaauuuccccggcugaaaacccuuguagcgauuucggcugggaggucuaucccgaggggcuguaccuccugcuuaaggaacuguauaaucgcuacggaguggaccucaucguuacagagaacggcguguccgauucuagagacgcccugcggccugccuaucuggucagccauguguacuccguuuggaaggcugcgaaugaaggcauucccgugaaaggguaucuccacuggagccugaccgauaacuacgagugggcccaaggauuuagacagaaguucggccuugucaugguggacuuuaaaacaaagaaacgcuaccugcggccgucugcucucguguucagagaaaucgccacccauaaugggauuccugacgagcugcagcaccuuacgcugauccag

SEQ ID NO: 43551 - RNA, 1443 nt, Artificial Sequence; identical to SEQ ID NO: 43550
  derived and/or modified sequence opt5 from anti-influenza_Chain

SEQ ID NO: 43552 - RNA, 1464 nt, Artificial Sequence
  derived and/or modified sequence opt5 from anti-influenza_Chain
cacgcccaggacauccuggagaagacccauaacggcaaacucugcgaucuggacggggugaagccccuuauucugagagauuguagcgucgcuggauggcuccugggcaauccuaugugcgacgaguucaucaacguuccggaaugguccuacauuguggaaaaagccaaucccgcgaacgaucuuuguuauccugggaauuuuaacgacuacgaggaacugaagcaccuccugucucggaucaaucauuucgagaaaauucaaaucauccccaagagcuccuggucugaucacgaggcuagcuccggagugucuagcgccugcccuuaucagggcacacccuccuuuuuccgcaacgucguguggcugauuaagaaaaauaacacguacccuaccaucaagagaagcuauaauaacacaaaucaggaagaccuccugauucuuugggggauccaucacucuaacgaugccgcugagcagaccaaacuguaccaaaauccgacaaccuauauuuccguuggaacaagcacccucaaccagcggcuggugcccaagaucgccacgcgcucuaaagucaacggccagaauggcagaauggacuuuuucuggaccauucuuaagccuaacgaugcuaucaauuuugaauccaacgggaauuucaucgcccccgaguacgcguacaagauugugaaaaagggauauaucccugaggcuccccgggacggccaggccuacguucgcaaagauggggaaugggugcugcucagcacauuucugagaucugacaagacccacacauguccgccuugccccgccccugagcugcucggaggccccuccgucuuccuguuucccccuaaaccgaaggacacccuuaugauuagccggacgcccgaagugacauguguggucguugaugugucccaugaggacccugaagugaaauucaacugguaugucgaugggguggagguucacaaugcuaagaccaagccccgcgaggaacaauacaacucuacauauagaguggucagcgugcugaccguucuccaucaggacuggcugaauggaaaagaguacaagugcaaaguguccaacaaggcccuuccugcgcccaucgagaaaaccauuagcaaggccaagggccagccgcgggaaccucaggucuauacacugcccccuucucgcgaagagaugacgaaaaaucaagugucccucaccugucuggucaagggcuuuuaccccagcgauaucgcuguggagugggaaucuaacgggcagccugagaauaacuacaaaacaacacccccgguucuggacagcgauggauccuucuuccucuauucuaagcugaccguggacaaaagcagauggcagcaaggcaaugucuuuuccugcagcgugaugcacgaagcccuucacaaccauuacacccagaagucucugucccucagcccugggaag

SEQ ID NO: 43553 - RNA, 1464 nt, Artificial Sequence; identical to SEQ ID NO: 43552
  derived and/or modified sequence opt5 from anti-influenza_Chain

SEQ ID NO: 43554 - RNA, 1473 nt, Artificial Sequence
  derived and/or modified sequence opt5 from anti-influenza_Chain
augcugagcuuccccaagggcuuuaaauucggguggucccagucuggauuucaaagcgagaugggcaccccuggguccgaagacccgaacucugauuggcacguguggguccaugacagagagaauaucguuagccaggugguguccggagaucuccccgaaaacggcccuggguacuggggaaauuauaagcgguuccacgacgaggccgagaaaauuggccugaacgcuguccgcaucaauguggaguggucuagaauuuuuccccggccucuucccaagccugagaugcagacaggcacggauaaagaaaacagcccgguuaucuccguggaccugaaugagagcaagcuccgcgaaauggauaacuacgccaaucaugaggcgcugucucacuauagacagauucuugaggaccugcggaaccgcggguuccauaucguccucaauauguaccacuggacccugcccaucuggcugcacgauccuauuagagugcggcgcggagacuuuacaggccccaccggguggcucaacuccagaacaguuuaugaauuugcucgguuuagcgccuacguggccuggaagcuggaugaccuugcuucugaguaugccaccaugaaugaaccuaacgucguguggggagcuggcuacgccuucccccgcgcgggguuuccgccuaauuaccuguccuucagacucagcgagaucgccaaauggaacauuauccaagcucaugcccgggcuuaugaugccauuaagucuguguccaaaaagagcgucggaaucauuuacgcgaacacauccuauuacccccugcgcccucaggacaaugaagccguugagaucgcugagagacuuaaccgguggucuuucuucgacagcaucauuaaaggcgaaaucaccuccgagggccagaaugugagagaagaucugcgcaaccggcucgacuggauuggggugaauuauuacacgagaaccgucgugacaaaggccgagagcggauaucugacccugcccggcuacggggaucgcugcgaacggaacucucucucccuggcuaaucuucccacaagcgacuucggaugggaguuuuucccugagggccuguacgauguucuccugaaguauuggaacagauacgggcuuccgcuguaugugauggaaaauggaaucgccgacgaugccgacuaccagcgccccuauuaccucgucucucacauuuaucaagugcaucgggcucugaacgagggcguugaugugagaggcuaccugcacuggagccucgcggacaauuacgaaugguccucuggguuuagcaugcgcuucggacugcuuaaagucgauuaucugaccaagcggcucuacuggagaccuuccgcccugguguaucgcgagaucacgcggagcaacggcauccccgaagaacuugagcaccugaauagagucccucccauuaaaccgcuccggcau

SEQ ID NO: 43555 - RNA, 1473 nt, Artificial Sequence; identical to SEQ ID NO: 43554
  derived and/or modified sequence opt5 from anti-influenza_Chain

SEQ ID NO: 43556 - RNA, 1494 nt, Artificial Sequence
  derived and/or modified sequence opt5 from anti-influenza_Chain
auggccagccagggcaccaagagauccuacgagcaaauggaaacagacggggagcggcagaacgcuacggaaauccgcgccucugugggaaaaaugauuggcgggaucggaagauucuauauucagaugugcaccgagcugaagcucagcgauuacgaaggccggcugauccaaaauucccuuacaauugagcgcaugguccugucugcguuugacgagagacggaacaaauaucucgaagaacaccccagcgcugggaaggauccuaaaaagaccggaggcccgaucuaccgcagaguuaauggcaaguggaugcgggaacugauccuuuaugacaaagaggagauucgcagaaucuggcggcaggccaacaauggggaugacgccacagcuggacugacccauaugaugauuuggcacuccaaccucaaugaugccacauaccagcgcaccagagcucuggugcggacgggcauggacccccgcauguguucucugaugcaggggagcacccucccuagacgguccggagccgcgggcgccgcugugaagggggucggaacaauggugauggaacugguuagaaugaucaaacgcggcauuaacgaucggaauuucuggagaggcgagaacgggcgcaagacccggaucgccuaugaaagaaugugcaauauucuuaaaggaaaguuucagacagcugcccaaaaggcgaugauggaccaggugcgcgagagccgggaucccggcaacgccgaguucgaggaccugaccuuucucgcuagaucugcccugauccuucgcggguccgucgcucauaaaagcugucugccugccugcguguacggacccgccguugcuucuggcuacgauuucgagcgggaaggguauucccucgugggaaucgacccuuuuagacugcugcagaauagccaggucuacucucucauucgcccgaacgagaaucccgcgcacaagucccaacugguguggauggccugucauagcgcugccuucgaagaccuucgggugcuguccuuuaucaaaggcacgaaggucguuccuagaggcaaacucucuacacgcggggugcagauugccagcaacgagaacauggaaaccauggaguccagcacacuggagcuucggucuagauauugggcuauccggaccagauccggaggcaauaccaaccagcaacgcgccagcgcggggcagauuucuauccagcccacauucagcgugcagcggaaucugccuuuugauagaacgaccgucauggcugccuucacaggaaacaccgaaggccgcacauccgacaugagaaccgagaucauucggaugauggaaucugcccgccccgaggaugugagcuuucaagggagaggcguuuucgaacucuccgacgagaaggcugccagcccgaucgugccuucuuucgauauguccaaugagggaagcuacuuuuucggcgacaacgcugaagaguaugauaau

SEQ ID NO: 43557 - RNA, 1494 nt, Artificial Sequence
  derived and/or modified sequence opt5 from anti-influenza_Chain
auggccagccagggcaccaagagauccuacgagcaaauggaaacagacggggagcggcagaacgcuacggaaauccgcgccucugugggaaaaaugauugauggcaucgggagauucuauauucagaugugcaccgagcugaagcucagcgacuacgaaggacggcugauccaaaauucccuuacaauugagcgcaugguccugucugcguuugaugagagacggaacaaauaucucgaggaacaccccagcgcuggcaaggacccuaaaaagaccgggggaccgaucuacaagcgcguugauggcaaauggaugagagaacuggugcuuuaugacaaggaggagauccggcgcauuuggagacaggccaauaacggcgaugacgccacagcugggcugacccauaugaugaucuggcacuccaaucucaacgauacaaccuaccagcggacgcgcgcccuggugagaaccggaauggacccccggauguguucucugaugcagggcagcacacucccucgcagauccggggcugccggagcggccgucaaaggcguggggaccaugguuauggaacugauucggaugaucaagagaggaauuaaugaucgcaacuucuggcggggcgagaauggcagaaaaacacgcagcgcuuaugaacggaugugcaacauccuuaaggggaaguuucagaccgccgcucaaagagccaugauggaccaggugcgcgagucucggaaucccggaaacgcggaaauugaggaucugaucuuccucgccagauccgcucugauccuucgcggcagcgucgcccauaaaucuugucugccugcuugcguguacgggcccgccauugccuccggauacaauuuugagaaggaaggcuauagccucguugggaucgacccuuucaaacugcugcagaacucucagguguacucccucauucggccgaaugagaaccccgcucacaagagccaacuggucuggauggcguguaacuccgccgcuuuugaagaccuuagagugcugucuuucauccgcggaacgaaagugagcccucggggcaagcucuccacaagaggcguccagauugccagcaaugagaacauggauaccauggaaucuuccacacuggagcuucggagccgcuauugggccaucagaacccggucugggggaaauaccaaccagcaaagagcuagcgccggccagaucuccguucagcccgcguuuucugugcagcgcaaucugccuuucgacaaacccacaauuauggcugccuuuacggggaacaccgagggacggacaagcgauaugagagccgaaaucauucgcaugauggagggcgcuaagccggaagagauguccuuccaagggagaggcguguuugaacucagcgacgagaaggccaccaauccuaucguccccucuuucgauauguccaacgagggaagcuacuucuuuggcgacaaugcugaagaguaugauaac

SEQ ID NO: 43558 - RNA, 1494 nt, Artificial Sequence
  derived and/or modified sequence opt5 from anti-influenza_Chain
auggccagccagggcaccaagagauccuacgagcaaauggaaacagggggagagcggcagaacgcuacggaaauccgcgccucugugggcagaauggucgggggaauuggccgguucuauguucagaugugcaccgagcugaaacucagcgaccaggaagggcgccugauccaaaauuccauuacaaucgagagaauggugcuuucugcguuugaugagcggcgcaacagauaccuggaggaacaccccagcgcuggaaaggacccuaaaaagaccggcggcccgauuuaucggcgcagagaugggaaaugggugcgggaacucauccuguacgacaaggaggagauccgcagaauuuggcggcaggccaauaacggagaagaugccacagcuggccuuacccauaugaugaucuggcacuccaaucugaacgacgccacauaucagcgcaccagagcucucguccggacggggauggaucccagaauguguucucugaugcagggaagcacccugccucgccgguccggcgccgcgggggccgcuauuaagggagugggcacaaugguuauggagcucaucagaaugauuaaacgcggcaucaaugaccggaacuucuggagaggggauaauggacgccggaccagaauugccuacgaacgcaugugcaacauccugaagggcaaauuucaaacagcugcccagcgggcgaugauggaccaggugagagagagccgcaaucccgggaacgccgaaaucgaggaucuuauuuuccuggcucggucugcccucauccugagaggauccgucgcucauaagagcugucuuccugccugcguguauggccuggccguugcuucuggguacgacuuugagcgggaaggauacucccucgugggcauugaucccuuccgccugcugcagaauagccaagucuuuucucucaucagaccuaacgagaauccggcgcacaaaucccagcugguguggauggccugucauagcgcugccuucgaagaccuucggguguccucuuuuauuagaggcacccgcgucaucccccgggggcagcugagcacgagaggaguucaaaucgccuccaacgagaacguggaagcuauggacagcucuacacucgagcugcgcuccagauauugggccauucggacccgcagcggcgggaauacaaaccagcagagagcgucugcuggacagaucagcgugcaaccuaccuucuccguccagcggaaucuucccuuugagcgcccuaccauuauggccgccuucaagggcaacacagaagggagaacgucugauaugcggaccgagaucauucgcaugauggaaagcgcuagacccgaggacguguccuuucagggccggggaguuuucgaacugagcgaugagaaggccacaaauccgaucgugccuucuuucgacauguccaacgagggcagcuacuuuuucggggauaaugcugaagaguaugacaac

SEQ ID NO: 43559 - RNA, 1494 nt, Artificial Sequence; identical to SEQ ID NO: 43556
  derived and/or modified sequence opt5 from anti-influenza_Chain

SEQ ID NO: 43560 - RNA, 1494 nt, Artificial Sequence; identical to SEQ ID NO: 43557
  derived and/or modified sequence opt5 from anti-influenza_Chain

SEQ ID NO: 43561 - RNA, 1494 nt, Artificial Sequence; identical to SEQ ID NO: 43558
  derived and/or modified sequence opt5 from anti-influenza_Chain

SEQ ID NO: 43562 - RNA, 1530 nt, Artificial Sequence
  derived and/or modified sequence opt5 from anti-influenza_Chain
auguuccccgagaaguuucuguggggcguggcccagagcggguuccaauuugaaaugggagacaaacucagacggaacaucgauaccaauacagacugguggcacuggguccgcgauaagacgaacauugagaaaggccugguuuccggggaccuuccugaagagggaaucaauaacuacgaacuguaugagaaggaucaugagauugcuagaaaacucggccugaaugccuaccggaucgggauugaauggucucgcaucuucccguggcccaccacauuuaucgacguggauuauagcuacaacgaguccuauaaucuuauugaagacgugaagaucaccaaggauacacuggaggagcucgacgaaauugcgaacaaaagagaggucgcuuacuaucggucugugaucaauagccugcgcuccaagggauucaaaguuauugugaaccugaaucacuuuacccucccuuacuggcugcaugaucccaucgaagccagagagcgggcccuuacaaacaagcgcaauggcugggucaacccuagaaccgugauugaauuugcuaaauacgccgcuuauaucgccuacaaguuuggcgacaucguugauauguggucuacguucaaugagcccaugguggucguggagcugggguaucucgcgccuuacagcggauuuccgcccggcgugcugaacccugaagccgcuaaacuugccauucugcacaugaucaacgcucaugcccucgcguaucggcagauuaagaaguucgacaccgagaaagccgacaaggauuccaaagaacccgcugaggucgggaucauuuacaauaacaucggaguugccuauccuaaggaccccaaugauagcaaagacgugaaggcugccgaaaacgauaauuucuuccacucuggccuguucuuugaggccauccacaaggggaaacugaacauugaguucgacggagaaacauuuaucgaugcuccguaccucaagggcaaugacuggauuggcgugaacuacuauacccgcgaggucgugacauaccaggaaccuauguuccccuccaucccucugauuaccuuuaaagggguucagggauauggcuacgcgugcagacccgggacgcuuagcaaggaugaccggcccgugucugauaucggaugggagcuguauccugaaggcauguacgacuccaucgucgaggcccauaaauauggggugccgguuuacgugacagagaauggaauugcugacagcaaggauauccuccgccccuacuauauugccucucacaucaagaugaccgaaaaagccuucgaggacggcuacgaagucaagggcuauuuucauugggcucugacagauaacuucgagugggcccuuggguuuagaaugcgguucggacuguacgaggugaaucucauuaccaaagaaagaaucccucgcgagaaguccgucagcauuuuucgggaaaucguggcgaacaauggcguuaccaaaaagaucgaggaggaacugcugagaggg

SEQ ID NO: 43563 - RNA, 1530 nt, Artificial Sequence; identical to SEQ ID NO: 43562
  derived and/or modified sequence opt5 from anti-influenza_Chain

SEQ ID NO: 43564 - RNA, 1536 nt, Artificial Sequence
  derived and/or modified sequence opt5 from anti-influenza_Chain
augaagagaaaagugaagaaaauggccgcuauggccaccagcaucauuauggcgaucaugauuauccugcacuccauucccguccucgcuggccggaucaucuacgacaacgagacagggacgcauggaggcuaugauuacgaacuguggaaggacuaugggaauaccauuauggagcuuaacgauggaggcacauucucuugccaguggagcaauaucgggaacgcccuguuucgcaaaggaagaaaguucaauuccgacaagaccuaccaagaacucggcgauauuguuguggaguauggcugugacuacaacccuaaugggaacucuuaucugugcguguacggauggacacggaauccgcuugucgaauacuauaucguggagagcuggggcuccuggagacccccuggggccacccccaaaggaacaauuacccaguggauggcuggcacguacgagaucuaugaaaccacacgcguuaaccagccuucuauugaugggaccgccacauuucagcaauacuggagcgugcggaccuccaagcgcacgagcggaacaaucucugucaccgagcacuucaaacagugggaaagaaugggcaugcggaugggcaagauguaugagguggcucugacaguugagggguaccaguccagcggauaugccaauguguacaaaaacgaaauccgcauuggcgcgaaucccaccccugccccgucucagucccccaucagacgggacgcuuuuagcauuaucgaggccgaagaguacaacucuaccaauuccagcacacuccaagucauugggacgccuaacaacggacgcggcaucggguauaucgaaaauggaaacaccgugacauacuccaauauugauuucggcucuggcgcuaccggguuuagcgccacaguggcgaccgaggucaacacguccauccagauuagaagcgacucucccacaggaacccugcugggcacccucuauguuuccagcacagggucuuggaauaccuaccagacagugagcacgaacaucuccaagauuaccggagugcaugauaucguccugguguucucuggcccuguuaauguggacaacuuuaucuucagccgguccagccccgucccggccccuggggauaauacacgcgacgcuuauucuauuauccaggccgaggacuacgauuccagcuauggccccaaccuucaaaucuuuucucugccuggaggcggguccgcuauuggauacauugaaaauggcuacagcaccacauauaagaacaucgacuucggggauggagccaccuccgugacggccagaguugcuacccagaaugcgacaaccauucaggugcggcucggcucucccagcgggacacugcuuggcaccaucuacgucggauccacgggcucuuuugacacauauagagaugugagcgccaccaucuccaacacagcuggggucaaagacauugugcugguuuucagcggacccgugaaugucgauugguucguguuuucuaaguccggcacc

SEQ ID NO: 43565 - RNA, 1536 nt, Artificial Sequence; identical to SEQ ID NO: 43564
  derived and/or modified sequence opt5 from anti-influenza_Chain

SEQ ID NO: 43566 - RNA, 1539 nt, Artificial Sequence
  derived and/or modified sequence opt5 from anti-influenza_Chain
aucugcauuggcuaccacgccaacaauagcaccgaacagguggacacaaucauggaaaagaacgucacgguuacccaugcucaagauauucuggagaaaacacacaaugggaagcucugugaccuggauggagugaaaccccuuauccugagagacugcuccguggccggcuggcuccuggggaacccuaugugugaugaguucauuaaugucccggaguggucuuauaucguggaaaaggcgaaccccgcuaaugaccuuugcuacccuggaaacuuuaaugauuaugaggagcugaaacaucuccugagccggaucaaccacuucgaaaagauucagaucauucccaaguccucuuggagcgaccaugaggccuccucuggcguuagcuccgccuguccuuaccaggggacccccagcuuuuuccgcaauguggucuggcugaucaaaaagaacaauacauauccuaccauuaaaagaucuuacaacaauacaaaccaggaagaucuccugauccuuuggggcauucaccacuccaacgacgcugccgagcaaaccaagcuguaucagaauccgacgaccuacaucagcgugggaacaucuacccucaaccagcggcugguucccaaaaucgcuacacgcuccaaggugaauggccagaacgggagaauggacuuuuucuggaccauucuuaagccuaaugaugccaucaacuuugagagcaauggaaacuucauugcgcccgaauacgccuauaaaaucgucaagaaaggcuacauuccugaggcuccccgggaugggcaagccuaugugcgcaaggacggagaaugggugcugcucucuacguuucugagauccgacaaaacacauaccugcccgccuugucccgcuccugagcugcucggcgggcccagcgucuuccuguuucccccuaagccgaaagauacacuuaugaucucccggacccccgaaguuaccugcgugguggucgacgugucucacgaggauccugagguuaaguucaauugguacguggacggagucgaagugcauaacgccaagacaaaaccccgcgaggaacaguauaauagcacguacagaguuguguccguccugaccgugcuccaccaggauuggcugaacggcaaggaguauaaauguaaggucagcaauaaagcgcuuccugcccccaucgaaaagacaauuucuaaggcuaaaggccagccgcgggagccucaaguguacacccugcccccuucccgcgaggaaaugacaaagaaccagguuagccuuaccugccuggugaaaggguuuuaccccucugacaucgccgucgagugggaaagcaauggacagccugagaacaacuauaagacgacacccccggugcuggauuccgacggcucuuucuuccucuacagcaaacugaccguugauaaguccagauggcaacaggggaauguguuuagcuguucugucaugcacgaagcucuccauaaccacuauacccagaagucccugagccucucuccuggaaaa

SEQ ID NO: 43567 - RNA, 1539 nt, Artificial Sequence; identical to SEQ ID NO: 43566
  derived and/or modified sequence opt5 from anti-influenza_Chain

SEQ ID NO: 43568 - RNA, 1593 nt, Artificial Sequence
  derived and/or modified sequence opt5 from anti-influenza_Chain
acccugugcaucggcuaccacgccaacaauagcacagacacgguggauaccguccucgagaagaacguuacagugacccauuccgugaaucugcuugaagacaaacacaacgggaagcuguguaaacucagaggagucgcuccccugcaucuuggcaagugcaauauugccggguggauccugggaaacccugagugugaaucucucagcacagcguccucuuggagcuauauuguggagaccuccucuagcgauaauggcacaugcuacccgggggacuucaucgauuaugaggaacugcgggagcagcuguccagcguuucuuccuuugaacgcuucgagauuuuucccaaaaccagcucuuggccuaaccacgacuccaauaagggagugacggcugccuguccccaugccggcgcuaagagcuucuacaaaaaccucaucuggcuggucaagaaaggcaauucuuauccuaaacuuuccaagagcuacaucaacgauaaggggaaggaagugcugguucucuggggcauucaccaccccuccaccucugccgaccaacagagccuguaucagaaugcugaugccuacguguuugucggaacauccagauacagcaaaaaguucaaaccugagaucgcgauucggccgaaggugcgcgaccaggaggggagaaugaacuauuacuggacccuuguggaacccggagauaaaaucacauuugaggccaccggcaaucuggucguuccucgguaugcuuucgccauggaacgcgacgcugggucuggaauuaucauuuccgauacgcccgugcaugacugcaacacaaccugucaaacaccuaagggcgccaucaacaccagccuccccuuucagaauauccacccgauuaccaucggcaaaugcccuaaguacgugaagucuacaaaacugagacuggcgacggggcuccggaacguccccagcauucagucccgcggacuguucggcgccaucgcuggguuuauugagggaggcuggaccgggaugguggacggaugguauggcuaccaucaccagaaugaacaaggcucuggguaugccgcugaucuuaagagcacacagaacgccaucgacgagaucaccaauaaaguuaacuccgugauugagaagaugaauacacaguucaccgccgucggaaaagaauuuaaccaccuggagaagagaaucgaaaaucucaacaagaaaauugaugacggcuuccuggauaucuggacguacaaugcugagcuucuggugcuccuggaaaacgagcggacacuggacuaccaugauagcaauguuaagaaccucuaugagaaagugcgcucucagcugaagaauaacgcgaaagaaauugggaacggauguuucgaguuuuaccacaagugcgacaauaccuguauggaauccgucaagaacggcaccuaugauuacccuaaauauagcgaggaagccaaacuuaauagagaggagaucgacggggugaagcuggaaucuacacggaucuaccaaauucucgcuaucuauuccaccgucgccagcucccuggugcuuguugugucucugggcgcc

SEQ ID NO: 43569 - RNA, 1593 nt, Artificial Sequence
  derived and/or modified sequence opt5 from anti-influenza_Chain
acccugugcaucggcuaccacgccaacaauagcacagacacgguggauaccguccucgagaagaacguuacagugacccauuccgugaaucugcuugaagacaaacacaacgggaagcuguguaaacucagaggagucgcuccccugcaucuuggcaagugcaauauugccggguggauccugggaaacccugagugugaaucucucagcacagcguccucuuggagcugcauuguggagaccuccucuagcgauaauggcacauguuauccgggggacuucaucgauuacgaggaacugcgggagcagcuguccagcguuucuuccuuugaacgcuucgagauuuuucccaaaaccagcucuuggccuaaccacgacuccaauaagggagugacggcugccugcccccaugccggcgcuaagagcuucuauaaaaaccucaucuggcuggucaagaaaggcaauucuuacccuaaacuuuccaagagcuauaucaacgauaaggggaaggaagugcugguucucuggggcauucaccaccccuccaccucugccgaccaacagagccuguaccagaaugcugaugccuauguguuugucggaacauccagauacagcaaaaaguucaaaccugagaucgcgauucggccgaaggugcgcgaccaggaggggagaaugaacuacuauuggacccuuguggaacccggagauaaaaucacauuugaggccaccggcaaucuggucguuccucgguacgcuuucgccauggaacgcgacgcugggucuggaauuaucauuuccgauacgcccgugcaugacuguaacacaaccugccaaacaccuaagggcgccaucaacaccagccuccccuuucagaauauccacccgauuaccaucggcaaauguccuaaguaugugaagucuacaaaacugagacuggcgacggggcuccggaacguccccagcauucagucccgcggacuguucggcgccaucgcuggguuuauugagggaggcuggaccgggaugguggacggaugguacggcuaucaucaccagaaugaacaaggcucuggguacgccgcugaucuuaagagcacacagaacgccaucgacgagaucaccaauaaaguuaacuccgugauugagaagaugaauacacaguucaccgccgucggaaaagaauuuaaccaccuggagaagagaaucgaaaaucucaacaagaaaauugaugacggcuuccuggauaucuggacguauaaugcugagcuucuggugcuccuggaaaacgagcggacacuggacuaccaugauagcaauguuaagaaccucuacgagaaagugcgcucucagcugaagaauaacgcgaaagaaauugggaacggaugcuucgaguuuuaucacaagugugacaauaccugcauggaauccgucaagaacggcaccuacgauuauccuaaauacagcgaggaagccaaacuuaauagagaggagaucgacggggugaagcuggaaucuacacggaucuaucaaauucucgcuaucuacuccaccgucgccagcucccuggugcuuguugugucucugggcgcc

SEQ ID NO: 43570 - RNA, 1593 nt, Artificial Sequence
  derived and/or modified sequence opt5 from anti-influenza_Chain
acccugugcaucggcuaccacgccaacaauagcacagacacgguggauaccguccucgagaagaacguuacagugacccauuccgugaaucugcuugaagacaaacacaacgggaagcuguguaaacucagaggagucgcuccccugcaucuuggcaagugcaauauugccggguggauccugggaaacccugagugugaaucucucagcacagcguccucuuggagcuauauuguggagaccuccucuagcgauaauggcacaugcuacccgggggacuucaucgauuaugaggaacugcgggagcagcuguccagcguuucuuccuuugaacgcuucgagauuuuucccaacaccagcucuuggccuaaucacgacuccaacaaaggagugacggcugccuguccccaugccggcgcuaagagcuucuacaagaaucucaucuggcuggucaaaaagggcaacucuuauccuaaacuuuccaagagcuacaucaaugauaaagggaaggaagugcugguucucuggggcauucaccaccccuccaccucugccgaccaacagagccuguaucagaacgcugaugccuacguguuugucggaacauccagauacagcaagaaauucaagccugagaucgcgauucggccgaaagugcgcgaccaggaggggagaaugaauuauuacuggacccuuguggaacccggagauaagaucacauuugaggccaccggcaaccuggucguuccucgguaugcuuucgccauggaacgcgacgcugggucuggaauuaucauuuccgauacgcccgugcaugacugcaacacaaccugucaaacaccuaaaggcgccaucaauaccagccuccccuuucagaacauccacccgauuaccaucggcaagugcccuaaauacgugaagucuacaaagcugagacuggcgacggggcuccggaauguccccagcauucagucccgcggacuguucggcgccaucgcuggguuuauugagggaggcuggaccgggaugguggacggaugguauggcuaccaucaccagaacgaacaaggcucuggguaugccgcugaucuuaaaagcacacagaaugccaucgacgagaucaccaacaagguuaauuccgugauugagaaaaugaacacacaguucaccgccgucggaaaggaauuuaaucaccuggagaaaagaaucgaaaaccucaauaagaagauugaugacggcuuccuggauaucuggacguacaacgcugagcuucuggugcuccuggaaaaugagcggacacuggacuaccaugauagcaacguuaaaaaucucuaugagaaggugcgcucucagcugaaaaacaacgcgaaggaaauugggaauggauguuucgaguuuuaccacaaaugcgacaacaccuguauggaauccgucaagaauggcaccuaugauuacccuaaguauagcgaggaagccaaacuuaacagagaggagaucgacggggugaagcuggaaucuacacggaucuaccaaauucucgcuaucuauuccaccgucgccagcucccuggugcuuguugugucucugggcgcc

SEQ ID NO: 43571 - RNA, 1593 nt, Artificial Sequence
  derived and/or modified sequence opt5 from anti-influenza_Chain
acccugugcaucggcuaccacgccaacaauagcacagacacgguggauaccguccucgagaagaacguuacagugacccauuccgugaaucugcuugaagacaaacacaacgggaagcuguguaaacucagaggagucgcuccccugcaucuuggcaagugcaauauugccggguggauccugggaaacccugagugugaaucucucagcacagcguccucuuggagcuauauuguggagaccuccucuagcgauaauggcacaugcuacccgggggacuucaucgauuaugaggaacugcgggagcagcuguccagcguuucuuccuuugaacgcuucgagauuuuucccaaaaccagcucuuggccuaaccacgacuccaauaagggagugacggcugccuguccccaugccggcgcuaagagcuucuacaaaaaccucaucuggcuggucaagaaaggcaauucuuauccuaaacuuuccaagagcuacaucaacgauaaggggaaggaagugcugguucucuggggcauucaccaccccuccaccucugccgaccaacagagccuguaucagaaugcugaugccuacguguuugucggaacauccagauacagcaaaaaguucgggccugagaucgcgauucggccgaaagugcgcgaccaggagggaagaaugaacuauuacuggacccuuguggaacccggcgauaagaucacauuugaggccaccgggaaucuggucguuccucgguaugcuuucgccauggaacgcgacgcuggaucuggcauuaucauuuccgauacgcccgugcaugacugcaacacaaccugucaaacaccuaaaggcgccaucaacaccagccuccccuuucagaauauccacccgauuaccaucgggaagugcccuaaauacgugaagucuacaaagcugagacuggcgacgggacuccggaacguccccagcauucagucccgcggccuguucggggccaucgcuggauuuauugagggcggguggaccggaaugguggacggcugguauggcuaccaucaccagaaugaacaagggucuggauaugccgcugaucuuaaaagcacacagaacgccaucgacgagaucaccaauaagguuaacuccgugauugagaaaaugaauacacaguucaccgccgucggcaaggaauuuaaccaccuggagaaaagaaucgaaaaucucaacaagaagauugaugacggguuccuggauaucuggacguacaaugcugagcuucuggugcuccuggaaaacgagcggacacuggacuaccaugauagcaauguuaaaaaccucuaugagaaggugcgcucucagcugaaaaauaacgcgaaggaaauuggaaacggcuguuucgaguuuuaccacaaaugcgacaauaccuguauggaauccgucaagaacgggaccuaugauuacccuaaguauagcgaggaagccaaacuuaauagagaggagaucgacggcgugaagcuggaaucuacacggaucuaccaaauucucgcuaucuauuccaccgucgccagcucccuggugcuuguugugucucugggagcc

SEQ ID NO: 43572 - RNA, 1593 nt, Artificial Sequence; identical to SEQ ID NO: 43568
  derived and/or modified sequence opt5 from anti-influenza_Chain

SEQ ID NO: 43573 - RNA, 1593 nt, Artificial Sequence; identical to SEQ ID NO: 43569
  derived and/or modified sequence opt5 from anti-influenza_Chain

SEQ ID NO: 43574 - RNA, 1593 nt, Artificial Sequence; identical to SEQ ID NO: 43570
  derived and/or modified sequence opt5 from anti-influenza_Chain

SEQ ID NO: 43575 - RNA, 1593 nt, Artificial Sequence; identical to SEQ ID NO: 43571
  derived and/or modified sequence opt5 from anti-influenza_Chain

SEQ ID NO: 43576 - RNA, 1605 nt, Artificial Sequence
  derived and/or modified sequence opt5 from anti-influenza_Chain
gccaacgcugacacccugugcaucggcuaccacgccaauaacagcacagauacgguggacaccguccucgagaagaauguuacagugacccauuccgugaaccugcuugaagauaaacacaaugggaagcuguguaaacucagaggagucgcgccccugcaucuuggcaagugcaacauugcuggguggauccugggaaauccugagugugaaucucucagcacagccuccucuuggagcuauauuguggagaccuccucuagcgacaacggcacaugcuacccgggggauuucaucgacuaugaggaacugcgggagcagcuguccagcguuucuuccuuugaacgcuucgagauuuuucccaaaaccagcucuuggccugaucacgacuccaauaagggagugacggccgcuuguccccaugccggcgcuaagagcuucuacaaaaaccucaucuggcuggucaagaaaggcaauucuuauccuaaacuuuccaagagcuacaucaacgauaaggggaaggaagugcugguucucuggggcauucaccaccccuccaccucugccgaccaacagagccuguaucagaaugcggaugccuacguguuugucggaacauccagauacagcaaaaaguucaaaccugagaucgcuauucggccgaaggugcgcgaccaggaggggagaaugaacuauuacuggacccuuguggaacccggagauaaaaucacauuugaggccaccggcaaucuggucguuccucgguaugcuuucgccauggaacgcaacgcggggucuggaauuaucauuuccgacacgcccgugcaugacugcaacacaaccugucaaacaccuaagggcgccaucaauaccagccuccccuuucagaacauccacccgauuaccaucggcaaaugcccuaaguacgugaagucuacaaaacugagacuggcuacggggcuccggaauguccccagcauucagucccgcggacuguucggcgccaucgcuggguuuauugagggaggcuggaccgggaugguggauggaugguauggcuaccaucaccagaacgaacaaggcucuggguaugccgccgaccuuaagagcacacagaaugcuaucgauaaaaucaccaacaagguuaauuccgugauugagaaaaugaacacacaguucaccgcggucggaaaggaguuuaaucaccuggaaaagagaaucgagaaccucaauaaaaagguggacgauggcuuccuggacauuuggacguacaacgccgaacuucugguucuccuggagaaugaacggacacuggauuaccaugacagcaacgugaaaaaucucuaugagaagguccgcucucagcugaaaaacaacgcuaaggagaucgggaauggauguuucgaauuuuaccacaagugcgauaacaccuguauggaguccgugaaaaauggcaccuaugacuacccuaaguauagcgaagaggccaaacuuaacagagaagagauugauggggucaagcuggagucuacacggaucuaccaaauccucgccauuuauuccaccguggcuagcucccugguucuuguggucucucugggcgcc

SEQ ID NO: 43577 - RNA, 1605 nt, Artificial Sequence
  derived and/or modified sequence opt5 from anti-influenza_Chain
gccaacgcugacacccugugcaucggcuaccacgccaauaacagcacagauacgguggacaccguccucgagaagaauguuacagugacccauuccgugaaccugcuugaagauaaacacaaugggaagcuguguaaacucagaggagucgcgccccugcaucuuggcaagugcaacauugcuggguggauccugggaaauccugagugugaaucucucagcacagccuccucuuggagcuauauuguggagaccuccucuagcgacaacggcacaugcuacccgggggauuucaucgacuaugaggaacugcgggagcagcuguccagcguuucuuccuuugaacgcuucgagauuuuucccaaaaccagcucuuggccuaaucacgauuccaacaagggagugacggccgcuugucccagagccggcgcuaagggcuucuacaaaaaucucaucuggcuggucaagaaagggaacagcuauccuaaacuuaauaagucuuacaucaacgacaagggaaaggaagugcugguucucuggggcauucaucaccccuccaccacagccgaucaacagagccuguaucagaaugcggacaccuacguguuugucgggacaucccgguacucuaaaaaguucaaaccugagaucgagauucgcccgaaggugagagaucaggaaggacggaugaacuauuacuggacccuuguggagcccggcgacaaaaucacguuugaagccacagggaaccuggucguuccucgcuaugcuuucgccauggagagaaaugcuggaagcggcauuaucauuuccgauacccccgugcacgacugcaacacaaccugucaaaccccuaagggcgccaucaauacaagccuccccuuucagaacauccauccgauuacgaucgggaaaugcccuaaguacgugaagucuaccaaacugcggcuggcgacaggacuccgcaauguccccuccauucagagcagaggccuguucggggccaucgcuggauuuauugaaggcggguggaccggaaugguggacggcugguauggcuaccaccaucagaacgagcaagggucuggauaugccgcugaucuuaagagcacacagaaugccaucgacaaaaucaccaacaagguuaauuccgugauugagaaaaugaacacgcaguucacagccgucgauaaggaauuuaaucaccuggagaagcggaucgaaaaccucaauaaaaagguggacgauggcuuccuggacauuuggaccuacaacgcugagcuucugguucuccuggaaaaugagcgcacccuggauuaccacgacucuaacgugaaaaaccucuaugagaaggucagaaaucagcugaaaaacaaugcgaaggaaaucgggaacggauguuucgaguuuuaccauaagugcgauaauacauguauggaaagcgugaaaaacggcaccuaugacuacccuaaguauuccgaggaagccaaacuuaaucgggaggagauugauggggucaagcuggaaagcacacgcaucuaccaaauccucgcuauuuauucuacgguggccuccagccugguucuuguggucucucugggcgcc

SEQ ID NO: 43578 - RNA, 1605 nt, Artificial Sequence; identical to SEQ ID NO: 43576
  derived and/or modified sequence opt5 from anti-influenza_Chain

SEQ ID NO: 43579 - RNA, 1605 nt, Artificial Sequence; identical to SEQ ID NO: 43577
  derived and/or modified sequence opt5 from anti-influenza_Chain

SEQ ID NO: 43580 - RNA, 1644 nt, Artificial Sequence
  derived and/or modified sequence opt5 from anti-influenza_Chain
cagaagcugcccggcaacgacaauagcaccgccacacucugccuggggcaccaugcugugccuaacggaacgaucgucaaaaccauuacaaaugaucaaaucgagguuaccaacgccacagaacuugugcaguccucuagcaccggcgagauuugugacuccccgcaccagauccuggauggggaaaauugcacacucauugacgcgcugcuuggagauccccagugugacggcuuccaaaacaagaaaugggaucuguuuguggagagaucuaaggcuuacagcaauugcuauccuuacgacguccccgauuaugccucccuccggucucugguggccagcuccgggacccuggaauuuaacaaugagagcuucaacuggacgggaguuacccagaauggcacaucuuccgcuuguauccgcagaagcaacaauucuuucuuuucccggcucaacuggcugacccaucuuaaauucaaguacccugcccugaaugugacaaugcccaacaacgagaaguuugacaaacucuauaucuggggcguccaccauccugggaccgauaaugaccagauuuucccguacgcucaggccagcggacgcaucacggugucuacaaagagaucccaacagaccguuauucccaacaucggcagccggccucgcgugagaaauauucccucccggaucucuauuuauuggacaaucgucaaaccuggggauauccugcuuauuaacagcaccggaaaucugaucgcgccccgcggcuacuuuaagauuagauccgggaaaagcucuaucaugcgguccgacgccccgauuggaaagugcaacagcgaauguaucaccccuaauggcucuauccccaacgacaagccuuuccagaaugugaaccgcauuacauacggcgcuugccccagauaugugaaacagaauacgcucaagcuggccaccgggaugcggaacguccccgagaaacaaacacgcggaaucuuuggcgcuauugccggguucaucgaaaauggaugggagggcaugguugaugggugguacggauuuagacaccagaacagcgagggcauuggccaggcggccgaccugaaguccacccaagcugccaucgaucagaucaaugggaaacucaaccggcugauuggaaagacaaacgaaaaauuccaccagaucgagaaggaguucucugaaguggaaggccgcauucaggaccuugagaaguauguggaggauaccaaaaucgaccuguggagcuacaaugcugaacuccuggucgcccuugagaaccaacauacgauugaucugacagacuccgaaaugaauaagcucuuugagaaaaccaagaaacagcugagagaaaacgccgaggauauggggaauggauguuucaagaucuaucacaagugcgacaacgcuuguauuggcagcauccggaaugggaccuacgaucaugacguguauagagacgaggcgcugaacaaucgcuuucagaucaaaggcguugaacucaagucuggauacaaagauuggauucuguggaucuccuucgccauuagcugcuuucuucugugcguggcucuccugggcuucaucaugugggccugucagaaggggaacauucggugcaauauc

SEQ ID NO: 43581 - RNA, 1644 nt, Artificial Sequence; identical to SEQ ID NO: 43580
  derived and/or modified sequence opt5 from anti-influenza_Chain

SEQ ID NO: 43582 - RNA, 1647 nt, Artificial Sequence
  derived and/or modified sequence opt5 from anti-influenza_Chain
augcugaccuuccacagaaucauucggaagggcuggauguuucuccuggccuuccuucugacagcucuccuguuuugccccacggggcagccugccaaagcggcugccccguucaacggaaccaugaugcaauacuuugagugguaucuucccgacgauggcacacuguggaccaagguggccaaugaagcuaacaaucucagcucccuggggaucacagcccuguggcucccucccgcuuacaaaggaaccucucgcagcgacgucggcuaugggguuuacgaucuguaugaccuuggagaguucaaccagaagggcgccgugagaacaaaauacggcaccaaggcgcaguaucugcaggccauucaagcugcccaugcugccgggaugcaaguguacgcggaugucguguuugaccacaagggaggcgccgaugggacggaauggguugacgcuguggaggucaauccuuccgaucggaaccaggaaaucucuggaaccuaccagauucaggccuggacaaaauucgacuuucccggccgcgggaauaccuauagcuccuucaaguggagaugguaccauuuugauggaguggacugggaugagucucggaaacucagccgcaucuauaaguucagaggcaucggcaaggcuugggacugggagguugacacagaaaacgggaauuacgauuaucugauguacgccgaccuugauauggaccacccugagguggucaccgaacugaaauccuggggaaagugguaugugaacacgacaaauauugauggcuuucggcucgacgccgugaaacauaucaaguucagcuucuuuccggauuggcugucugacguccgcucccagaccgggaaaccccuguucacaguuggagaguacuggagcuacgauauuaacaagcuccacaauuauaucaugaaaaccaacggcaccaugucucuguuugacgcuccucuucacaauaaguucuacacagcguccaaaagcgggggaacguuugauaugagaacccugaugacaaacacccucaugaaggaccagcccacacuggccgugaccuucguggacaaccaugauacggagccuggccaggcccuucaaucuugggucgaccccugguuuaagccgcuggcuuaugccuucauucucacacggcaggaaggcuacccuuguguguuuuauggggauuacuauggaaucccccaguacaauauuccuucccugaaaagcaagaucgacccccugcucaucgcucgcagagauuacgccuauggcacccaacacgacuaccuggaucauuccgacauuaucggguggacccgggagggaguuacagaaaaacccggcucugggcuugcggcucugauuaccgauggcccuggaggcagcaaguggauguauguggggaaacagcacgccggaaaggucuucuacgaccucacaggcaaccgcuccgauacggugaccaucaauagcgacggguggggagaguuuaagguuaacggcgggucuguguccgucugggugccgagaaaaacaaccgucagcacaauugccuggucuaucaccacgcggcccuggaccgaugaguucgugagauggacagaaccucgccugguugcuuggccc

SEQ ID NO: 43583 - RNA, 1647 nt, Artificial Sequence
  derived and/or modified sequence opt5 from anti-influenza_Chain
aucugcauuggcuaccacgccaacaauagcaccgaacagguggacacaaucauggaaaagaacgucacgguuacccaugcucaagauauucuggagaaaacacacaaugggaagcucugugaccuggauggagugaaaccccuuauccugagagacugcuccguggccggcuggcuccuggggaacccuaugugugaugaauuuauuaaugucccggaguggucuuauaucguggaaaaggcgaaccccgcuaaugaccuuugcuacccuggaaacuuuaaugauuaugaggagcugaaacaucuccugagccggaucaaccacuucgaaaagauucagaucauucccaaguccucuuggagcgaccaugaggccuccucuggcguuagcuccgccuguccuuaccaggggacccccagcuuuuuccgcaauguggucuggcugaucaaaaagaacaauacauauccuaccauuaaaagaucuuacaacaauacaaaccaggaagaucuccugauccuuuggggcauucaccacuccaacgacgcugccgagcaaaccaagcuguaucagaauccgacgaccuacaucagcgugggaacaucuacccucaaccagcggcugguucccaaaaucgcuacacgcuccaaggugaauggccagaacgggagaauggauuucuucuggaccauucuuaagccuaaugacgccaucaacuuugagagcaauggaaacuucauugcgcccgaauacgccuauaaaaucgucaagaaaggcgauucugcuauugugaaguccgagguggaauacgggaauugcaacacgaaaugucaaacaccuaucggagccaucaauagcuccaugcccuuucauaacauucacccgcugaccaucggcgagugcccuaaguaugucaaaucuaauaagcucguucuggcuacagggcugcggaacagcccccuccgcuccgacaagacccauaccuguccucccugccccgccccugaacugcuuggaggcccgagcguguuccuguuucccccuaaacccaaggacacacucaugauuucuagaacgccugaggugaccugugucgugguugaugugucccacgaggaccccgaagucaaauucaauugguacguggauggcguugaggugcacaacgcgaagacaaaaccgcgggaggagcaguauaacagcaccuaccgcgucgugucuguccugacagugcuucaucaggacuggcugaaugggaaggaauauaagugcaaaguuagcaacaaggcccucccugcucccaucgagaaaaccauuuccaaggccaaaggacagccuagagagccccaaguguacacgcugccucccucucgggaagagaugacaaagaaucaggucagccugaccugccucgugaagggcuuuuacccguccgauaucgcuguugaaugggagagcaacgggcagccugaaaauaacuauaaaaccacaccucccgugcuggacucugauggauccuucuuccuuuacagcaagcugaccgucgacaaaucucgcuggcaacagggcaauguguuuuccuguagcgugaugcacgaggcccuccauaaccacuauacacagaagucccugucucuuagccccgggaaa

SEQ ID NO: 43584 - RNA, 1647 nt, Artificial Sequence; identical to SEQ ID NO: 43583
  derived and/or modified sequence opt5 from anti-influenza_Chain

SEQ ID NO: 43585 - RNA, 1647 nt, Artificial Sequence; identical to SEQ ID NO: 43582
  derived and/or modified sequence opt5 from anti-influenza_Chain

SEQ ID NO: 43586 - RNA, 1650 nt, Artificial Sequence
  derived and/or modified sequence opt5 from anti-influenza_Chain
gaccagaucugcauuggcuaccacgccaacaauagcaccgagcaaguggauacaaucauggaaaagaacgucacgguuacccaugcucaggacauucuggagaaaacacacaaugggaagcucugugaucuggacggagugaaaccccuuauccugagagauugcuccguggccggcuggcuccuggggaacccuaugugugacgaguucauuaaugucccggaguggucuuauaucguggaaaaggcgaaccccaccaaugaucuuugcuacccuggcagcuuuaacgacuaugaggagcugaaacaucuccugucccggaucaaucacuucgaaaagauucagaucauucccaagucuagcugguccgaucaugaggcuucuagcggaguuuccagcgccuguccuuaccuggggucucccuccuuuuuccgcaacguggucuggcucaucaaaaagaauagcacauauccuaccauuaaaaagucuuacaacaauacaaaccaggaagaccugcuugugcuguggggaauccaccacccgaaugaugccgcugagcaaaccagacucuaucagaaccccacgaccuacauuuccaucggcacaagcacccugaaccagcggcuuguuccuaaaaucgccacacgcucuaaggugaauggccaguccgggagaauggaguuuuucugggcuauucugaagcccaacgacgccaucaauuuugaaagcaacggaaauuucauugcgccugaguacgccuauaaaaucgucaagaaaggcgauuccgcuauuaugaagucugaacucgaguacgggaacugcaauaccaaaugucaaacgcccaugggagccaucaacagcuccaugccguuucauaauauccacccucugacaauuggcgaaugccccaaguaugugaaaagcaaccggcuggugcucgcuaccgggcugcgcaauucuccucagagagagucccggcgcaagaagagaggacuuuucggcgccaucgcgggcuuuauugaagggggauggcagggcauggucgacgggugguacggauaucaucacagcaacgaacagggcucuggguacgccgcugacaaagagagcacacaaaaggccaucggaguuaccaauaaagugaacuccauuaucgauaagaugaauacccaguucgaagcugugggccgggaguuuaacaaccuggaacgcagaaucgagaaucucaacaaaaagauggaggacggcuuccuggaugucuggacauauaaugccgaacuucuggugcucauggagaacgaacggacgcuggacuuccacgauucuaauguuaagaaccuguacgacaaagugcgccuccagcugagagauaaugccaaggagcuugggaacggauguuuugaguucuaccauaaaugcgacaaugaauguauggagagcauucggaacggcaccuauaauccccaauacuccgaagaggcuagacugaagcgcgaagagaucagcggggucaaacucgagucuauuggaacauaucagauccuguccauuuacagcaccguggcgucuucccuugcccuggcuaucaugauugccggccucagccuguggaugugcuccaacgggucucugcagugccggaucuguauc

SEQ ID NO: 43587 - RNA, 1650 nt, Artificial Sequence; identical to SEQ ID NO: 43586
  derived and/or modified sequence opt5 from anti-influenza_Chain

SEQ ID NO: 43588 - RNA, 1656 nt, Artificial Sequence
  derived and/or modified sequence opt5 from anti-influenza_Chain
augaacauccagauucuggccuucaucgcuugcgugcucaccggcgccaagggggacaaaauuugucugggacaccaugcggucgcuaauggcacaaagguuaacacgcuuaccgagaaagggaucgaaguggugaaugccacagagaccgucgaaacagccgaugugaagaaaauuugcacccaaggaaagagagcuacagaccugggccggugugggcuccugggaacccuuaucgggcccccucagugcgaucaguuucuggaguucagcuccgaccucaucauugaacgcagagagggcacggauguuuguuacccggggcgguuuaccaacgaggaaucucugcgccagauccugagacggagcggaggcauugggaaggaguccaugggauucacauauucuggcauccgcaccaauggggccgcuagcgccugcacaagauccggaucuagcuuuuacgcggaaaugaaauggcuccuguccaacagcgacaauucugccuucccccaaaugaccaaggcuuaucggaacccucgcaauaaacccgcccuuauuaucuggggcgugcaccauuccgagagcgcuucugagcagacgaagcuguacggcuccgggaacaaacucauuacagucagaagcucuaaguaucagcaguccuuuaccccuagccccggaacacggcgcaucgauuuccacuggcugcuucuggacccuaaugauaccgugaccuuuacauucaacggcgccuuuaucgcgccggacagagccuccuucuuucggggcgaaucucucggaguucaaagcgaugcuccccuggacuccagcugucgcggcgauugcuuccauucugggggaacgauuguguccagccugccuuuccagaauaucaacucuagaaccgucggccggugucccagauacgugaagcagaaaagccuccugcuugccacaggcaugcgcaaugugccugagaagcccaaaccgcgggggcuguuuggagcuauugccggcuucaucgaaaacgggugggagggacucauuaacggcugguauggguuuagacaccagaaugcccaaggcgaaggaaccgcugcggacuacaaguccacacagucugccaucgaccagaucaccggcaaacugaaccgccuuauugggaagacgaaucaacaguucgagcugaucgauaacgaguuuaaugaaauugagcagcagaucggaaacgucauuaauuggacacgggacgcuaugaccgaaaucuggagcuacaacgccgagcuccugguugccauggaaaaucaacacaccaucgaucuggcugacuccgagaugagcaaacucuaugagagagugaagaagcagcugcgcgaaaacgccgaggaagauggcacagggugcuucgagauuuuucauaaaugugacgaucagugcauggaaucuauccggaauaacaccuacgaccacacacaguauagaacggagucccuucaaaaucgcauucagaucgauccugugaagcugagcucuggauacaaagacauuauccucugguucuccuuuggcgcgagcugcuucauucugcuugcuaucgccauggggcuggucuuuaucuguauuaagaacggcaauaugcagugcaccaucuguauu

SEQ ID NO: 43589 - RNA, 1656 nt, Artificial Sequence
  derived and/or modified sequence opt5 from anti-influenza_Chain
augaacacccagauccuggccuucauugcuugcgugcucacaggcgucaagggggacaaaaucugucugggacaccaugccguugcgaauggcacgaaggugaacacccuuacagagaaagggauugaaguggucaaugcuaccgagacaguggaaaccgccgauguuaagaaaaucugcacacaaggaaagagagccaccgaccugggccggugugggcuccugggaacgcuuauugggcccccucagugcgaucaguuucuggaguucagcuccgaccucaucaucgaacgcagagagggcaccgauguguguuacccggggcgguuuacaaacgaggaaucucugcgccagauucugagacggagcggaggcaucgggaaggaguccaugggauucaccuauucuggcauucgcacaaauggggcuaccagcgccugcacgagauccggaucuagcuuuuacgcugaaaugaaauggcuccuguccaacagcgacaauucugccuucccccaaaugacaaaggcguaucggaacccucgcaauaaacccgcccuuaucauuuggggcguccaccauuccgagagcgugucugagcagaccaagcuguacggcuccgggaacaaacucaucacaguuagaagcucuaaguaucagcaguccuuuaccccuagccccggagcucggcgcauugauuuccacuggcugcuucuggacccuaaugauaccgugacauuuacguucaacggcgccuuuaucgcuccggacagagccuccuucuuucggggcgaaucucucggaguccaaagcgaugugccccuggacuccagcugucgcggcgauugcuuccauucugggggaaccaucguguccagccugccuuuccagaauauuaacucuagaacagucggcaaguguccccgguacguuaaacaaaagagccuccugcuugcgaccggcaugagaaaugugccugagaaacccaagccgcgcgggcuguuuggagccaucgcuggcuucauugaaaacgggugggagggacucaucaacggcugguauggguuucggcaccagaaugcccagggcgaaggaacagcugccgacuacaaauccacccagucugccauugaccagaucacgggcaagcugaacagacuuaucgggaaaacaaaucaacaguucgagcugauugauaacgaguuuaaugaaaucgagcagcagauuggaaacgugaucaauuggacccgcgacgcuaugaccgaaauuuggagcuacaacgcggagcuccuggucgccauggaaaaucaacacacaaucgaucuggcugacuccgagaugagcaagcucuaugagcgggugaagaaacagcugagagaaaacgccgaggaagauggcaccgggugcuucgagaucuuucauaagugugacgaucagugcauggaaucuauucgcaauaacacauacgaccacacgcaguaucggaccgagucccuucaaaauagaauccagauugauccuguuaaacugagcucuggauacaaggacaucauucucugguucuccuuuggcgccagcugcuuccugcuucuggcuaucgccauggggcucguguuuauuuguaucaaaaacggcaauaugcagugcacaaucuguauu

SEQ ID NO: 43590 - RNA, 1656 nt, Artificial Sequence
  derived and/or modified sequence opt5 from anti-influenza_Chain
augaacauccagauucuggccuucaucgcuugcgugcucaccggcgccaagggggacaaaauuugucugggacaccaugcggucgcuaauggcacaaagguuaacacgcuuaccgagaaagggaucgaaguggugaaugccacagagaccgucgaaacagccaacauuaagaaaaucugcacccaaggaaagagacccacagaucugggccagugugggcuccugggaacccuuaucggcccuccgcagugcgaccaguuucuggaguucagcuccgaucucauuaucgaaagacgcgagggcacggacguguguuaccccgggaaguuuaccaaugaggaaucucugagacaaauucugcggcgcagcggaggcaucgggaaagaguccaugggauucacauauucuggcauuagaaccaacggggcuacaagcgccugcacccgguccggaucuagcuuuuacgcugaaaugaaguggcuccuguccaauagcgauaacgccgcguucccucagaugacgaaaucuuaucgcaaucccagaaacaagccugcccuuaucauuuggggcguucaccauuccgagagcgugucugagcagacaaaacuguacggcuccgggaauaagcucaucaagguccggagcucuaaauaucagcaauccuuuacccccaacccuggagcucgcagaaucgacuuccacuggcugcuucuggauccgaaugacacagugaccuuuaccuucaacggcgccuuuauugcucccgaucgggccagcuucuuucgcggggaauccaucggaguucagucugacgcgccucucgauagcuccuguggcgggaauugcuuccauaacggaggcacaauugugagcucucugcccuuccagaacaucaauccuagaacggucggcaaguguccccgguacgugaaacagaagucccugcuccuggccaccgggaugcgcaacgugccggagaaaccuaagaaaagaggacuuuuuggcgcuauugccggguucaucgaaaauggaugggagggccugaucaacgggugguauggcuuucggcaccaaaaugcucagggagaaggcacagccgccgacuacaagagcacccagucugcuauugaucaaaucacagggaagcucaacagacugauuggaaaaaccaaucagcaguucgagcuuaucaacaaugaguuuaacgaagucgagcagcaaauuggcaauguuaucaacuggacgcaggacgcgaugacagaaguguggagcuacaaugccgagcugcucguggcuauggaaaaccagcacaccaucgaccugaccgauuccgagaugucuaagcuguaugagcgcguccggaaacagcucagagaaaaugccgaggaagacgggacaggaugcuucgagauuuuucauaagugugaugaccacugcauggaaagcauccgcaacaacaccuacgaucauacacaauaucggacggagucccugcagaaucggauucagaucgaccccgugaaacuuagcggcggguacaaggauauuauccugugguucucuuuuggcgccuccugcuuccuccugcuugcuauugccaugggacugguuuuuaucuguaucaagaacggcaauaugcagugcaccauuuguauc

SEQ ID NO: 43591 - RNA, 1656 nt, Artificial Sequence
  derived and/or modified sequence opt5 from anti-influenza_Chain
gaccagaucugcauuggcuaccacgccaacaauagcaccgagcaaguggauacaaucauggaaaagaacgucacgguuacccaugcucagaauauucuggagaaaacacacaacgggaagcucugugaccuggauggagugaaaccccuuauccugagagacugcuccguggccggcuggcuccuggggaauccuaugugugaugaauuucuuaacgucccggaguggucuuauauuguggaaaagaucaaucccgcgaacgaccugugcuacccuggaaauuuuaacgauuaugaggagcucaaacaucugcugagccggaucaaucacuucgaaaagauucagaucauucccaaguccucuuggagcgaccaugaggcuuccucuggcguuagcuccgccuguccuuaccaggggcgcagcucuuucuucagaaacguggucuggcucaucaaaaaggauaaugccuaucccaccauuaaacgguccuacaacaauacaaaccaagaagaccugcuugugcuguggggaauccaccacccuaacgaugcugccgagcagacccgccucuaucagaauccgacaaccuacauuagcguuggcacgucuacccugaaccagagacuugugcccaagaucgcuacacgguccaaagucaauggccaaagcgggcgcauggaguuuuucuggaccauccugaagccuaacgacgccauuaauuuugaaucuaacggaaauuucaucgcgcccgagaacgccuacaagauugugaaaaagggcgauuccacaaucaugaaaagcgaacucgaguaugggaauugcaacaccaagugucagacgccuauuggagcuaucaauuccucuaugcccuuucauaacauccacccgcugacaauuggcgaaugcccuaaauacgugaaguccaauaaacugguccucgccaccgggcugagaaacagcccccagggagagcggcgcagaaagaagcggggccuuuucggcgcuaucgccggguuuauugagggaggcuggcaggggaugguugacggaugguauggcuaccaucacagcaaugaacaagggucuggauaugcggccgacaaagaguccacacagaaggcuaucgauggcgugaccaacaaagugaacagcauuaucgacaagaugaauacccaguucgaagccgucggccgcgaguuuaacaaucuggaaagacggaucgagaaccucaauaaaaagauggaggauggguuccuggacguguggacauacaacgcugaacuucugguucucauggagaaugaacgcacgcuggauuuccacgacucuaacgugaagaaucuguaugauaaaauuagacuccaacugcgggacaacgccaaggagcuuggaaauggcuguuuugaguucuaccauagaugcgauaacgaauguauggagagcguccgcaaugggaccuacgacuauccucaguacuccgaagaggcccggcugaaaagagaagagaucucuggagugaagcucgagagcauuggcacauaucagauccuguccauuuacagcaccguugcuucuucccuuacacuggcgaucaugguggccgggcucagccuguggaugugcucuaacggcucccugcagugccgcauuuguauc

SEQ ID NO: 43592 - RNA, 1656 nt, Artificial Sequence
  derived and/or modified sequence opt5 from anti-influenza_Chain
gaccagaucugcauuggcuaccacgccaacaauagcaccgagcaaguggauacaaucauggaaaagaacgucacgguuacccaugcucaggacauucuggagaaaacacacaaugggaagcucugugaucuggacggagugaaaccccuuauccugagagauugcuccguggccggcuggcuccuggggaacccuaugugugacgaguucauuaaugucccggaguggucuuauaucguggaaaaggcgaaccccaccaaugaucuuugcuacccuggauccuuuaacgacuaugaggagcugaaacaucuccugucccggaucaaucacuucgaaaagauucagaucauucccaagucuagcugguccgaucaugaggcuucuagcggcguuuccagcgccuguccuuaccuggggucucccuccuuuuuccgcaacguggucuggcucaucaaaaagaauagcacauauccuaccauuaaaaagucuuacaacaauacaaaccaggaagaccugcuugugcuguggggaauccaccacccgaaugaugccgcugagcaaaccagacucuaucagaaccccacgaccuacauuuccaucggcacaagcacccugaaccagcggcuuguuccuaaaaucgccacacgcucuaaggugaauggccaguccgggagaauggaguuuuucuggaccauucugaaccccaaugacgcuaucaacuuugaaagcaauggaaacuucauugccccugaguacgcguauaagaucgucaaaaagggcgauuccgccauuaugaaaucugaacucgaguacgggaauugcaacacgaagugucaaacacccaugggagcuaucaauagcuccaugccguuucauaacauccacccucugaccauuggcgaaugccccaaauaugucaagagcaaucggcuggugcucgccacagggcugcgcaacucuccucagagagagucccggcgcaaaaagagaggacuuuucggcgcuaucgccggcuuuauugaagggggauggcagggcaugguggacgggugguacggauaucaucacagcaaugaacagggcucuggguacgcggccgacaaggagagcacccaaaaagcuaucgauggaguuaccaacaaggugaauagcauuaucgacaaaaugaacacacaguucgaagccgugggccgggaguuuaacaaucuggaacgcagaaucgagaaccucaauaagaaaauggaggauggcuuccuggacgucuggacguauaacgcugaacuucuggugcucauggagaaugaacggacccuggauuuccacgacucuaacguuaagaaucuguacgauaaggugcgccuccagcugagagacaacgccaaagagcuugggaauggauguuuugaguucuaccauaagugcgauaacgaauguauggagagcauucggaauggcacauauaacuacccccaauauuccgaagaggccagacugaaacgcgaagagaucagcggggucaagcucgagucuauuggaaccuaccagauccuguccauuuauagcacaguggcuucuucccuugcgcuggccaucaugauggcuggccucagccuguggaugugcuccaaugggucucugcagugccggauuuguauc

SEQ ID NO: 43593 - RNA, 1656 nt, Artificial Sequence; identical to SEQ ID NO: 43588
  derived and/or modified sequence opt5 from anti-influenza_Chain

SEQ ID NO: 43594 - RNA, 1656 nt, Artificial Sequence; identical to SEQ ID NO: 43589
  derived and/or modified sequence opt5 from anti-influenza_Chain

SEQ ID NO: 43595 - RNA, 1656 nt, Artificial Sequence; identical to SEQ ID NO: 43590
  derived and/or modified sequence opt5 from anti-influenza_Chain

SEQ ID NO: 43596 - RNA, 1656 nt, Artificial Sequence; identical to SEQ ID NO: 43591
  derived and/or modified sequence opt5 from anti-influenza_Chain

SEQ ID NO: 43597 - RNA, 1656 nt, Artificial Sequence; identical to SEQ ID NO: 43592
  derived and/or modified sequence opt5 from anti-influenza_Chain

SEQ ID NO: 43598 - RNA, 1680 nt, Artificial Sequence
  derived and/or modified sequence opt5 from anti-influenza_Chain
augagcaacauggacaucgauuccauuaauaccggcacaaucgacaagacgcccgaggaacugaccccugggacaucuggagccaccagaccgauuaucaaacccgcuacacucgccccucccagcaacaagcggacccgcaauccuucccccgagagaacaaccacgucuagcgaaaccgauauuggccggaaaauccagaagaaacaaacaccuaccgagaucaagaaguccguguacaaaauggucguuaagcugggggaauuuuauaaccagaugauggugaaagcgggacuuaaugacgauauggagcgcaaccugauucagaaugcucaggccguggagagaauccuccuggccgcuacagacgauaagaaaaccgaauaccaaaagaagcggaacgcccgcgacgucaaagagggcaaggaagagauugaucacaauaaaacgggaggaacauuuuauaagauggugagagacgauaaaaccaucuacuucucuccgauuaagaucacauuucuuaaagaggaaguuaagaccauguauaagaccacaaugggcagcgacggcuucuccgggcugaaccauauuaugaucggacacagccagaugaaugaugugugcuuucagcggucuaaaggccucaagcgcgucgggcuggaccccucccugaucagcacguucgcuggaucuacccucccuagacgguccggcacaaccgggguggccauuaaaggaggcggcacacugguugacgaggcgauccgcuuuauugggagagccauggcugaucggggacuucugcgcgacaucaaggccaaaaccgcuuacgaaaagauucuccugaaccuuaagaauaaauguagcgcgccccagcaaaaggcccugguggaucaggucaucggcucuagaaacccugggaucgccgacauugaggaucucacgcugcuggcucgguccauggugguggucagacccagcguugccuccaaaguggugcucccgaucucuauuuaugcuaagaucccucagcugggauucaauacagaagaguacagcauggucggcuacgaggccauggcccuuuauaacauggcuacccccguguccauucugcgcaugggggacgaugcgaaagacaagagccagcucuuuuucaugucuugcuuuggagccgcuuacgaagaucugcggguucuuuccgcccugaccggcacagaguucaagccuagaagcgcccucaaauguaagggcuuucaugugcccgcuaaagaacaagucgaggggaugggagccgcgcugaugucuaucaagcugcaguucugggcucccaugacccgcagcggcgggaacgaaguguccggagagggcgggucuggccagaucagcugcuccccuguuuucgccguggagcggccgauugcccucagcaaacaagcugucagacgcaugcugucuaugaauguggaaggacgggacgccgaugucaagggcaaccuucugaagaugaugaaugacuccauggcuaaaaagacaagcgggaacgccuuuaucgggaaaaagauguuccagauuucugacaaaaauaaggugaaccccaucgagauuccuaucaaacagacgauucccaauuucuucuuuggcagagauaccgcggaagacuaugaugaccucgauuac

SEQ ID NO: 43599 - RNA, 1680 nt, Artificial Sequence
  derived and/or modified sequence opt5 from anti-influenza_Chain
augaacacccagauccuggcccucauugcuuacaugcugaucggcgccaagggggacaaaauuugccuuggacaccaugcgguggcuaauggcacaaaggucaacacgcugaccgagagagggaucgaaguugugaaugccacagagaccguggaaacagucaacauuaaaaagaucuguacccaaggaaaacggcccacagaucucggccagugcgggcugcuuggaacccugaucggcccuccgcagugugaccaguuccucgaguuugaugccgaccugauuaucgaacgcagagagggcacggaugugugcuaucccgggaaguucaccaaugaggaaagccugcggcaaauucuccgcggauccggcgggaucgacaaggagucuaugggauuuacauacagcggcauuagaaccaacgggguuacauccgcuugucggcgcucuggaagcuccuucuaugccgaaaugaaauggcugcuuucuaauagcgauaacgcugccuuuccucagaugaccaaguccuacagaaauccccggaacaaaccugcgcugaucauuuggggcgugcaccauagcggcucugccacggagcagacaaagcucuauggguccggaaauaaacugaucaccgucggcagcucuaaguaccagcaauccuucacacccagcccuggggcucgcccccaggugaacggacagucuggcagaaucgacuuucacuggcuucugcucgauccgaaugacaccguuaccuucacauuuaacggggccuucauugcuccugaucgggccuccuuuuuccgcggagagagccugggcgugcaguccgacgucccccuggauucuggcugcgaaggggacuguuuucauagcagaggaacgaucguguccagccucccuuuccaaaauauuaacccccggaccgugggcaagugcccgcgcuaugucaaacagacaucucugcuucuggcgaccgggaugagaaacguuccugagaaucccaagacacggggacucuucggcgccaucgcuggguuuauugaaaacggcugggagggacugaucgacggcugguacggguucagacaccagaaugcccaaggagaaggcaccgcugccgauuacaaauccacgcagagcgccaucgaccagauuacagggaaacuuaaccgccugaucgauaagaccaaucagcaauuugagcucauugacaacgaguucucugaaaucgagcagcagauuggaaaugugaucaacuggacccgggauagcaugacagaagugugguccuauaaugcugagcugcuggucgcgauggaaaaccagcacaccaucgaccucgccgauucugagaugaauaagcuguacgagagagugcgcaaacaacuucgggaaaacgcugaggaagacggcacaggguguuuugagauuuuccauaagugcgaugaccaguguauggaaagcaucagaaauaacacguaugaucacacccaguaccgcacagagucccugcagaaucggauucaaaucgacccuguuaagcucagcucuggcuauaaagacauuauccugugguuuuccuucggagccagcugcuuucuucugcucgccauugcuaugggccugguguucaucugcaucaagaacgggaacaugagauguaccauuugcauc

SEQ ID NO: 43600 - RNA, 1680 nt, Artificial Sequence
  derived and/or modified sequence opt5 from anti-influenza_Chain
augaacacccagauccuggcccucauugcuugcaugcugaucggcgccaagggggacaaaauuugucuuggacaccaugcgguggcuaauggcacaaaggucaacacgcugaccgagagagggaucgaaguugugaaugccacagagaccguggaaacagccaacauuaaaaagaucugcacccaaggaaaacggcccacagaucucggccagugugggcugcuuggaacccugaucggcccuccgcagugcgaccaguuccucgaguuugaugcugaccugauuaucgaacgcagagagggcacggaugucuguuaccccgggaaguucaccaaugaggaaagccugcggcaaauucuccgcggauccggcgggaucgacaaggagucuaugggauuuacauauagcggcauuagaaccaacggggccacauccgcuugccggcgcucuggaagcuccuucuacgccgaaaugaaauggcugcuuucuaauagcgauaacgcggccuuuccucagaugaccaaguccuauagaaauccccggaacaaaccugcucugaucauuuggggcgugcaccauagcggcucugccacggagcagacaaagcucuacggguccggaaauaaacugaucaccguuggcagcucuaaguaucagcaauccuucacacccagcccuggggcucgcccccaggugaacggacagucuggcagaaucgacuuucacuggcuucugcucgauccgaaugacaccgucaccuucacauuuaacggggccuucauugcgccugaucgggccuccuuuuuccgcggaggcagccugggcgugcaguccgacguuccccuggauucugggugugagggagacugcuuucauagcggcgggacgaucguguccagccucccuuuccaaaauauuaaccccagaaccgucggaaaguguccgcgguacgugaaacagacaucucugcuucuggcuaccggcaugcgcaacgugccugaaaaucccaagacaagagggcuuuucggcgccaucgcuggauuuauugagaacggcugggaagggcugaucgacggaugguauggcuuccggcaccagaaugcccaaggggagggaaccgccgcugauuacaaauccacgcagagcgcgaucgaccagauuacaggcaagcucaacagacugaucgauaaaaccaaucagcaauuugaacucauugacaacgaguucaaugagaucgaacagcagauugggaacgucaucaauuggacccgcgauucuaugacagagguuuggagcuacaacgccgaacugcugguggcuauggagaaucagcacaccaucgaccucgccgauuccgaaaugaacaagcuguaugagcgggugagaaaacaacuucgcgagaaugccgaagaggacggcacaggaugcuuugaaauuuuccauaagugugaugaccagugcauggagucuauccggaacaauacguacgaucacacccaguauagaacagaaagccugcagaaccgcauucaaaucaacccugucaagcucuccagcggcuacaaagacauuauccugugguuuucuuucggggcuuccugcuuucuucugcucgccauugcgaugggacugguguucaucuguaucaagaauggcaacaugcggugcaccauuuguauc

SEQ ID NO: 43601 - RNA, 1680 nt, Artificial Sequence
  derived and/or modified sequence opt5 from anti-influenza_Chain
auggagagaaucgugcugcuccuggccauugucagccuuguuaaguccgaccagaucugcauuggcuaccacgcuaacaauucuaccgaacaaguggauacaaucauggagaaaaacgugacggucacccaugcccaggacauucuggaaaagacacacaaugggaaacucugugaucuggacggagugaagccccuuauccugcgggauugcagcguugcgggcuggcuccuggggaacccuaugugugacgaguuccugaaugugccggaaugguccuauaucgucgagaaaauuaaccccgcuaaugaucucugcuacccuggaaacuuuaaugacuaugaggaacugaagcaucuucugucucgcaucaaccacuucgagcggauucagaucauucccaagagcuccuggucugaucaugaagccagcuccggcgugagcucugccuguccuuaccaggggagauccagcuuuuuccgcaauguuguguggcucaucaaaaagaacaaugcuuaucccaccauuaaaagaucuuacaacaauacaaaccaagaggaccugcuuguccuguggggaauccaccacccuaacgaugccgcugagcagacccggcucuaucagaauccgacaaccuacaucuccgugggcacgagcacccugaaccagcgccuggugcccaagauugccacaagaucuaaagucaauggccaauccgggcggauggaauuuuucuggaccauccucaagccuaacgacgcgauuaauuuugagagcaacggaaauuucaucgcccccgaaaacgcuuacaagaauugccagaaaggcgauuccacaauuaugaagucugagcuggaauaugggaacuguaauaccaaaugccagacgccuaucggagccaucaacagcuccaugcccuuucauaauauucacccgcuuacaaucggcgaguguccuaaguacguuaaaagcaaccgccuggugcucgcuaccgggcugagaaauucuccccagggagagcggcgcagaaagaaacggggccuuuucggcgccauugcgggguuuaucgaaggaggcuggcaagggaugguggacggaugguauggcuaccaucacuccaacgagcaggggagcggauaugccgcugacaaggaaucuacacagaaggccauugauggcgucaccaacaaagugaauagcaucaucgacaagaugaacacccaauucgaggcuguuggccgcgaauuuaauaaccuggagagacggauugagaaucucaacaaaaagauggaagauggguuccuggacguguggacauacaaugccgagcugcucguccugauggaaaacgagagaacgcuugauuuccacgacuccaaugugaaaaaccuguaugauaagguucgccuccagcugcgggacaaugccaaggaacuuggaaacggcugcuuugaguucuaccauagaugugauaaugagugcauggaaucugugcgcaacgggaccuacgacuauccucaguacagcgaggaagcucggcugaaaagagaggagaucuccggagucaagcucgaaagcauuggcacauaucagauccugucuauuuacuccaccguggcgagcucucuggcccucgcuaucauggucgccgggcugucccuuuggaugugcagcaauggc

SEQ ID NO: 43602 - RNA, 1680 nt, Artificial Sequence; identical to SEQ ID NO: 43598
  derived and/or modified sequence opt5 from anti-influenza_Chain

SEQ ID NO: 43603 - RNA, 1680 nt, Artificial Sequence; identical to SEQ ID NO: 43599
  derived and/or modified sequence opt5 from anti-influenza_Chain

SEQ ID NO: 43604 - RNA, 1680 nt, Artificial Sequence; identical to SEQ ID NO: 43600
  derived and/or modified sequence opt5 from anti-influenza_Chain

SEQ ID NO: 43605 - RNA, 1680 nt, Artificial Sequence; identical to SEQ ID NO: 43601
  derived and/or modified sequence opt5 from anti-influenza_Chain

SEQ ID NO: 43606 - RNA, 1686 nt, Artificial Sequence
  derived and/or modified sequence opt5 from anti-influenza_Chain
augcccagagcccugcggcgcgugccuggcagcagagucaugcuccggguuggggugguggucgcugugcuggcccuuguugcggcucuggccaaccucgccgugccgcgccccgcuagagccgcuggaggcggguacuggcacaccuccggacgggagauccuggacgccaauaacgucccugugcgcauugcgggcaucaauugguucggguuugaaacaugcaacuauguugugcauggacuuuggucuagagauuaccggagcaugcuggaccagauuaagucccucggcuauaauacgauccgccugcccuacucugaugacauucugaaaccuggcaccaugcccaacagcaucaauuucuaucaaaugaaccaggaucuccaggggcugacaucccuucaggucauggacaagaucguggccuacgcuggacaaauuggccugagaaucauucucgaucggcaccgcccugacuguucugggcagagcgcccugugguauaccuccagcgugucugaggcuacauggaucuccgaucuucaggcccuggcgcagagauacaaaggaaauccgaccgucguuggcuuugaccuccauaacgaaccccacgauccugccugcuggggguguggagaccccagcauugauuggcggcuggcugccgagcgcgcuggcaaugccgugcugucugugaacccuaaucuccugaucuucgucgaaggcgugcaauccuacaacggggacagcuauugguggggaggcaaucuucagggggccggacaguaccccguugugcugaacgucccgaacagacucguguauucugcucaugacuacgcgacauccguuuauccucagaccugguuuagcgaucccacguucccuaauaacaugcccggcauuuggaauaagaacuggggguaccuguuuaaucaaaacaucgcccccguguggcuuggagaguucggcaccacacugcaguccaccacagaccagaccuggcucaaaacgcugguccaauaucugcggccuacagcucaguacggcgccgauucuuuucaguggaccuucuggagcuggaauccggacuccggggauacaggaggcauccucaaggacgauuggcagaccguggacaccgucaaggauggguaccuggcccccauuaaaagcucuaucuuugacccugugggagcuuccgccagccccucuagccaaccuucccccucuguuagcccguccccuagccccucuccuuccgcgagcagaacacccacgccuacccccacaccgaccgcuucuccuacacccacccuuacgcccacagccaccccuaccccgacagccucccccaccccuagccccacagcugccuccggcgcucgcugcacggccucuuaucaggugaacagcgauugggggaauggcuucaccgucacaguggcgguuaccaacuccggaucuguggccacaaagaccuggacggucagcuggaccuuuggcgggaaucagacaauuaccaacuccuggaaugcugccgugacacagaacggacaaagcgugaccgcucggaauaugucuuacaacaacguuauccagccuggccagaauacgacauucggguuccaggccuccuauaccggaagcaacgcggcccccacagucgcuugugccgcuucu

SEQ ID NO: 43607 - RNA, 1686 nt, Artificial Sequence
  derived and/or modified sequence opt5 from anti-influenza_Chain
auggagagagugugguggaaggaagccgucguuuaccagaucuauccccggagcuucuacgacuccaacggcgaugggauuggagacauccgcggcauuaucgcuaaacuggauuaucucaaggagcuggggguggacguggucuggcuuucuccuguguacaaaagcccgaaugaugacaacggauaugauauuuccgacuacagagauaucauggacgaauuuggcaccauggccgauuggaagacaaugcuggaggaaaugcacaaacgggggaucaagcucguuauggaccugguggucaaucauacgucugaugagcaccccugguucauugagagccgcaaguccaaagacaacccuuauagagacuacuacaucuggcggcccggaaagaauggcaaagaaccuaacaauugggagucuguguuuagcggcuccgcgugggaauaugaugagaugaccggggaguacuaucuucaucuguucagcaagaaacaacccgaccucaacugggaaaauccuaagguucgcagagagguguacgaaaugaugaaguuuuggcuggauaaaggagucgacggcuuccggauggaugugauuaacaugaucucuaaggugccggagcugcccgacggggaaccucaguccggcaaaaaguaugcuagcggaucucgcuacuauaugaaugggcccagaguccacgaguuucuccaggagaugaaccgggaaguucuguccaaauacgauauuaugacagugggagagaccccuggcgugacacccaaggaaggcauccuuuacaccgacccgagccgcagagagcugaauauggucuuccaguuugaacauauggaucucgacucugggccuggaggcaaaugggauauucggcccuggucccuggccgaccuuaagaagacaaugaccaaauggcaaaaggagcuggaggggaaaggauggaacagccucuaucugaauaaccacgaccagccucgcgccguguccagauucggcgaugacgggaaguaccggguugaaucugcuaaaaugcuggccacguuucuccacaugaugcagggaacccccuauaucuaccagggcgaggaaaucggcaugacaaacgugagauuccccagcauugaggauuaucgcgacaucgaaacccugaauauguacaaggagcgggucgaggaauauggggaggauccucaagaagugauggagaagauuuacuacaaaggaagagacaacgcucgcacaccgaugcagugggaugacuccgagaaugccggcuuuaccgcggggacgcccuggaucccuguuaaccccaauuauaaggaaauuaacgugaaagccgcucuugaggauccuaauagcgucuuccauuacuauaagaaacugauccagcuccggaagcagcacgacaucauuguguacggaacauaugaucugauccuugaagacgaucccuacauuuauagauacacccgcacacugggcaacgagcaacucaucgucauuaccaauuucucugaaaagaccccgguguuucggcugccugaccauaucaucuacaaaacaaaggagcugcucauuuccaacuaugacguugaugaggccgaggaacugaaagaaaucagacuucgccccugggaggcucggguguacaagauuagacugccu

SEQ ID NO: 43608 - RNA, 1686 nt, Artificial Sequence; identical to SEQ ID NO: 43606
  derived and/or modified sequence opt5 from anti-influenza_Chain

SEQ ID NO: 43609 - RNA, 1686 nt, Artificial Sequence; identical to SEQ ID NO: 43607
  derived and/or modified sequence opt5 from anti-influenza_Chain

SEQ ID NO: 43610 - RNA, 1689 nt, Artificial Sequence
  derived and/or modified sequence opt5 from anti-influenza_Chain
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaaagcacaaugggaaacugugugaucucgacggagugaagccccugauccuuagagauugcagcguugcgggcuggcugcucgggaacccuaugugugacgaauuuaucaaugugccggaaugguccuauauugucgagaaggcuaaccccgugaaugaucugugcuacccuggagacuucaacgauuaugaggaacugaaacaucuccugucucggaucaaucacuuugagaagauucagaucauucccaaaagcuccuggucuagccaugaagccucccuuggcguuagcucugccuguccuuaccaggggaagacauccuucuuucgcaacguggucuggcugaucaaaaagaauagcaccuaucccacaauuaagagaucuuacaacaauaccaaccaagaggaccuccuggugcuuuggggaauccaccacccuaaugaugcugccgagcagacaaaacuguaucagaacccgaccacguacaucuccgugggcaccagcacacucaaccagcggcuggucccccgcauugcuaccagaucuaagguuaauggccaauccgggcggauggaguucuuuuggacaauccugaaaccuaacgacgccauuaauuucgaaagcaacggaaauuuuaucgcgcccgaauacgccuauaagauugugaaaaagggcgauuccaccaucaugaaaucugagcucgaauacgggaacugcaauacgaagugucagacaccuaugggagcuaucaacagcuccaugcccuuccauaauauucacccgcugaccaucggcgagugcccuaaguaugugaaaagcaaccgccuuguccuggccacagggcucagaaauucuccccagcgggagacccgcggacuguuuggcgcuauugccggcuucaucgaagggggauggcagggcaugguggacgggugguacggauaucaucacuccaacgagcaaggcagcggguacgcggccgacaaggaaucuacccagaaagcuauugauggaguuacaaauaaggugaacagcaucaucgacaaaaugaauacgcaguuugaggccgucggcagagaguucaacaaccuugaacggcgcauugagaaucugaacaagaagauggaagauggcuuccucgacguguggaccuauaaugcugagcugcugguucucauggaaaacgagagaacacuggauuuucacgacuccaaugugaaaaaccuuuacgauaagguccggcugcaacuccgcgacaaugccaaagaacuggggaacggauguuucgaguuuuaccauaagugcgauaaugaguguauggaaucugugagaaacggcaccuaugacuacccucaguauagcgaggaagcccggcuuaaaagagaggagaucuccggggucaagcuggaaagcauuggaaucuaccagauucucucuaucuauuccacaguggcuagcucucuggcgcuggccauuaugguugcuggccucucccuguggaugugcagcaaugggucccuucagugccgcaucugu

SEQ ID NO: 43611 - RNA, 1689 nt, Artificial Sequence; identical to SEQ ID NO: 43610
  derived and/or modified sequence opt5 from anti-influenza_Chain

SEQ ID NO: 43612 - RNA, 1692 nt, Artificial Sequence
  derived and/or modified sequence opt5 from anti-influenza_Chain
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcuguguagccucaacggagugaaaccccugauccuuagagauugcuccguugcgggcuggcugcucgggaauccuaugugugacgaguuucugaacgugccggaauggucuuauaucgucgagaaggauagccccauuaauggacugugcuacccuggcgacuucaacgauuaugaggaacucaagcaucugcuuuccucuaccaaucacuuugagaaaauccagauuaucccccggagcuccuggagcgaccaugaugcuucuuccggggugagcucugccuguccuuacaacggacgcuccagcuucuuuagaaauguuguguggcugauuaagaaaaacaaugccuaucccacaaucaagcggaacuacaauaacaccaaccaggaagaccuccugguccuuuggggcauucaccacccuaaugaugcuacagagcaaaccaaacuguaucagaacccgacgaccuacgugucugugggcacauccacccucaaucagcgcagcguccccgagaucgccacaagaccuaagguuaacgggcaguccggacggaucgaguucuuuuggaccauucugaagcccaaugacgcuaucaacuucgaaucuaauggcaacuuuauugccccugaauacgcguauaaaaucgccaagaaaggggauagcgcuauuaugaaguccggacuggaguacggcaauugcaacacgaaaugucaaacacccaugggggccaucaauagcucuaugccguuccauaacauccacccucucaccauuggagaaugcccccgcuaugugaaguccgacagacuggugcuugcuacaggccugcggaaugucccucagcgcgagaccagaggccucuuuggggccaucgcgggauucauugagggcggguggcagggaaugguggacggcugguacggguaucaucacagcaacgaacagggaucuggcuacgccgcugauaaagagagcacccaaaaggccaucgacggcauuacaaauaagguuaacuccaucaucgauaaaaugaacacgcaguuugaagcuguggggaaggaguucaauaaccuggaacggcgcauugagaaucuuaacaaaaagauggaggacggauuccuggaugucuggaccuauaaugccgaacuccuggugcugauggagaacgaaagaacacucgacuuucacgauucuaauguuaaaaaccuguacgacaaggugcggcuucagcugcgcgauaaugccaaggagcucggcaacggguguuucgaauuuuaccauaaaugcgacgaugaguguauggagagcgucagaaauggaaccuaugacuacccccaauauuccgaagaggcucggcugaacagagaagagaucagcggcgugaaacuugagucuauugggacauaccagauccuguccauuuauagcaccgucgcgucuucccucgcccuggcuaucaugguggccggccugagcuucuggaugugcuccaauggaucucuccagugccgcauuuguauc

SEQ ID NO: 43613 - RNA, 1692 nt, Artificial Sequence; identical to SEQ ID NO: 43612
  derived and/or modified sequence opt5 from anti-influenza_Chain

SEQ ID NO: 43614 - RNA, 1695 nt, Artificial Sequence
  derived and/or modified sequence opt5 from anti-influenza_Chain
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaaagcacaaugggaaacugugugaucucgacggagugaagccccugauccuuagagauugcagcguugcgggcuggcugcucgggaacccuaugugugacgaauuuaucaaugugccggaaugguccuauauugucgagaaggcuaaccccgugaaugaucugugcuacccuggagacuucaacgauuaugaggaacugaaacaucuccugucucggaucaaucacuuugagaagauucagaucauucccaaaagcuccuggucuagccaugaagccucccuuggcguuagcucugccuguccuuaccaggggaaguccagcuucuuucgcaacguggucuggcugaucaaaaagaacucuacauaucccaccauuaagagauccuacaauaauacaaaccaagaggaccuccuggugcuuuggggaauccaccacccuaaugaugcugccgagcagaccaaacuguaucagaacccgacaaccuacaucagcgugggcacgucuacccucaaccagcggcuggucccccgcauugcuacaagauccaagguuaauggccaaagcgggcggauggaguucuuuuggaccauccugaaaccuaacgacgccauuaauuucgaauccaacggaaauuuuaucgcgcccgaauacgccuauaagauugugaaaaagggcgauucuacaaucaugaaaagcgagcucgaauacgggaacugcaauaccaagugucagacgccuaugggagcuaucaacuccagcaugcccuuccauaauauucacccgcugacaaucggcgagugcccuaaguaugugaaaucuaaccgccuuguccuggccaccgggcucagaaauagcccccagcgggagcgcagacggaagaaacgcggacuguuuggcgcuauugccggcuucaucgaagggggauggcagggcaugguggacgggugguacggauaucaucacuccaacgagcaaggcucuggguacgcggccgacaaggaaagcacacagaaagcuauugauggaguuaccaauaaggugaacuccaucaucgacaagaugaauacccaguuugaggccgucggcagagaguucaacaaccuugaacggcgcauugagaaucugaacaaaaagauggaagauggcuuccucgacguguggacauauaaugcugagcugcugguucucauggaaaacgagagaacgcuggauuuucacgacucuaaugugaaaaaccuuuacgauaagguccggcugcaacucagagacaaugccaaagaacuggggaacggauguuucgaguuuuaccauaagugcgauaaugaguguauggaaagcgugcgcaacggcaccuaugacuacccucaguauuccgaggaagcccggcuuaagagagaggagaucagcggggucaaacuggaaucuauuggaaucuaccagauucucuccaucuauagcacaguggcuucuucccuggcgcuggccauuaugguugcuggccucagccuguggaugugcuccaaugggucucuucagugccgc

SEQ ID NO: 43615 - RNA, 1695 nt, Artificial Sequence
  derived and/or modified sequence opt5 from anti-influenza_Chain
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggucuagccaugaagccucccuuggcguuagcucugccuguccuuaccaggggaaauccagcuucuuucgcaacguggucuggcugaucaagaaaaauucuaccuaucccacaauuaagagauccuacaacaauaccaaccaagaggaccuccuggugcuuuggggaauccaccacccuaaugaugcugccgagcagacaaagcuguaucagaacccgaccacguacaucagcgugggcaccucuacacucaaccagcggcuggucccccgcauugcuaccagauccaaaguuaauggccaaagcgggcggauggaguucuuuuggacaauccugaagccuaacgacgccauuaauuucgaauccaacggaaauuuuaucgcgcccgaauacgccuauaaaauugugaagaaaggcgauucuaccaucaugaaaagcgagcucgaauacgggaacugcaauacgaaaugucagacaccuaugggagcuaucaacuccagcaugcccuuccauaauauucacccgcugaccaucggcgagugcccuaaguaugugaagucuaaccgccuuguccuggccacagggcucagaaauagcccccagcgggagcgcagacggaaaaagcgcggacuguuuggcgcuauugccggcuucaucgaagggggauggcagggcaugguggacgggugguacggauaucaucacuccaacgagcaaggcucuggguacgcggccgacaaagaaagcacccagaaggcuauugauggaguuaccaauaaagugaacuccaucaucgacaagaugaauacacaguuugaggccgucggcagagaguucaacaaccuugaacggcgcauugagaaucugaacaagaaaauggaagauggcuuccucgacguguggacguauaaugcugagcugcugguucucauggaaaacgagagaacccuggauuuucacgacucuaaugugaagaaccuuuacgauaaaguccggcugcaacucagagacaaugccaaggaacuggggaacggauguuucgaguuuuaccauaaaugcgauaaugaguguauggaaagcgugcgcaacggcacauaugacuacccucaguauuccgaggaagcccggcuuaagagagaggagaucagcggggucaagcuggaaucuauuggaaucuaccagauucucuccaucuauagcaccguggcuucuucccuggcgcuggccauuaugguugcuggccucagccuguggaugugcuccaaugggucucuucagugccgc

SEQ ID NO: 43616 - RNA, 1695 nt, Artificial Sequence
  derived and/or modified sequence opt5 from anti-influenza_Chain
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucugcuuguccuuaccaggggaaauccagcuuuuuccgcaauguuguguggcugaucaagaaaaacucuuccuaucccaccauuaagagaagcuacaauaacacaaaucaagaggaccuccugguccuuuggggaauccaccacccuaacgaugccgcugagcagacccggcuguaucagaacccgacaaccuacaucucugugggcacguccacccucaaucagcgccuggugcccaagauugccacaagaagcaaagucaacggccaauccgggcggauggaauuuuucuggaccauccugaagccuaaugacgcgauuaacuuugagucuaauggaaacuucaucgcccccgaauacgcuuauaaaauuguuaagaaaggcgauagcgccaucaugaaguccgagcucgaauacgggaauugcaacacaaaaugucagaccccuaugggagcuaucaauagcucuaugcccuuucauaacauucacccgcugacgaucggcgagugcccuaaguaugugaaguccaaucgccuugugcuggccacagggcucagaaacagcccccagcgggagcgcagacggaaaaagcgcggacuguucggcgcgauugccggcuuuaucgaagggggauggcagggcauggucgacgggugguacggauaucaucacucuaaugagcaaggcagcggguacgcugccgacaaagaauccacccagaaggcuauugauggagugacaaacaaaguuaauucuaucaucgacaagaugaacacccaguucgaggccgugggcagagaauuuaacaaucuugagcggcgcauugagaaccugaauaagaaaauggaagauggcuuccucgacgucuggaccuauaacgccgagcugcuggugcucauggaaaaugagagaacacuggauuuccacgacagcaacguuaagaaucuuuacgauaaagugcggcugcaacucagagacaacgcuaaggaacuggggaauggauguuuugaguucuaccauaaaugcgauaacgaguguauggaauccguccgcaauggcacguaugacuacccucaguauagcgaggaagcgcggcuuaagagagaggagaucucuggggugaagcuggaauccauuggaaucuaccagauucucagcaucuauucuaccgucgccuccagccuggcucuggccauuaugguggccggccucucccuguggaugugcucuaacgggagccuucagugccgc

SEQ ID NO: 43617 - RNA, 1695 nt, Artificial Sequence
  derived and/or modified sequence opt5 from anti-influenza_Chain
augagcgacagacggcagaaccgcaagacccccgaugagcaaagaaaagccaaugcucugaucauuaacgaaaauaucgaggccuacauugcgaucugcaaggaagugggccucaacggggacgagaugcugauucuugaaaauggaaucgcuaucgagaaagccauucggaucuguugcgauggcaaguaucaggagaaacgcgaaaagaaggccagagaggcucagcgggccgacuccaacuucaaugcugauucuauugggauccgccuggucaaaagagccggaagcggcacaaacauuacguaccacgcgguuguggaacucaccucccggucucgcaucgugcagauucuuaagagccauugggggaaugagcugaacagagccaaaaucgcuggaaagcggcugggcuuuuccgcccucuucgcuucuaaucuggaggccaucauuuaucaacgcggcagaaacgcggcccggcgcaaugggagcgcugaacuguuuacacucacccagggagccggcaucgagacaagauacaaauggauuauggaaaagcacaucgggauuggaguccugaucgcugacgccaagggccuuaucaacgggaaacgggagggaaagagaggcguggaugccaauguuaaacugcgcgcuggcaccacaggguccccucucgaacgggcgaugcagggaauugagaagaaagccuucccgggcccccugagagcucuugcccgccggguggucaaggccaacuauaacgacgcuagagaggcccugaaugugaucgcggaagcuagccuccugcugaaaccucagauuaccaacaagaugacgaugcccugguguauguggcucgccgcccgccugacccuuaaggaugaguuugcuaauuucugcgccuacgcugggcggagagccuuugaaguuuucaacaucgcgauggagaaaauuggaaucuguucuuuucaaggcacaaucaugaaugacgaugaaauugaguccaucgaggacaaggcccaggugcugaugauggcuugcuucgggcucgccuaugaagauuuuagccuggucucugcuauggugucccauccucuuaaacugcgcaaccggaugaagauuggaaauuucagagugggcgagaaagucagcaccguucucucuccccugcugcgcuuuacacggugggccgaguucgcgcagagauucgcccuccaggcuaacaccucccgggagggcgcccaaaucagcaauuccgcuguguuugccguggaacgcaagauuacgacagacguccagagaguggaggagcugcuuaacaagguucaggcccacgaagacgagccucugcaaacccucuacaaaaaggugcgggaacagaucucuauuaucgggagaaauaaaagcgagaucaaggaguuccugggauccagcauguacgaucuuaacgaccaggaaaaacagaauccgauuaacuuucgcucuggcgcucaucccuucuuuuucgaguuugauccugacuauaaucccauccgggucaagagaccuaagaaacccauugcgaagcgcaacuccaacaucagcagacuggaagaggaagggauggaugaaaauucugagauuggacaagccaaaaagaugaaaccgcucgaccagcugacaagcaccuccucuaacaucccuggcaagaau

SEQ ID NO: 43618 - RNA, 1695 nt, Artificial Sequence
  derived and/or modified sequence opt5 from anti-influenza_Chain
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuaccauuggacccuucuggagcccggagacacgauuaucuuugaagcgaauggcaaccucauugccccucgguaugcuuucacacugucccgcggguuuggaagcggcaucauuaauucuaacgcccccauggauaagugugacgcuaaaugccagaccccgcaaggcgccaucaauuccagccuuccuuuccagaacgugcaccccgucacaaucggggaguguccuaaguacgugagaucugcgaaacugcggaugguuaccggacuccgcaauauucccagcauccaguccagaggccuguuuggggccauugcuggauucaucgaaggcggguggaccggaaugguggauggcugguauggcuaccaccaucagaacgagcaagggucuggauaugccgcugaccaaaagagcacacagaaugccauuaacggcaucacgaauaaagucaacuccgugaucgaaaagaugaauacccaguuuacagccguugggaaggaguucaacaaacuggagcggcgcauggaaaaccucaauaagaaaguggaugacggauucauugauaucuggaccuacaacgcugagcugcuuguccugcucgaaaaugagagaacacuggacuuucacgacagcaacgugaagaaucuuuacgaaaaagucaagucucagcugaagaacaaugcgaaagagauuggcaacgggugcuucgaguuuuaucauaaguguaaugaugaaugcauggaguccgugaaaaacggcaccuacgacuaucccaaguacagcgaagagucuaaacucaaucgggagaagaucgauggaguuaagcuggaauccaugggcguguaucagauucuggccaucuacagcacggucgcuuccucucucgugcugcuuguuagccugggggccaucuccuucuggaugugcucuaacggaagccuccagugucgcauuugcauc

SEQ ID NO: 43619 - RNA, 1695 nt, Artificial Sequence
  derived and/or modified sequence opt5 from anti-influenza_Chain
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaaacccuguaccauacagagaaugccuacgugagcgucguuuccucucacuauagcagaaaguucacccccgaaauugcuaagcggccuaaagugcgcgaucaggaggggagaaucaacuacuauuggacgcuucuggagcccggagacacaauuaucuuugaagccaauggcaaccucauugcgccucgguacgccuucgcucugucccgcggguuuggaagcggcaucauuaauucuaacgcccccauggauaagugugacgcuaaaugccagaccccgcaaggcgccaucaauuccagccuuccuuuccagaacgugcaucccgucacaaucggggaguguccuaaguaugugagaucugcgaaacugcggaugguuaccggacuccgcaauauucccagcauccaguccagaggccuguuuggggccauugcuggauucaucgaaggcggguggaccggaaugguggauggcugguacggcuaucaccaccagaacgagcaagggucuggauacgccgcugaccaaaagagcacacagaaugccauuaacggcaucacgaauaaagucaacuccgugaucgaaaagaugaauacccaguuuacagccguugggaaggaguucaacaaacuggagcggcgcauggaaaaccucaauaagaaaguggaugacggauucauugauaucuggaccuacaacgcugagcugcuuguccugcucgaaaaugagagaacacuggacuuucaugacagcaacgugaagaaucuuuaugaaaaagucaagucucagcugaagaacaaugcgaaagagauuggcaacgggugcuucgaguuuuaccacaaguguaaugaugaaugcauggaguccgugaaaaacggcaccuaugacuaccccaaguauagcgaagagucuaaacucaaucgggagaagaucgauggaguuaagcuggaauccaugggcguguaccagauucuggccaucuauagcacggucgcuuccucucucgugcugcuuguuagccugggggccaucuccuucuggaugugcucuaacggaagccuccagugucgcauuugcauc

SEQ ID NO: 43620 - RNA, 1695 nt, Artificial Sequence
  derived and/or modified sequence opt5 from anti-influenza_Chain
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccggacaucggcgaucagaaaacccuguaccauacagagaacgccuacgugagcgucguuuccucucacuauagcagaaaguucacccccgaaauugcuaagcggccuaaagugcgcgaccaggaggggagaaucaauuacuauuggacgcuucuggagcccggagauacaauuaucuuugaagccaacggcaaucucauugcgccucgguacgccuucgcucugucccgcggguuuggaagcggcaucauuaacucuaaugcccccauggacaagugugaugcuaaaugccagaccccgcaaggcgccaucaacuccagccuuccuuuccagaaugugcaucccgucacaaucggggaguguccuaaguaugugagaucugcgaaacugcggaugguuaccggacuccgcaacauucccagcauccaguccagaggccuguuuggggccauugcuggauucaucgaaggcggguggaccggaaugguggacggcugguacggcuaucaccaccagaaugagcaagggucuggauacgccgcugaucaaaagagcacacagaacgccauuaauggcaucacgaacaaagucaauuccgugaucgaaaagaugaacacccaguuuacagccguugggaaggaguucaauaaacuggagcggcgcauggaaaaccucaacaagaaaguggacgauggauucauugacaucuggaccuacaaugcugagcugcuuguccugcucgaaaacgagagaacacuggacuuucaugauagcaaugugaagaaccuuuaugaaaaagucaagucucagcugaagaauaacgcgaaagagauuggcaaugggugcuucgaguuuuaccacaaguguaacgacgaaugcauggaguccgugaaaaauggcaccuaugauuaccccaaguauagcgaagagucuaaacucaaccgggagaagaucgacggaguuaagcuggaauccaugggcguguaccagauucuggccaucuauagcacggucgcuuccucucucgugcugcuuguuagccugggggccaucuccuucuggaugugcucuaauggaagccuccagugucgcauuugcauc

SEQ ID NO: 43621 - RNA, 1695 nt, Artificial Sequence
  derived and/or modified sequence opt5 from anti-influenza_Chain
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaagugugacgccaaaugccagacaccgcaaggcgcgaucaauuccagccuuccuuuccagaacgugcaucccgucaccaucggggaguguccuaaguaugugagaucugccaaacugcggaugguuacaggacuccgcaauauucccagcauccaguccagaggccuguuuggggcuauugccggauucaucgaaggcggguggaccggaaugguggauggcugguacggcuaucaccaccagaacgagcaagggucuggauacgcugccgaccaaaagagcacccagaaugccauuaacggcaucacaaauaaagucaacuccgugaucgaaaagaugaauacgcaguuuaccgcuguugggaaggaguucaacaaacuggagcggcgcauggaaaaccucaauaagaaaguggaugacggauucauugauaucuggacauacaacgcggagcugcuuguccugcucgaaaaugagagaacccuggacuuucaugacagcaacgugaagaaucuuuaugaaaaagucaagucucagcugaagaacaaugccaaagagauuggcaacgggugcuucgaguuuuaccacaaguguaaugaugaaugcauggaguccgugaaaaacggcacauaugacuaccccaaguauagcgaagagucuaaacucaaucgggagaagaucgauggaguuaagcuggaauccaugggcguguaccagauucuggcuaucuauagcaccgucgccuccucucucgugcugcuuguuagccugggggccaucuccuucuggaugugcucuaacggaagccuccagugucgcauuugcauc

SEQ ID NO: 43622 - RNA, 1695 nt, Artificial Sequence
  derived and/or modified sequence opt5 from anti-influenza_Chain
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgcuagcugcucucacaacggcaaguccagcuuuuaccgcaaucugcuuuggcugaccggcaaaaacgggcucuaucccaaucugucuaaguccuacguuaacaauaaagaaaaggaggugcugguccucuggggagugcaucacccuccgaacaucggcaaccagagagcccuguaccacacagaaaaugcuuaugugagcgucguuuccucucauuacagccggcgcuucacccccgagauugccaaaagaccuaaggugcgggaucaggaagggcgcaucaacuauuacuggacgcuucuggagcccggagacacaauuaucuuugaggcgaauggcaaccucauugccccuugguaugcuuucgcccuguccagaggguuuggaagcggcaucauuaccucuaaugcucccauggaugaaugugacgccaagugccagacaccgcaaggcgcgaucaacuccagccuuccuuuccagaaugugcaccccgucaccaucggggaguguccuaaauacgugcggucugccaagcugcgcaugguuaccggacucagaaacauucccagcauccagucccggggccuguuuggggcuauugccggauucaucgaaggcggguggacaggaaugguggauggcugguauggcuaccaucaccagaaugagcaagggucuggauacgcugccgaccagaaaagcacgcagaacgccauuaauggcaucaccaacaaggucaauuccgugaucgaaaagaugaacacacaguuuaccgcuguugggaaagaguucaauaaacuggagcgcagaauggaaaaccucaacaagaagguggaugacggauuccuggauauuuggacauauaaugcggagcuucugguccuccuggaaaacgagcggacccuugacuuucacgacagcaaugugaaaaaccuguacgaaaaggucaaaucucaacucaagaauaacgccaaagagaucggcaaugggugcuucgaguuuuaucauaaguguaacaaugaaugcauggaguccgugaagaacggcacguacgauuaucccaaauacagcgaagagucuaagcugaaucgcgagaaaauugacggaguuaagcuggaauccaugggcguguaucagauccucgcuauuuacagcacagucgccuccucucuggugcuucugguuagccucggggccaucuccuucuggaugugcucuaacggaagccugcaguguagaaucugcauu

SEQ ID NO: 43623 - RNA, 1695 nt, Artificial Sequence
  derived and/or modified sequence opt5 from anti-influenza_Chain
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggagagcucuuggccuaaucacacgaccacaggaguguccgccagcugcucucauaacggcgaauccagcuuuuauaagaaucugcuuuggcugaccggcaaaaacgggcucuaccccaaucugucuaaguccuaugcuaacaauaaagagaaggaaguucuggugcucuggggaguccaccacccuccgaacaucggcgaucagagagcccuguaccauaaagagaacgcuuacgugagcguggucuccucucacuauagccggaaguucacacccgaaauugccaagcgcccuaaaguuagagaccaggaggggcggaucaauuacuauuggacccuucuggagcccggagauacgauuaucuuugaagcgaacggcaaucucauugccccucgcuacgcuuucgcccuguccagaggguuuggaagcggcaucauuaacucuaaugcucccauggacgagugugaugccaagugccagacaccgcaaggcgcgaucaacuccagccuuccuuuccagaaugugcaucccgugaccaucggggaauguccuaaauauguccggucugccaagcugcgcauggugacaggacucagaaacauucccagcauccagucccggggccuguuuggggcuauugccggauucaucgagggcggguggaccggaaugguugacggcugguacggcuaucaccaccagaaugaacaagggucuggauacgcugccgaucagaaaagcacccagaacgccauuaauggcaucacaaacaaggucaauuccgugaucgagaaaaugaacacgcaguuuaccgcuguggggaaggaguucaauaagcuggaacgcagaauggagaaccucaacaaaaagguugacgauggauucauugacaucuggacauacaaugcggaacugcuugugcugcucgagaacgaacggacccuggacuuucaugauagcaaugucaaaaaccuuuaugagaaggugaaaucucaacugaagaauaacgccaaggagauuggcaaugggugcuucgaauuuuaccacaaauguaacgacgagugcauggaauccgucaagaauggcacauaugauuaccccaaauauagcgaggagucuaagcucaaccgcgagaaaaucgacggagugaagcuggaauccaugggcguuuaccagauucuggcuaucuauagcaccguggccuccucucucguccugcuugugagccugggggccaucuccuucuggaugugcucuaauggaagccuccaguguagaauuugcauc

SEQ ID NO: 43624 - RNA, 1677 nt, Artificial Sequence
  derived and/or modified sequence opt5 from anti-influenza_Chain
gacaagaucugcauuggcuaccagagcaccaacuccacagagacgguggauacccugacaaaaaccaauguccccguuacacaagccaaggaacuccugcacaccgagcauaacgggaugcuuugugcuacaaaucugggacacccucucauccuggauaccugcacgauugaaggccuuaucuaugggaacccgucuugugaccugcuccugggaggcagagaguggagcuacauuguggaacggcccuccgccgugaaugggaugugcuauccuggaaacgucgagaaucuggaggaacuccgccugcuuuucucuagcgcguccucuuaccagagagugcagaucuuucccgacaccaucuggaacguuacauauagcggcaccuccagcgcuuguucuaauuccuucuaccggagcaugcgcuggcugacacagaaagauaacaccuauccugugcaagacgcccaguacacgaauaacagaggcaagucuauucucuuuaugugggggaucaaucaucccccuacagauaccguccagacaaaccuguacacccggaccgacacaacgaccuccgugacaaccgaggauauuaaucgcgccuucaaaccgguuaucggacccagaccucuugugaacggccugcaggggcggauugacuauuacuggagcguccucaagcccggacaaacacugcgcgugagaucuaacggcaaucugaucgcuccuugguaugggcacauucucuccggagaaagccauggccggauccugaaguccgaucuuaacucuggcaauugcgugguccagugucagaccgagcgcgggggacugaacacgacacuccccuuucacaauguuagcaaauacgccuucggcaacugcccgaaguaugugggggugaaaucccugaaacuugcugucggaaugagaaaugugccugcccggagcucucgcggccuguuuggggcgaucgccggauucauugagggcggcuggcccgggcucguugcuggaugguacggcuuucagcacuccaacgaccaaggggugggaauggccgcugauagagacagcacccagaaggccaucgacaagauuaccucuaaggucaauaacaucguggauaaaaugaauaagcaguaugaaauuaucgaccaugaguucagcgaaaucgagacacggcugaacaugauuaauaacaaaaucgaugaccaaauucaggauaucugggcguacaaugccgaacugcucguucugcuugagaaccagaagacccuggacgagcacgaugcuaacgugaauaaccucuacaauaaagucaagagagcccugggcuccaacgcuauggaagacgggaaaggcuguuuugagcuuuaucauaagugcgaugaccgcuguauggaaacaauucggaauggaacguacaacagaggcaaguauaaagaggaaucucgccuggagcggcagaagaucgagggggugaaacucgaaagcgagggaaccuacaaguccggcagacuggucccucgcgggagccccggaucuggcuauauccccgaagccccucgggaugggcaagccuacgugagaaaagacggcgaguggguucugcucuccacauuccugggaaagccgauucccaauccucuucugggccucgacagcaccggg

SEQ ID NO: 43625 - RNA, 1677 nt, Artificial Sequence; identical to SEQ ID NO: 43624
  derived and/or modified sequence opt5 from anti-influenza_Chain

SEQ ID NO: 43626 - RNA, 1695 nt, Artificial Sequence; identical to SEQ ID NO: 43617
  derived and/or modified sequence opt5 from anti-influenza_Chain

SEQ ID NO: 43627 - RNA, 1695 nt, Artificial Sequence; identical to SEQ ID NO: 43614
  derived and/or modified sequence opt5 from anti-influenza_Chain

SEQ ID NO: 43628 - RNA, 1695 nt, Artificial Sequence; identical to SEQ ID NO: 43615
  derived and/or modified sequence opt5 from anti-influenza_Chain

SEQ ID NO: 43629 - RNA, 1695 nt, Artificial Sequence; identical to SEQ ID NO: 43616
  derived and/or modified sequence opt5 from anti-influenza_Chain

SEQ ID NO: 43630 - RNA, 1695 nt, Artificial Sequence; identical to SEQ ID NO: 43618
  derived and/or modified sequence opt5 from anti-influenza_Chain

SEQ ID NO: 43631 - RNA, 1695 nt, Artificial Sequence; identical to SEQ ID NO: 43619
  derived and/or modified sequence opt5 from anti-influenza_Chain

SEQ ID NO: 43632 - RNA, 1695 nt, Artificial Sequence; identical to SEQ ID NO: 43620
  derived and/or modified sequence opt5 from anti-influenza_Chain

SEQ ID NO: 43633 - RNA, 1695 nt, Artificial Sequence; identical to SEQ ID NO: 43621
  derived and/or modified sequence opt5 from anti-influenza_Chain

SEQ ID NO: 43634 - RNA, 1695 nt, Artificial Sequence; identical to SEQ ID NO: 43622
  derived and/or modified sequence opt5 from anti-influenza_Chain

SEQ ID NO: 43635 - RNA, 1695 nt, Artificial Sequence; identical to SEQ ID NO: 43623
  derived and/or modified sequence opt5 from anti-influenza_Chain

SEQ ID NO: 43636 - RNA, 1698 nt, Artificial Sequence
  derived and/or modified sequence opt5 from anti-influenza_Chain
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgucuaucgggagccggccccgcauuagagaugucccuucccggaucagcaucuacuggaccauugugaaacccggagacauccugcugauuaacucuaccggcaaucucaucgcuccucgcggguacuuuaagauuagauccggaaagagcucuaucaugcggagcgacgcccccaucggcaaauguaacuccgagugcauuacaccgaauggcucuaucccuaacgauaagcccuuccagaaugugaaccgcauuacguauggggcuuguccuagauacgucaaacagaauacccugaaacuugccacaggaaugcggaacguucccgaaaaacaaacccgcggcaucuuuggggcgauugccggauucaucgagaauggcugggaagggaugguggacggaugguauggcuuuagacaccagaacagcgagggcacagggcaggcugccgaucugaaguccacccaagcugccaucaaucagauuaacggaaaacucaaucggcugaucggcaagacgaacgagaaguuccaccagauugaaaaagaguucagcgaaguggaggggagaauccaggaccuugaaaaguacgucgaggauacaaaaauugaccuguggucuuauaacgccgagcuccugguggcucuggaaaaucaacauaccaucgaucucaccgacuccgagaugaacaagcuguuugaacgcacaaagaagcagcuucgggagaaugcggaagauaugggaaacggcugcuucaagauuuaccacaaaugugacaaugccugcaucgggagcaucagaaacggcaccuaugaucaugacguuuaccgcgacgaggcucugaauaaccgguuucagauuaagggaguggagcucaaaucuggcuacaaggauuggauccuguggauuuccuucgccaucagcugcuuucuucugugugucgcccuccugggguucauuaugugggcuugccagaaaggaaauaucagauguaacaucugcauu

SEQ ID NO: 43637 - RNA, 1698 nt, Artificial Sequence
  derived and/or modified sequence opt5 from anti-influenza_Chain
augaagaccaucauugcccugagcuacauccucugccugguguccgcucagaaauuccccggcaacgacaauucuacagccacgcuuugucuggggcaccaugcggucccuaacggaaccauuguuaagacaaucaccaaugaucaaauugaggugacaaacgcuaccgaacucgugcagagcuccucuacaggcgagaucugcgacagcccgcaccagauccuggauggggaaaauuguacccuuauugacgcccugcucggagauccccagugcgacggcuuucaaaacaaaaagugggaucuguucgucgagagauccaaagccuauucuaauuguuacccuuaugacgugcccgauuacgcuagccugcggucccucguugccagcucugggacgcuggaauuuaacaaugaguccuucaacuggaccggagugacacagaauggcaccagcucugcuugcauccgcagauccaacaauagcuuuuucucucggcuuaacuggcugacacaucucaaguuuaaguauccugcccugaaugucaccaugcccaacaacgaggaguucgacaaacuuuacauuuggggcgugcaccauccugggacggauaaugaccagaucuuucuguaugcgcaggccuccggacgcauuacaguuagcaccaagagaucccaacagacagugaucccgaacauucggucucgccccagaguccggaauaucccuagccgcaucuccauuuacuggaccaucgugaaacccggcgauauucuccugaucaacagcaccgggaaucugauugcuccuagaggauacuucaagauccggucuggcaaauccagcaucaugcgcucugacgcccccauugggaaguguaacagcgaaugcaucacaccgaauggauccauuccuaacgacaagcccuuucagaaugugaacagaaucacguauggcgcuuguccucgguacgucaaacagaauacccucaagcuggccacaggcaugcgcaacguucccgaaaaacaaaccagagggauuuucggagcgaucgccggcuuuaucgagaaugggugggagggaaugguggauggcugguauggguuccggcaccagaacucugaaggaauuggccaggcugccgaccuuaagagcacacaagcugccaucgaucagauuaauggcaaacugaacagacucaucgggaagaccaacgagaaauuccaccagauugaaaaggaguuuuccgaaguggagggacgcauccaggaccuggagaaguacgucgaagauacgaaaauugaccuuuggagcuauaaugccgagcugcucguggcucuggaaaaccaacauacaaucgaucugaccgacucugagaugaauaaacucuucgaaaagaccaagaaacagcugcgggagaacgcggaggauaugggcaaugggugcuuuaagaucuaccacaagugugacaacgccugcauuggauccaucagaaauggcacauaugaucaugacguuuaccgcgacgaagcucuuaacaaucgguuccagauuaaagggguggagcucaagagcggcuacaaagauuggauccuguggauuucuuuugccaucuccugcuuccugcuuugugucgcccugcucggauuuaucaugugggcuugccagaagggcaacauuagauguaauaucugcauu

SEQ ID NO: 43638 - RNA, 1698 nt, Artificial Sequence
  derived and/or modified sequence opt5 from anti-influenza_Chain
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaagaacgagucuuucaauuggaccggagugacacagaacggcaccuccagcgcuugcauccgcagaucuaauaacuccuuuuucagccggcugaauuggcucacacaucugaaguuuaaauauccugcccuuaacgucaccaugcccaauaaggagaaauucgacaagcuguacauuuggggcgugcaccauccugggacggauaacgaccagaucuuucucuaugcgcaggccucuggacgcauuacaguuuccaccaaaagaagccaacagacagugaucccgaacauuggcucccggcugcgcgucagagauauccccucucggaucagcauuuacuggaccaucgugaagccuggggacauucugcucaucaauuccaccggaaaccugauugcuccccgcggcuacuucaagaucagaagcgggaaaucuuccaucaugcggagcgacgccccuauuggaaaguguaauucugaaugcaucacacccaacggcagcauuccgaaugauaaaccuuuucagaacgugaaucgcaucacguauggcgcuugucccagauacgucaagcagaacacccuuaaacuggccacagggaugcggaauguuccugagaagcaaacccgcggaauuuucggcgcgaucgccggguuuaucgaaaacggaugggagggcaugguggacgggugguauggauucagacaccaaaauuccgagggcacaggccaggcugccgaucucaaaucuacccaggcugccauugaccagaucaacgggaagcugaaucggcuuauuggaaagacgaacgaaaaauuccaccagaucgagaaggaauuuagcgagguggaaggccgcauucaggaucuggagaaauacgucgaggacacaaagaucgaucucugguccuauaaugccgaacugcugguggcucucgagaaccaacauaccauugaccugaccgauagcgaaaugaacaaacuuuucgagaagacaaagaaacagcugagagaaaaugcggaggacauggggaacggaugcuuuaagaucuaccacaaaugugauaaugccugcaucggcucuauucggaacgggaccuaugaccaugacguuuacagagaugaggcucucaauaaccgcuuccagaucaagggcguggaacugaaauccggauacaaggacuggauucuuuggaucagcuuugccauuucuugcuuccugcucugugucgcccugcugggcuuuaucaugugggcuugccagaaggggaauauccgguguaacauuugcauc

SEQ ID NO: 43639 - RNA, 1698 nt, Artificial Sequence
  derived and/or modified sequence opt5 from anti-influenza_Chain
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaaguguuacccuuaugacgugcccgauuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugaaguuuaaauauccugcccuuaacgucaccaugcccaauaacgagaaguucgacaaacuguacauuuggggcgugcaccauccugggacggauaacgaccagaucuuucucuaugcgcaggccucuggacgcauuacaguuuccaccaagagaagccaacagacagugaucccgaauauuggcucccggccccgcgucagagauaucccuucucggaucagcauuuacuggaccaucgugaaacccggggacauucugcugaucaacuccaccggaaaucucauugcuccucgcggcuacuucaagaucagaagcgggaagucuuccaucaugcggagcgacgcccccauuggaaaauguaacucugaaugcaucacaccgaauggcagcauuccuaacgauaagcccuuucagaaugugaaccgcaucacguauggcgcuuguccuagauacgucaaacagaauacccugaaacuugccacagggaugcggaacguucccgagaagcaaacccgcggaauuuucggcgcgaucgccggguuuaucgaaaauggaugggagggcaugguggacgggugguauggauucagacaccagaacuccgagggcauuggccaggcugccgaucugaagucuacacaagcugccaucgaccagauuaaugggaaacucaaccggcugaucggaaagaccaaugaaaaguuccaccagauugagaaagaauuuagcgagguggaaggcagaauccaggaucuugagaaguacgucgaggacacgaaaauugaucugugguccuauaacgccgaacuccugguggcucuggagaaccaacauacaaucgaccucaccgauagcgaaaugaauaagcuguucgagaaaaccaagaagcagcuucgcgaaaacgcggaggacauggggaauggaugcuuuaaaaucuaccacaagugugauaacgccugcauuggcucuauccggaaugggacauaugaccaugacguuuacagagaugaggcucugaacaaucgcuuccagauuaaaggcguggaacucaaguccggauacaaagacuggauccuguggauuagcuuugccaucucuugcuuccuucugugugucgcccuccugggcuuuaucaugugggcuugccagaaggggaacauucgguguaauaucugcauu

SEQ ID NO: 43640 - RNA, 1698 nt, Artificial Sequence
  derived and/or modified sequence opt5 from anti-influenza_Chain
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcauuggccaggcugccgaccugaaaucuacacaagcugccaucgaucagauuaaugggaagcucaaccggcugaucggaaaaaccaacgaaaaguuccaccagauugagaaggaauuuagcgagguggaaggcagaauccaggaccuugagaaauacgucgaggauacgaagauugaccugugguccuauaaugccgaacuccugguggcucuggagaaccaacauacaaucgaucucaccgacagcgaaaugaauaaacuguucgagaagaccaaaaagcagcuucgcgaaaacgcggaggauauggggaauggaugcuuuaagaucuaccacaaaugugacaacgccugcauuggcucuauccggaaugggacauaugaucaugacguuuacagagacgaggcucugaacaaucgcuuccagauuaagggcguggaacucaaauccggauacaaggauuggauccuguggauuagcuuugccaucucuugcuuccuucugugugucgcccuccugggcuuuaucaugugggcuugccagaaagggaacauucgguguaauaucugcauu

SEQ ID NO: 43641 - RNA, 1698 nt, Artificial Sequence
  derived and/or modified sequence opt5 from anti-influenza_Chain
augaagaccaucauugcccugagcuacauccucugccugguguucucccagaaacuucccggcaacgacaauucuacagcuacgcugugucucgggcaccaugccgucccuaacggaaccauuguuaagacaaucaccaaugaucaaauugaggugacaaacgcgaccgaacuggugcagagcuccucuacaggcgggaucugcgacagcccgcaccagauccuugauggagagaauuguacccugauugacgcucuccugggcgauccccagugcgacggguuucaaaacaaaaagugggaucuguucgucgaaagauccaaagccuauucuaauuguuacccuuaugacgugcccgauuacgccagccuccggucccugguugcuagcucuggaacgcuugaguuuaacaaugaauccuucaacugggccggcgugacccagaauggcacaagcucugcuugcaagcgcagauccaacaagagcuuuuucucucggcugaauuggcucacccaucugaaauauaaguacccugcccuuaacgucacaaugcccaauaacgagaaauuugacaagcuguauaucuggggagugcaccauccuguuaccgauuccgaccagauuagccucuacgcgcaggccuccgggcgcaucacggugucuacaaaaagaagccaacagaccgucauuccgaacaucggcuaccggccccgcgugagagauauuuccagccggaucucuaucuauuggacaauugugaagccuggggacauccugcugauuaauuccaccggaaaccucaucgcuccccgcggcuacuucaagauuagaagcgggaaaucuagcaucaugcgguccgacgccccuaucggaaaguguaauucugagugcauuacccccaacggcagcaucccgaaugauaaaccuuuucagaacgucaaucgcauuacauauggcgcuugucccagauacguuaagcagaacacgcugaaacuugccaccgggaugcggaaugugccugaaaagcaaacacgcggaaucuucggcgcgauugccggguuuaucgagaacggaugggaaggcaugguggacgggugguauggauucagacaccaaaauuccgagggcaccggccaggcugccgaucugaaaagcacacaggcugccaucaaccagauuaaugggaagcucaaccggcugaucggaaagaccaaugagaaauuucaccagauugaaaaggaguucucugaagucgagggcagaauccaggaccuugaaaaauacguggaggauacgaagauugaccugugguccuauaacgccgagcuccugguugcucuggaaaaccaacauacaaucgaucucaccgacagcgagaugaauaaacuguucgaacgcaccaagaagcagcuucgggagaacgcggaagauauggggaauggaugcuuuaaaauuuaccacaagugugacaacgccugcaucgagucuaucagaaauggcacauacgaucaugacguguaucgcgacgaggcucugaacaaucgguuccagauuaaaggggucgaacucaaguccggcuacaaagauuggauccuguggauuagcuuugccaucuccugcuuccuucuguguguggcccuccugggauuuauuaugugggcuugccagaagggcaacaucagauguaauaucugcauu

SEQ ID NO: 43642 - RNA, 1698 nt, Artificial Sequence
  derived and/or modified sequence opt5 from anti-influenza_Chain
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacgacgaaucuuucaauuggaccggcgugacacagaacggcaccuccagcucuugcaagcgcagauccaauaacagcuuuuucucucggcugaauuggcucacacaucugaaguuuaaauauccugcucuuaacgucaccaugcccaauaacgagaaguucgauaaacuguacaucuggggagugcaccauccuguuacggacaacgaucagauuuuucucuaugcccaggcguccgggcgcaucacagugagcaccaagagaucccaacagacagucauuccgaauaucggcucucggccccgcauuagaaacaucccuagccggaucuccauuuacuggaccaucgugaaacccggggacauucugcugaucaauagcaccggaaaccucauugccccucgcggcuacuucaagaucagaucugggaaguccagcaucaugcggucugacgcucccauuggaaaauguaauagcgagugcaucacaccgaacggcuccauuccuaaugauaagcccuuucagaacgugaaucgcaucacguauggcgccuguccuagauacgucaaacagaacacccugaagcuggcuacagggaugcggaauguucccgaaaaacaaacccgcggaauuuucggcgccaucgcgggguuuaucgagaacggaugggaaggcaugguggacgggugguauggauucagacaccaaaauucugagggcauuggccaggccgcugaucuuaagagcacacaggccgcuaucaaccagauuaaugggaaacucaaccggcugaucggaaagaccaacgagaaguuccaccagauugaaaaagaguuuuccgaaguggagggcagaauccaggaccuugaaaaguacgucgaggauacgaaaauugaccuguggagcuauaaugccgagcuccugguggcccuggaaaaccaacauacaaucgaucucaccgacucugagaugaauaagcuguucgaacgcaccaaaaagcagcuucgggagaacgcugaagauauggggaauggaugcuuuaagaucuaccacaaaugugacaacgcgugcauuggcuccaucagaaaugggacauaugaucaugacguuuaccgcgacgaggcccugaacaaucgguuccagauuaagggcguggagcucaaaagcggauacaaggauuggauccuguggauuucuuuugcuaucuccugcuuccuucugugugucgcccuccugggcuuuaucaugugggccugccagaaagggaacauuagauguaauaucugcauu

SEQ ID NO: 43643 - RNA, 1698 nt, Artificial Sequence
  derived and/or modified sequence opt5 from anti-influenza_Chain
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguucaucaaugugccggaaugguccuauauugucgagaaggcuaaccccaccaaugaucugugcuacccuggaucuuuuaacgacuaugaggaacucaagcaucugcuuagccggaucaaucacuucgagaaaauucagaucauucccaaguccucuuggagcgaucaugaagccuccagcggcgugucuuccgccuguccuuaccuggggagccccuccuuuuuccgcaacguuguguggcucaucaaaaagaacucuacauauccuaccauuaaaaagagcuacaauaauacaaaccaggaggaccugcuuguccuguggggaauccaccacccgaaugaugcugccgagcaaaccagacucuaucagaaccccacgaccuacaucucuauuggcacauccacccugaaccagcggcuggugccuaagaucgcuacacgcagcaaagugaauggccaguccgggagaauggaauuuuucugggccauucucaagcccaacgacgcgaucaauuuugagucuaacggaaauuucauugccccugaauacgcuuauaaaaucgucaagaaaggcgauagcgccaucaugaaguccgagcuggaauacgggaacugcaauaccaaaugucaaacgcccaugggagcuauuaacagcucuaugccguuucauaauauccacccucuuacaauuggcgagugccccaaguauguuaaguccaaccggcuggugcucgccaccgggcugcgcaauagcccucagagagagucucggcgcaaaaagagaggacuuuucggcgcgaucgccggcuuuauugaagggggauggcagggcaugguggacgggugguacggauaucaucacagcaacgagcagggcuccggguacgcugccgacaaagaaucuacacaaaaggcuaucggagucaccaauaaagugaacagcaucauugauaagaugaauacccaguucgaggccguuggccgggaauuuaacaaccuggagcgcagaaucgagaaucucaacaagaaaauggaagacggcuuccuggauguguggacauauaaugccgagcugcucguccugauggaaaacgagcggacgcuugacuuccacgauuccaaugugaagaaccuguacgacaaaguucgccuccagcugagagauaaugcuaaggaacuugggaacggauguuuugaguucuaccauaaaugcgacaaugaguguauggaaagcauucggaacggcaccuauaauccccaauacucugaggaagcgagacugaagcgcgaggagaucuccggggugaagcucgaaagcauuggaacauaucagauccugucuauuuacuccaccgucgccagcucccuggcucucgccaucaugaucgccggccugucucuuuggaugugcagcaacgggucccugcagugccggauuuguauc

SEQ ID NO: 43644 - RNA, 1698 nt, Artificial Sequence
  derived and/or modified sequence opt5 from anti-influenza_Chain
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauu

SEQ ID NO: 43645 - RNA, 1698 nt, Artificial Sequence
  derived and/or modified sequence opt5 from anti-influenza_Chain
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaucccccuaccuccgccgaucaacagucucucuaccagaacgcugacgccuacguguucgugggcagcuccagauauagcaagaaauuuaagccggagauugcuauccggcccaaaguccgcgaucaggaggggagaaugaauuacuauuggacacugguugaaccuggagacaagauuaccuucgaggccacgggcaaccugguggugccccgguacgcguuugccauggaacgcaacgcugggucuggaaucauuaucuccgauacaccuguccacgacugcaauaccacaugucaaacccccaaaggcgccaucaacaccagccucccguuccagaauauucacccuaucacaauuggcaagugccccaaguaugugaaaucuacgaagcugagacuugcuaccgggcugcggaacaucccuagcauucagucccgcggacucuuuggcgccaucgccggguucaucgagggaggcuggacagggaugguugacggaugguacggcuaucaucaccagaaugaacaaggcucuggguacgcugcggaucugaaaagcacccagaacgccauugacgagaucacaaauaaggugaacuccgucauugagaaaaugaauacccaguuuacggcugugggaaaggaguucaaccaccuugagaagagaaucgaaaaucugaacaaaaagguugaugacggcuuccucgauauuuggacauacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauaccuguauggaauccgucaaaaacggcacauacgauuaucccaaguacagcgaggaagcuaaacugaauagagaggagaucgacggggugaaacuugaaucuacccggauuuaucaaauccuggccauuuacuccacaguugcgagcucccucgugcuggucgugucucugggcgcuaucagcuuuuggaugugcuccaacggaucucuccagugccgcauuuguauc

SEQ ID NO: 43646 - RNA, 1698 nt, Artificial Sequence; identical to SEQ ID NO: 43643
  derived and/or modified sequence opt5 from anti-influenza_Chain

SEQ ID NO: 43647 - RNA, 1698 nt, Artificial Sequence; identical to SEQ ID NO: 43636
  derived and/or modified sequence opt5 from anti-influenza_Chain

SEQ ID NO: 43648 - RNA, 1698 nt, Artificial Sequence; identical to SEQ ID NO: 43644
  derived and/or modified sequence opt5 from anti-influenza_Chain

SEQ ID NO: 43649 - RNA, 1698 nt, Artificial Sequence; identical to SEQ ID NO: 43645
  derived and/or modified sequence opt5 from anti-influenza_Chain

SEQ ID NO: 43650 - RNA, 1698 nt, Artificial Sequence; identical to SEQ ID NO: 43637
  derived and/or modified sequence opt5 from anti-influenza_Chain

SEQ ID NO: 43651 - RNA, 1698 nt, Artificial Sequence; identical to SEQ ID NO: 43638
  derived and/or modified sequence opt5 from anti-influenza_Chain

SEQ ID NO: 43652 - RNA, 1698 nt, Artificial Sequence; identical to SEQ ID NO: 43639
  derived and/or modified sequence opt5 from anti-influenza_Chain

SEQ ID NO: 43653 - RNA, 1698 nt, Artificial Sequence; identical to SEQ ID NO: 43640
  derived and/or modified sequence opt5 from anti-influenza_Chain

SEQ ID NO: 43654 - RNA, 1698 nt, Artificial Sequence; identical to SEQ ID NO: 43641
  derived and/or modified sequence opt5 from anti-influenza_Chain

SEQ ID NO: 43655 - RNA, 1698 nt, Artificial Sequence; identical to SEQ ID NO: 43642
  derived and/or modified sequence opt5 from anti-influenza_Chain

SEQ ID NO: 43656 - RNA, 1683 nt, Artificial Sequence
  derived and/or modified sequence opt5 from anti-influenza_Chain
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggucuagccaugaagccucccuuggcguuagcucugccuguccuuaccaggggaaauccagcuucuuucgcaacguggucuggcugaucaagaaaaauucuaccuaucccacaauuaagagauccuacaacaauaccaaccaagaggaccuccuggugcuuuggggaauccaccacccuaaugaugcugccgagcagacaaagcuguaucagaacccgaccacguacaucagcgugggcaccucuacacucaaccagcggcuggucccccgcauugcuaccagauccaaaguuaauggccaaagcgggcggauggaguucuuuuggacaauccugaagccuaacgacgccauuaauuucgaauccaacggaaauuuuaucgcgcccgaauacgccuauaaaauugugaagaaaggcgauucuaccaucaugaaaagcgagcucgaauacgggaacugcaauacgaaaugucagacaccuaugggagcuaucaacuccagcaugcccuuccauaauauucacccgcugaccaucggcgagugcccuaaguaugugaagucuaaccgccuuguccuggccacagggcucagaaauagcccccagcgggagcgcagacggaaaaagcgcggacuguuuggcgcuauugccggcuucaucgaagggggauggcagggcaugguggacgggugguacggauaucaucacuccaacgagcaaggcucuggguacgcggccgacaaagaaagcacccagaaggcuauugauggaguuaccaauaaagugaacuccaucaucgacaagaugaauacacaguuugaggccgucggcagagaguucaacaaccuugaacggcgcauugagaaucugaacaagaaaauggaagauggcuuccucgacguguggacguauaaugcugagcugcugguucucauggaaaacgagagaacccuggauuuucacgacucuaaugugaagaaccuuuacgauaaaguccggcugcaacucagagacaaugccaaggaacuggggaacggauguuucgaguuuuaccauaaaugcgauaaugaguguauggaaagcgugcgcaacggcacauaugacuacccucaguauuccgaggaagcccggcuuaagagagaggagaucagcggggucaagcuggaaucuauuggaaucuaccagauucagcacuccggcgggcgcagcucucucgagggcccccgguucgaacaaaaacugaucuccgaggaagaucugaauaugcauaccgga

SEQ ID NO: 43657 - RNA, 1683 nt, Artificial Sequence
  derived and/or modified sequence opt5 from anti-influenza_Chain
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucugcuuguccuuaccaggggaaauccagcuuuuuccgcaauguuguguggcugaucaagaaaaacucuuccuaucccaccauuaagagaagcuacaauaacacaaaucaagaggaccuccugguccuuuggggaauccaccacccuaacgaugccgcugagcagacccggcuguaucagaacccgacaaccuacaucucugugggcacguccacccucaaucagcgccuggugcccaagauugccacaagaagcaaagucaacggccaauccgggcggauggaauuuuucuggaccauccugaagccuaaugacgcgauuaacuuugagucuaauggaaacuucaucgcccccgaauacgcuuauaaaauuguuaagaaaggcgauagcgccaucaugaaguccgagcucgaauacgggaauugcaacacaaaaugucagaccccuaugggagcuaucaauagcucuaugcccuuucauaacauucacccgcugacgaucggcgagugcccuaaguaugugaaguccaaucgccuugugcuggccacagggcucagaaacagcccccagcgggagcgcagacggaaaaagcgcggacuguucggcgcgauugccggcuuuaucgaagggggauggcagggcauggucgacgggugguacggauaucaucacucuaaugagcaaggcagcggguacgcugccgacaaagaauccacccagaaggcuauugauggagugacaaacaaaguuaauucuaucaucgacaagaugaacacccaguucgaggccgugggcagagaauuuaacaaucuugagcggcgcauugagaaccugaauaagaaaauggaagauggcuuccucgacgucuggaccuauaacgccgagcugcuggugcucauggaaaaugagagaacacuggauuuccacgacagcaacguuaagaaucuuuacgauaaagugcggcugcaacucagagacaacgcuaaggaacuggggaauggauguuuugaguucuaccauaaaugcgauaacgaguguauggaauccguccgcaauggcacguaugacuacccucaguauagcgaggaagcgcggcuuaagagagaggagaucucuggggugaagcuggaauccauuggaaucuaccagauucagcacagcggcgggcggucuucccucgagggcccccgcuuugaacaaaaacugaucagcgaggaagaucugaacaugcauaccgga

SEQ ID NO: 43658 - RNA, 1701 nt, Artificial Sequence
  derived and/or modified sequence opt5 from anti-influenza_Chain
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauuagcaaguccucuuggagcgaucaugaagccuccagcggcgugucuuccgcuugucccuaccaggggaccccuagcuuuuuccgcaauguuguguggcugaucaaaaagaacaauacauaucccaccauuaaaagaucuuacaacaauacaaaccaagaggaccuccugauccuuuggggaauccaccacuccaacaaugccgcugagcagaccaagcuguaucagaacccuacgaccuacauuagcgucggcacaucuacccucaaucugcggcuggugccgaagaucgccacacgcuccaaagugaacggccagagcgggagaauggacuuuuucuggaccauucucaagcccaaugaugcgaucaacuuugaauccaauggaaacuucauugccccugaguacgcuuauaaaaucgucaagaaaggcgauucugccaucaugaaaagcgaaguugaguacgggaauugcaacacgaaaugucaaacacccauuggagcuaucaauuccagcaugccuuuucauaacauucacccccugaccaucggcgaaugcccgaaguaugugaagucuaauaaacuugugcuggccacagggcuccggaacuccccucugcgcgagagacggcgcaagagaggacuuuucggcgcgauugccggcuuuaucgaagggggauggcagggcauggucgacgggugguacggauaucaucacagcaaugaacagggcucuggguacgcugccgacaaagagagcacccagaaggcuaucgauggagugaccaacaaaguuaacuccauuaucgacaagaugaauacacaauucgaagccgugggccgggaguuuaacaaucuggaacgcagaauugagaaccucaauaagaaaauggaggauggcuuccuggacgucuggacguauaacgccgaacugcucgugcugauggagaaugaacggacccuugauuuccacgacucuaacguuaagaaucuguacgauaaagugcgccuccagcugagagacaacgcuaaggagcuugggaauggauguuuugaguucuaccauaaaugcgauaacgaguguauggagagcguccggaauggcacauaugacuacccccaguauuccgaagaggcgagacugaagcgcgaagagaucagcggggugaagcucgagucuauuggaaccuaccaaauccuguccauuuauagcacagucgccucuucccuggcucucgccaucaugguggccggccugagccuuuggaugugcuccaacgggucucugcagugccggaucuguauu

SEQ ID NO: 43659 - RNA, 1701 nt, Artificial Sequence
  derived and/or modified sequence opt5 from anti-influenza_Chain
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucugcuuguccuuaccaggggacccccuccuuuuuccgcaauguuguguggcugaucaaaaagaacaauacauauccuaccauuaaaagaagcuacaacaauacaaaccaagaggaccuccugauccuuuggggaauccaccacucuaacgaugccgcugagcagaccaagcuguaucagaauccgacgaccuacauuuccgucggcacaagcacccucaaccagcggcuggugcccaagaucgccacacgcucuaaagugaauggccaauccgggagaauggacuuuuucuggaccauucugaagccuaacgaugcgaucaauuuugaaagcaacggaaauuucauugcccccgaguacgcuuauaaaaucgucaagaaaggcgacuccgccaucguuaagucugaaguggaguacgggaacugcaauacgaaaugucagacaccuauuggagcuaucaacagcuccaugcccuuucauaauauucacccgcucaccaucggcgaaugcccuaaguaugugaaaagcaacaaacugguccuugccacagggcugcgcaauucuccccuccgggagagacggcgcaagagaggacuguucggcgcgauugccggcuuuaucgaagggggauggcagggcaugguggacgggugguacggauaucaucacuccaacgaacagggcagcggguacgcugccgauaaagagucuacccaaaaggcuaucgacggaguuaccaauaaagugaacagcauuaucgauaagaugaacacacaguucgaagccgucggccgggaguuuaauaaccuugaacgcagaauugagaaucugaacaagaaaauggaggacggcuuccucgauguguggacguauaaugccgaacugcugguucucauggagaacgaacggacccuggacuuccacgauuccaaugugaagaaccuuuacgacaaaguccgccugcagcucagagauaaugcuaaggagcuggggaacggauguuuugaguucuaccauaaaugcgacaaugaguguauggagucugugcggaacggcacauaugauuacccucaauauagcgaagaggcgagacuuaagcgcgaagagaucuccggggucaagcuggagagcauuggaaccuaccagauccucucuauuuauuccacaguggccagcucucuggcucuggccaucaugguugccggccucucccuguggaugugcagcaaugggucccuucagugccggaucuguauu

SEQ ID NO: 43660 - RNA, 1683 nt, Artificial Sequence
  derived and/or modified sequence opt5 from anti-influenza_Chain
gacaagaucugccugggccaccaugccgugagcaacgggaccaaagucaauacacucacggagagaggaguugaaguggugaacgccaccgagacagucgaacggaccaaugugccccgcauuuguuccaagggcaaaagaacaguugaucuggggcagugcggacuucugggcaccaucacagggccuccgcaaugugaccaguuccucgaguuuucugccgaucugauuaucgaacggcgcgagggaagcgacgugugcuaccccggcaaguucgucaacgaggaagcgcuuagacagauucugcgggaguccggcgggaucgauaaagaaaccaugggauuuacguauucuggcauccgcaccaaugggacaaccagcgcuuguagacgguccggaucuagcuucuacgccgagaugaaguggcuccuguccaacacagacaaugccgcuuuuccucagaugaccaagagcuauaaaaacacgcgcaaggaucccgcccugauuaucuggggcauucaccauucuggguccacaaccgagcaaacaaaacucuacggaagcggcaauaagcugaucaccguggggucuuccaacuaucagcagagcuucguuccuucucccggcgcuagaccucaggugaauggacaauccggccggauugacuuucacuggcuuauccugaacccgaaugauaccgucacauucagcuuuaacggggccuucauugcgcccgaccgcgccuccuuucucagaggaaaaucuaugggcauccagagcgaaguccagguggaugcuaauugcgagggggacuguuaccauuccggaggcacgaucauuagcaaccugccuuuccagaacaucaauucucgggccgugggcaagugcccccgcuauguuaagcaagaaucccuucugcucgcuaccgggaugaaaaacgugccugagauucccaagagacggagacgcggacuguuuggcgccaucgcgggguucauugaaaauggaugggagggccugaucgaugggugguacggcuuccggcaccagaacgcccagggagagggcacagcugccgacuacaaaagcacccaaucugcuaucgaccagauuacagggaagcucaauagacugaucgaaaagaccaaccagcaguuugagcuuauugauaaugaguucacggaaguggaacgccaaaucggaaacgucauuaauuggacacgggacagcaugaccgaggugugguccuauaacgccgagcugcucguugccauggaaaaucagcacaccaucgaucuggcugacucugagaugaacaaacuuuacgaaagagugaaacgccagcugcgggagaaugcggaagaggauggcacaggguguuuugagaucuuccauaagugcgacgaugacuguauggccagcauuagaaacaauaccuaugaucacuccaaguaccgcgaagaggcuauccagaaccggauucaaaucgacccggucaaacucagcucuggauauaaggauuccggcagacuggugccucgcgggagccccggcucuggauacauuccugaagcuccccgggacggccaggccuauguuagaaaagacggggagugggugcugcucuccacauuucugggaaagcccaucccuaacccgcuucugggccucgauagcacgggg

SEQ ID NO: 43661 - RNA, 1701 nt, Artificial Sequence
  derived and/or modified sequence opt5 from anti-influenza_Chain
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucugcuuguccuuaccaggggacccccuccuuuuuccgcaauguuguguggcugaucaaaaagaacaauacauauccuaccauuaaaagaagcuacaacaauacaaaccaagaggaccuccugauccuuuggggaauccaccacucuaacgaugccgcugagcagaccaagcuguaucagaauccgacgaccuacauuuccgucggcacaagcacccucaaccagcggcuggugcccaagaucgccacacgcucuaaagugaauggccaaaacgggagaauggacuuuuucuggaccauucugaagccuaaugaugcgaucaacuuugaauccaauggaaacuucauugcccccgaguacgcuuauaaaaucgucaagaaaggcgacagcgccaucguuaaguccgaaguggaguacgggaauugcaacacgaaaugucagacaccuauuggagcuaucaauucuagcaugcccuuucauaacauucacccgcucaccaucggcgaaugcccuaaguaugugaaguccaauaaacugguccuugccacagggcugcggaacagcccccuccgcgagagacggcgcaagagaggacuguucggcgcgauugccggcuuuaucgaagggggauggcagggcaugguggacgggugguacggauaucaucacucuaaugaacagggcuccggguacgcugccgauaaagagagcacccaaaaggcuaucgacggaguuaccaacaaagugaacucuauuaucgauaagaugaauacacaguucgaagccgucggccgggaguuuaacaaucuugaacgcagaauugagaaccugaauaagaaaauggaggacggcuuccucgauguguggacguauaacgccgaacugcugguucucauggagaaugaacggacccuggacuuccacgauagcaacgugaagaaucuuuacgacaaaguccgccugcagcucagagauaacgcuaaggagcuggggaauggauguuuugaguucuaccauaaaugcgacaacgaauguauggaguccgugcggaauggcacauaugauuacccucaauauucugaagaggcgagacuuaagcgcgaagagaucagcggggucaagcuggaguccauuggaaccuaccagauccucagcauuuauucuacaguggccuccagccuggcucuggccaucaugguugccggccucucucuguggaugugcuccaacgggagccuucagugccggaucuguauu

SEQ ID NO: 43662 - RNA, 1683 nt, Artificial Sequence; identical to SEQ ID NO: 43660
  derived and/or modified sequence opt5 from anti-influenza_Chain

SEQ ID NO: 43663 - RNA, 1683 nt, Artificial Sequence; identical to SEQ ID NO: 43656
  derived and/or modified sequence opt5 from anti-influenza_Chain

SEQ ID NO: 43664 - RNA, 1683 nt, Artificial Sequence; identical to SEQ ID NO: 43657
  derived and/or modified sequence opt5 from anti-influenza_Chain

SEQ ID NO: 43665 - RNA, 1701 nt, Artificial Sequence; identical to SEQ ID NO: 43661
  derived and/or modified sequence opt5 from anti-influenza_Chain

SEQ ID NO: 43666 - RNA, 1701 nt, Artificial Sequence; identical to SEQ ID NO: 43658
  derived and/or modified sequence opt5 from anti-influenza_Chain

SEQ ID NO: 43667 - RNA, 1701 nt, Artificial Sequence; identical to SEQ ID NO: 43659
  derived and/or modified sequence opt5 from anti-influenza_Chain

SEQ ID NO: 43668 - RNA, 1704 nt, Artificial Sequence
  derived and/or modified sequence opt5 from anti-influenza_Chain
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggagacuuuaacgauuaugaggaacugaagcaucuucugucucggaucaaucacuucgagaaaauucagaucauucccaagagcuccuggucugacuacgaagccagcuccggcgugagcucugccuguccuuaucaggggcgcuccagcuuuuucagaaacguuguguggcucaucaaaaagaauaacgcuuaccccaccauuaaacggucuuauaauaacacaaaucaagaggaucugcuuguccuguggggaauccaucacccuaacgacgccgcugagcagauccgccucuaccagaacccgaccacauacauuuccaucggcaccagcacgcugaaucagagacuggugcccaagauugccacccggucuaaggugaacggccaauccgggcgcauggaauuuuucuggacaauccucaaaagcaaugaugcgauuaacuuugaguccaauggaaacuucaucgccccugaauaugcuuacaagaucgucaaaaagggcgacucuaccauuaugaaaagcgagcuggaauaugggaauugcaacacaaagugucagacccccaucggagccauuaauuccagcaugccuuuucacaacauccauccccuuacgauuggcgagugcccgaaauacguuaagucuaauagacuggugcucgcuacagggcugcggaacuccccucagggagagcgcagacggcgcaagagaggccuuuucggcgccaucgcgggguuuaucgaaggaggcuggcaggggaugguggacggaugguauggcuaccaccauagcaaugagcaagggucuggauaugccgcugauaaagaaagcacccagaaggccauugacggcgucacaaacaaaguuaauuccaucauuaacaagaugaacacccaguucgaggcugugggccgggaauuuaauaaccuggagcgcagaaucgagaaucucaacaaaaagauggaagauggguuccuggacguguggaccuacaaugccgagcugcucguccugauggaaaacgagcggacacuugauuuccacgacucuaaugugaagaaccuguacgauaaaguuagacuccaacugcgcgacaaugccaaggaacuuggaaacggcuguuuugaguucuaucaccggugcgauaaugaguguauggaaagcgugagaaacgggacguacgacuauccccaguacuccgaggaagcucgccugaaacgggaggagauuagcggagucaagcucgaaucuaugggcaucuaucagauucuguccaucuacagcaccguggcgucuucccuggcccucgcuaucauggucgccgggcuguuucuuuggaugugcagcaauggcucccugcagugcagaauuuguauc

SEQ ID NO: 43669 - RNA, 1704 nt, Artificial Sequence
  derived and/or modified sequence opt5 from anti-influenza_Chain
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguucaucaaugugccggaaugguccuauauugucgagaaggcuaaccccaccaaugaucugugcuacccuggaucuuuuaacgacuaugaggaacucaagcaucugcuuagccggaucaaucacuucgagaaaauucagaucauucccaaguccucuuggagcgaucaugaagccuccagcggcgugucuuccgccuguccuuaccuggggagccccuccuuuuuccgcaacguuguguggcucaucaaaaagaacucuacauauccuaccauuaaaaagagcuacaauaauacaaaccaggaggaccugcuuguccuguggggaauccaccacccgaaugaugcugccgagcaaaccagacucuaucagaaccccacgaccuacaucucuauuggcacauccacccugaaccagcggcuggugccuaagaucgcuacacgcagcaaagugaauggccaguccgggagaauggaauuuuucuggaccauucucaagcccaacgacgccaucaauuuugagucuaacggaaauuucauugcgccugaauacgccuauaaaaucgucaagaaaggcgauagcgcuaucaugaaguccgagcuggaauacgggaacugcaauacgaaaugucaaacacccaugggagccauuaacagcucuaugccguuucauaauauccacccucuuaccauuggcgagugccccaaguauguuaaguccaaccggcuggugcucgcuacagggcugcgcaauagcccucagagagagucucggcgcaaaaagagaggacuuuucggcgccaucgcgggcuuuauugaagggggauggcagggcaugguggacgggugguacggauaucaucacagcaacgagcagggcuccggguacgccgcugacaaagaaucuacccaaaaggccaucgauggagucaccaauaaagugaacagcaucauugacaagaugaauacacaguucgaggcuguuggccgggaauuuaacaaccuggagcgcagaaucgagaaucucaacaagaaaauggaagauggcuuccuggacguguggacguauaaugccgagcugcucguccugauggaaaacgagcggacccuugauuuccacgacuccaaugugaagaaccuguacgauaaaguucgccuccagcugagagacaaugccaaggaacuugggaacggauguuuugaguucuaccauaaaugcgauaaugaguguauggaaagcauucggaacggcacauauaauuacccccaauauucugaggaagcuagacugaagcgcgaggagaucuccggggugaagcucgaaagcauuggaaccuaccagauccugucuauuuauuccacagucgcgagcucccuggcccucgcuaucaugauggccggccugucucuuuggaugugcagcaacgggucccugcagugccggaucuguauu

SEQ ID NO: 43670 - RNA, 1704 nt, Artificial Sequence
  derived and/or modified sequence opt5 from anti-influenza_Chain
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggucuagccaugaagccucccuuggcguuagcucugccuguccuuaccaggggaaauccagcuucuuucgcaacguggucuggcugaucaagaaaaauucuaccuaucccacaauuaagagauccuacaacaauaccaaccaagaggaccuccuggugcuuuggggaauccaccacccuaaugaugcugccgagcagacaaagcuguaucagaacccgaccacguacaucagcgugggcaccucuacacucaaccagcggcuggucccccgcauugcuaccagauccaaaguuaauggccaaagcgggcggauggaguucuuuuggacaauccugaagccuaacgacgccauuaauuucgaauccaacggaaauuuuaucgcgcccgaauacgccuauaaaauugugaagaaaggcgauucuaccaucaugaaaagcgagcucgaauacgggaacugcaauacgaaaugucagacaccuaugggagcuaucaacuccagcaugcccuuccauaauauucacccgcugaccaucggcgagugcccuaaguaugugaagucuaaccgccuuguccuggccacagggcucagaaauagcccccagcgggagcgcagacggaaaaagcgcggacuguuuggcgcuauugccggcuucaucgaagggggauggcagggcaugguggacgggugguacggauaucaucacuccaacgagcaaggcucuggguacgcggccgacaaagaaagcacccagaaggcuauugauggaguuaccaauaaagugaacuccaucaucgacaagaugaauacacaguuugaggccgucggcagagaguucaacaaccuugaacggcgcauugagaaucugaacaagaaaauggaagauggcuuccucgacguguggacguauaaugcugagcugcugguucucauggaaaacgagagaacccuggauuuucacgacucuaaugugaagaaccuuuacgauaaaguccggcugcaacucagagacaaugccaaggaacuggggaacggauguuucgaguuuuaccauaaaugcgauaaugaguguauggaaagcgugcgcaacggcacauaugacuacccucaguauuccgaggaagcccggcuuaagagagaggagaucagcggggucaagcuggaaucuauuggaaucuaccagauucucuccaucuauagcaccguggcuucuucccuggcgcuggccauuaugguugcuggccucagccuguggaugugcuccaaugggucucuucagugccgcaucuguauc

SEQ ID NO: 43671 - RNA, 1704 nt, Artificial Sequence; identical to SEQ ID NO: 43668
  derived and/or modified sequence opt5 from anti-influenza_Chain

SEQ ID NO: 43672 - RNA, 1704 nt, Artificial Sequence; identical to SEQ ID NO: 43669
  derived and/or modified sequence opt5 from anti-influenza_Chain

SEQ ID NO: 43673 - RNA, 1704 nt, Artificial Sequence; identical to SEQ ID NO: 43670
  derived and/or modified sequence opt5 from anti-influenza_Chain

SEQ ID NO: 43674 - RNA, 1707 nt, Artificial Sequence
  derived and/or modified sequence opt5 from anti-influenza_Chain
agcaaguccagaggcuacaaaaugaacacccagauccugguguucgcccucgucgcuucuauucccacaaaugccgacaagaucugccuggggcaccaugcgguuagcaacggaacgaaagugaauacccuuacagagcggggcguggaagucgugaacgcuaccgagacaguugaacgcaccaaugugccuagaauuuguuccaaggggaaacggacagucgaucugggacaaugcggccuccuggggaccaucacgggaccgccccagugugaccaguuucuugaguucucugccgaucugauuaucgaacgcagagagggcagcgacgugugcuauccuggcaaguuuguuaacgaggaagcccuccggcagauccugcgcgaguccgggggaauugauaaggaaaccaugggcuucacauacucugggaucagaaccaauggaacaaccagcgcuugucggcgcuccggcagcucuuuuuaugccgagaugaaauggcugcucuccaacacggacaaugcugccuucccccaaaugacaaagagcuacaaaaacaccagaaaggauccugcgcugauuaucugggggauucaccauucuggauccacaaccgagcagaccaaacuuuauggcagcggcaauaagcugaucacaguggggucuuccaacuaccagcagagcuuuguccccuccccuggagcccggccgcaagugaauggccagucugggcgcauugacuuccacuggcucauccugaaccccaaugauacggugaccuuuagcuucaacggagcuuuuaucgccccugacagagcuuccuuccuucggggcaagagcauggggauucagucugaaguccagguugaugccaacugcgagggagacuguuaucauuccggcggcacaaucauuagcaaucugcccuuucaaaacaucaauucucgcgcgguggggaaaugcccuagauacgugaagcaggaaagccuccugcuggccaccggaaugaaaaacguccccgagauuccgaagcggagacgccggggccucuucggggcuaucgccggauucaucgaaaauggcugggaggggcugauugauggcugguacggauuuagacaccagaacgcucaaggcgaggggacagccgccgacuauaaauccacccagucugcuaucgaccagauuacgggaaaacuuaaucgccugaucgaaaagacaaaccagcaauucgagcucauugauaaugaauuuaccgagguggaacggcagaucggcaacguuaucaauuggaccagagacagcaugacagaggugugguccuacaacgcggagcugcuugucgccauggaaaaucagcacaccauugaucuggcugacagcgagaugaacaagcucuaugaacgcgugaagcggcagcugagagagaaugccgaagaggaugggacaggauguuucgagaucuuucauaaaugcgacgaugacuguauggccucuauucgcaacaacacguacgaucacuccaaguaucgggaagaggcuauccaaaaucgcauucagaucgacccuguuaaacugagcucuggcuacaaggaugugauucucugguucuccuuuggggccagcugcuucauccugcuugcgaucgcuaugggccuggucuuuauuugcgugaaaaacggaaauaugagauguaccaucugcauu

SEQ ID NO: 43675 - RNA, 1707 nt, Artificial Sequence; identical to SEQ ID NO: 43674
  derived and/or modified sequence opt5 from anti-influenza_Chain

SEQ ID NO: 43676 - RNA, 1692 nt, Artificial Sequence
  derived and/or modified sequence opt5 from anti-influenza_Chain
gaccagaucugcauuggcuaccacgccaacaauagcaccgagaagguggauacaaaccuggaaagaaaugucacgguuacccaugcuaaagacauccucgagaagacacacaacgggaaacuguguaaacuuaaugggauucccccucuggaacucggcgauugcuccaucgccggguggcugcuuggaaacccggagugugaccggcugcucucugugcccgaauggagcuauauuauggagaaggagaauccucgcgauggccugugcuaccccggguccuucaacgacuaugaggagcugaagcaucuccugucuagcgugaagcacuuugaaaaagucaagauccuuccuaaagauagauggacccaacauacaaccacaggaggcucccgggcgugugcugugucuggcaaucccagcuucuuucgcaacaugguuuggcugaccaaggagggguccgacuacccuguggccaaaggaagcuauaauaacacgucuggcgagcagaugcucaucauuuggggaguccaccacccgaucgaugaaaccgagcagagaacacuguaccagaaugugggaaccuauguuuccgugggcacaagcacccuuaacaagcggucuacgcccgaaauugccacacgcccuaaggucaaugggcaaggaggcagaauggaguucuccuggacccugcucgacaugugggauacaaucaacuuugaaagcaccggcaaccugauugcucccgaguacggguucaaaaucucuaagcggggauccagcggcauuaugaaaaccgaggggacacuggaaaauugcgagacgaagugucagaccccucucggagccaucaacacaacccugcccuuucauaaugugcacccgcuuacaaucggcgaaugcccuaaauacgugaaguccgagaaacugguccucgcuaccgggcugcgcaacguuccccagauugaaucuagaggacuuuucggcgccaucgcgggcuuuauugaagggggauggcagggcaugguggacgggugguauggauaccaucacagcaaugaucaaggcuccggguaugccgcugacaaggagagcacgcagaaggccuucgacggcaucacaaacaaagucaauucugugauugaaaagaugaacacccaguuugaggcugugggaaaagaguucggcaaucuggaacggcgccucgaaaaccugaauaagagaauggaggauggguuucuggacguuuggaccuacaacgccgagcuccuggugcuuauggaaaaugagcggacacuggauuuccacgacuccaacgucaaaaaucucuaugauaaggugcgcaugcagcugagagacaacguuaaggaacuuggaaacggcuguuucgaguuuuaccauaaaugcgaugacgaguguaugaauagcgugaagaacgggaccuaugauuacccuaaauacgaagaggaaucuaagcugaaucggaacgagaucaaaggagucaagcucagcuccaugggcguguaucaaucugggagacuggucccccgcggcagccccggauccggcuacaucccugaagcgccgcgggacgggcaggccuaugugagaaaggauggagaguggguucugcucagcacauuccugggcaaacccauuccuaauccccuucuggggcucgacucuacggga

SEQ ID NO: 43677 - RNA, 1692 nt, Artificial Sequence
  derived and/or modified sequence opt5 from anti-influenza_Chain
cagaagcugcccggcaacgacaauagcaccgccacacucugccuggggcaccaugcugugccuaacggaacgaucgucaaaaccauuacaaaugaucaaaucgagguuaccaacgccacagaacuugugcaguccucuagcaccggcgggauuugugacuccccgcaccagauccuggauggagagaauugcacacucauugacgcgcugcuuggcgauccccagugugacggguuccaaaacaagaaaugggaucuguuuguggaaagaucuaaggcuuacagcaauugcuauccuuacgacguccccgauuaugccucccuccggucucugguggccagcuccggaacccuggaguucaacgacgagagcuuuaauuggacgggcguuacccagaacggcacaucuuccagcuguaaacgcagaucuaauaacuccuucuuuagccggcucaauuggcugacccagcuuaaguucaaguacccugcucugaacgugacaaugcccaauaacgaaaaauuugauaagcucuauaucuggggaguccaucacccugugaccgacaacgaucagaucuuccuguacgcccaggcuucugggcgcauuacgguuuccacaaaaagaagccagcagaccgugaucccgaauauuggcucccggccccgcaucagaaacauuccuucucggaucagcauuuauuggacaaucgucaagcccggggacauccuucugauuaauuccaccggaaaccucaucgccccucgcggcuacuuuaaaauuagaagcgggaagucuuccaucaugcggagcgacgcgcccauuggaaagugcaauucugaguguaucaccccgaacggcagcaucccuaaugauaaacccuuccagaacgugaaucgcauuacauacggcgccugcccuagauaugugaagcaaaacacgcugaaacuggcuaccgggaugcggaauguccccgaaaagcagacacgcggaaucuuuggcgccauugcuggguucaucgagaacggaugggaaggcaugguugacgggugguacggauuuagacaucaaaauuccgagggcauuggccaagccgcggaucucaaaucuacccaggccgcuaucaaccagaucaaugggaagcugaaccggcuuauuggaaaaacaaacgagaaguuccaccagaucgaaaaggaguucagcgaaguggagggccgcauucaagaccuggaaaaauauguggaggauaccaagaucgaccucugguccuacaaugccgagcugcuugucgcucuggaaaaccagcacacgauugaucucacagacagcgagaugaauaaacuguuugaaagaaccaagaaacagcugcgggagaacgccgaagauauggggaauggauguuucaagaucuaucauaagugcgacaacgccuguauuggcucuaucagaaaugggaccuacgaucacgacguguaucgcgacgaggcucucaacaaucgguuucagaucaaaggcguugagcugaaguccggaagcggcagacuugugccccgcgggucuccuggauccggcuacauuccggaagcgccccgggaugggcaagccuacgucagaaaagacggagagugggugcugcucagcacauuccugggcaagccuauccccaacccucuucuggggcucgauuccaccggc

SEQ ID NO: 43678 - RNA, 1692 nt, Artificial Sequence; identical to SEQ ID NO: 43676
  derived and/or modified sequence opt5 from anti-influenza_Chain

SEQ ID NO: 43679 - RNA, 1692 nt, Artificial Sequence; identical to SEQ ID NO: 43677
  derived and/or modified sequence opt5 from anti-influenza_Chain

SEQ ID NO: 43680 - RNA, 1695 nt, Artificial Sequence
  derived and/or modified sequence opt5 from anti-influenza_Chain
gacaccaucugcauuggcuaccacgccaacaauagcacagauacgguggacaccguccuggagaagaacguuacagugacccauuccgugaaucuccuggaagauucucacaacgggaaacuuugucugcucaagggaaucgcuccccugcagcuuggcaauugcagcgucgccggguggauucugggaaacccugagugugaacuccugaucuccagagagucuuggagcuauauuguggaaaaaccgaaucccgagaacggcacaugcuacccugggcauuucgcggacuaugaggaacugcgggagcaacucuccucuguuagcuccuuugaacgcuucgagaucuuucccaaggagagcucuuggccuaaucacaccacaaccggaguguccgcuagcuguucucauaacggcgaauccagcuucuacaaaaaucugcuuuggcugacgggcaagaacgggcucuaucccaaucugucuaaguccuacgccaacaauaaagagaaggaaguccuugugcuguggggaguucaccacccuccgaacaucggcgaucagagagcccucuaucauaaagagaacgcuuacgugagcgucguguccucucacuacagccggaaguuuacccccgaaauugccaaacgcccuaaggugagagaccaggaggggcggaucaauuauuacuggacacugcuggagcccggagauaccauuaucuucgaagcuaacggcaaucucauugccccucgcuaugcguuugcccuguccagaggguucggaagcggcaucauuaacucuaaugcucccauggacgagugcgaugccaagugucagacaccgcaaggcgcuaucaacuccagccuuccuuuucagaauguccaucccguuaccaucggggaaugcccuaaauacgugcggucugccaagcugcgcauggugacgggacucagaaacauucccagcauccagucccggggccuguucggggcgauugccggauuuaucgagggcggguggacaggaauggucgacggcugguauggcuaccaccaccagaaugaacaagggucuggauaugcugccgaucagaaaagcacccagaacgcuauuaauggcaucacaaacaagguuaauuccgugaucgagaaaaugaacacccaguucaccgccguggggaaggaguuuaauaaacuugaacgcagaauggagaaccugaacaagaaggucgacgauggauucauugacaucuggacauacaaugccgaacuccuggugcugcucgagaacgaacggacgcuggacuuccaugauagcaauguuaaaaaccuuuacgagaaggugaaaucucaacugaagaauaacgcuaaagagauuggcaauggguguuuugaguucuaucacaagugcaacgacgaauguauggaauccgucaagaauggcaccuacgauuaucccaaauacagcgaggagucuaagcucaaccgcgagaaaaucgacggagugaagcuggaauccaugggcgucuaucagagcgggagacuugugccucggggauccccgggcucuggguacauucccgaagcgccuagagauggacaggccuauguucgcaaagacggcgagugggugcugcucagcacauuucuggggaagcccaucccuaauccccugcucggccuggauuccaccgga

SEQ ID NO: 43681 - RNA, 1695 nt, Artificial Sequence
  derived and/or modified sequence opt5 from anti-influenza_Chain
caaaacuacaccggcaaucccgugaucugccuggggcaccaugccgucagcaacggaacaaugguuaagacgcucaccgacgaucaaauugagguggugacagcucaggaacuggucgagucccagcaccuuccugaacuguguccgucuccccucagacugguggacggccagaccugcgauaucguuaauggggcccuuggaagcccuggcugugaccaucugaacggggcggagugggauguguucauugaacggcccacagcugucgauaccugcuauccuuuugaugugcccgacuaccaaucccuccgcucuauccuggccaauaacggaaaauucgaguuuauugccgaggaguuccaguggaauacaguuaagcagaacggcaaaagcggcgcuuguaagagagccaaugugaacgacuuuuucaaucggcugaacuggcucaccaaauccgacgggaaugcuuauccucugcagaaccuuacgaaggucaauaacggagauuacgcccgccuguauaucuggggcgugcaccauccgucuaccgacacagaacaaaccaaccucuacaagaauaaccccgggagagugacagucagcacccagacgucccagacaagcguugugccuaauaucggaucucggcccugggugcgcggccuguccagcagaauuucuuuuuauuggaccaucgucgaaccuggggaucuuauuguguucaacacaaucggaaaucugauugcgccccggggccacuacaaacucaacucccagaagaaaagcaccauccugaauaccgccguuccgauuggcucuugcguguccaagugucacacagacaaagggagcaucuccacgaccaagccuuuucaaaacaucucucgcauuagcaucggagacugccccaaguacgucaaacagggcucccugaagcucgcuacagggaugagaagcauucuggagaaagccacccggggacuuuucggcgcuaucgccggguuuauugagaauggauggcagggccugaucgauggcugguauggguuccgccaucaaaacgcggaaggaacaggcaccgccgcugaccucaagucuacgcaggccgcuaucgaucagauuaaugggaaacugaacagacuuaucggaaagccuaaugagaaauaccaccagauugaaaaggaguuugaacaaguggagggccggauccaggaccuggagaaguauguugaagauacaaaaauugaccucugguccuacaacgccgagcugcugguggcccucgaaaaucagcauaccaucgaugucaccgacagcgagaugaacaagcuguucgaacgcgugagacaccagcuucgggagaacgcugaggauaaagggaauggcuguuucgaaaucuuucaccaaugcgacaacucuuguauugagagcaucagaaauggaacauaugaucaugacauuuaccgcgacgaagcgaucaacaaucgguuccagauucagggcgucaagcugauccagggguauaaagauuccggaagacucgugccccgcggcucucccgggagcggauacauuccugaggccccgcgggacggccaggcuuacguuagaaaggauggggaaugggugcugcuuuccaccuuucugggcaagcccaucccuaacccccuccugggacuggacagcacaggc

SEQ ID NO: 43682 - RNA, 1695 nt, Artificial Sequence
  derived and/or modified sequence opt5 from anti-influenza_Chain
gaccagaucugcauuggcuaccacgccaacaauagcaccgagcaaguggauacaaucauggaaaagaacgucacgguuacccaugcucaggacauucuggagaaaacacacaaugggaagcucuguaaccuggauggagugaaaccccuuauccugaaggacugcuccguggccggcuggcuccuggggaauccuaugugugaugaguuccuuaacgucucugaauggagcuauauuguggaaaaagcguccccggcuaauggacugugcuaccccggcgacuuuaacgauuaugaggagcucaagcaucugcugucuagaaucaaucaccucaagaaaaucaagauuaucccuaaaagcuacugguccaaccaugaagccucuagcgggguuuccgccgcuuguagcuaucugggagagcccucuuucuuucggaauguggucuggcuuauuaagaaaaacaauaccuacccucccaucaaggugaacuauacaaauaccaaccaggaagaccugcucguucuguggggcauucaccacccuaacgaugagaaggagcagauccgcauuuaccaaaauccgaacacauccaucagcgugggcaccucuacgcuuaaucagagacugguccccaaaaucgccacccggccuaaggugaacgggcaguccggacgcauggaguucuuuuggacaauucucaaacccaaugacagcaucaacuucgauucuaauggcaacuuuauugcuccugaauacgccuauaagaucgcgaaaaagggggacuccgugauuaugaaaagcgaacuggaguacggaaauugcaacaccaagugucagacacccaugggcgccaucaauuccucuaugccguuccauaacauccacccucugaccauuggggaaugccccaaguaugucaaaagcaauagacucguucuggcuacgggacuucggaacgccccucaaacagagacccgcggccuguuuggcgcuaucgccggguucauugagggaggcuggcaggggaugguggauggaugguacggcuaucaucacuccaaugaacaggggagcggauacgcggccgacaaggagucuacacagaaagcuaucgacggcauuaccaacaaggugaacuccaucaucgauaaaaugaauacccaauuugaaauugucggcagagaguucaacaaucucgaacggcgcaucgagaaccugaauaagaagauggaggacggguuucuugauguguggacauauaacgccgaacugcucguucugauggagaaugaaagaacgcuggacuuccacgauagcaacgugaaaaaucucuacgagaagguccggcugcagcuucgcgacaacgcuaaagaacugggaaauggcuguuucgaguuuuaccauaagugcgauaacgaguguauggaaucugugagaaaugggaccuaugacuacccccaguauagcgaggaagcccggcucucccgcgaggagauuucuggaguuaaaauggaaagcauggugacauaccaauccggcagacuggucccccgggggagcccuggcucuggauauaucccggaggcccccagagauggccaggcuuacgugcgcaaggacggggaauggguccuucuguccaccuuccucggaaagccuauucccaacccucugcugggccucgauagcacaggg

SEQ ID NO: 43683 - RNA, 1695 nt, Artificial Sequence; identical to SEQ ID NO: 43680
  derived and/or modified sequence opt5 from anti-influenza_Chain

SEQ ID NO: 43684 - RNA, 1695 nt, Artificial Sequence; identical to SEQ ID NO: 43681
  derived and/or modified sequence opt5 from anti-influenza_Chain

SEQ ID NO: 43685 - RNA, 1695 nt, Artificial Sequence; identical to SEQ ID NO: 43682
  derived and/or modified sequence opt5 from anti-influenza_Chain

SEQ ID NO: 43686 - RNA, 1698 nt, Artificial Sequence
  derived and/or modified sequence opt5 from anti-influenza_Chain
gacacccugugcaucggcuaccacgccaacaauagcacagauacgguggacaccguccucgagaagaacguuacagugacccauuccgugaaucugcuugaagauaaacacaacgggaagcuguguaaacucagaggagucgcuccccugcaucuuggcaagugcaauauugccggguggauccugggaaacccugagugugaaucucucagcacagcguccucuuggagcuauauuguggagaccccguccucugacaauggcacaugcuaccccggggauuucaucgacuaugaggaacugcgggagcagcugagcuccguuagcucuuuugaacgcuucgagauuuuuccuaaaaccuccagcuggcccaaccacgauucuaauaagggagugacggcugccuguccucaugccggcgcuaaguccuucuacaaaaaccucaucuggcuggucaagaaaggcaauagcuaucccaaacuuucuaaguccuacaucaacgacaaggggaaggaagugcugguucucuggggcauucaccacccuagcaccuccgccgaucaacagucucuguaucagaaugcugacacauacguguuugucggaagcuccagauacagcaaaaaguucaaaccggagaucgccauucggcccaaggugcgcgaucaggaggggagaaugaacuauuacuggacccuuguggaaccuggagacaaaaucacauuugaggcgaccggcaaucuggucguuccccgguaugccuucgcuauggaacgcaacgccgggucuggaauuaucauuuccgauacgccugugcaugacugcaacacaaccugucaaacacccaagggcgcuaucaauaccagccucccguuucagaacauccacccuauuaccaucggcaaaugccccaaguacgugaagucuacaaaacugagacuggccacggggcuccggaauauuccuagcauccagucccgcggacuguucggcgcgauugccggguuuaucgagggaggcuggaccgggauggucgacggaugguauggcuaccaucaccagaacgaacaaggcucuggguaugcugccgaucuuaagagcacacagaaugcuaucgacgagauuaccaacaaaguuaauuccgugaucgagaagaugaacacacaguucaccgccgugggaaaagaauuuaaucaccuggagaagagaauugaaaaccucaauaagaaagucgaugacggcuuccuggauaucuggacguacaacgccgagcuucuggugcuccuggaaaaugagcggacacuggacuaccaugauagcaacguuaagaaucucuaugagaaagugcgcucucagcugaagaacaacgcuaaagaaauugggaauggauguuucgaguuuuaccacaagugcgacaacaccuguauggaauccgucaagaauggcaccuaugauuaccccaaauauagcgaggaagcgaaacuuaacagagaggagaucgacggggugaagcuggaaucuacacggaucuaccaauccggccgccucguccccagaggaagcccuggcuccggguauauuccggaggcuccccgggauggacaggccuacgugagaaaggacggcgaauggguucugcuuucuaccuuccuggggaaaccuauccccaauccucuccugggacuggacagcacaggc

SEQ ID NO: 43687 - RNA, 1698 nt, Artificial Sequence
  derived and/or modified sequence opt5 from anti-influenza_Chain
gacagaaucugcauuggcuaccaaagcaacaauuccaccgauacagugaacacgcugaucgagcaaaagguccccguuacccagacaauggaacucguggagaccgaaaaacacccugccuauuguaauacagaccugggggcuccgcuugagcugcgggauugcaagauugaagccgugaucuacggaaaccccaaaugugacauucaucucaaggaucagggcuggucuuauaucgucgagcgcccuagcgcgcccgaggggaugugcuacccuggauccguggaaaaucuggaggaacuuagauucguguuuucuagcgcugccuccuauaaacggauccgccuguucgacuacucuagauggaacguuaccagcuccggcacaagcaaggccuguaaugcuucuaccgggggacaguccuuuuaucggagcauuaacuggcucacgaagaaaaagcccgauaccuacgacuucaaugagggcacauacgucaacaaugaggauggcgacaucauuuuucugugggggauccaccauccuccggauaccaaagaacaaacaacccuguauaagaacgccaauacgcucucuuccgugacaaccaacacaauuaaucgcagcuuccagcccaacaucggaccuagaccccugguucggggccagcaggggcgcauggacuacuauuggggcauucuuaaaagaggagagacccugaagauccggaccaacgggaaucucaucgcuccugaauuuggauaccugcuuaagggcgagucucacggccgcacaauucaaaacgaagauauccccauugggaauugcuauacgaaaugucagaccuacgccggagcgaucaacuccagcaagccguuccagaaugccuccagacauuauaugggcgagugcccuaaauacgugaagaaggcuucucugcggcucgccgucgggcugcgcaacacacccagcguggagccuagaggacuguuuggcgcuauugccggguucaucgaaggaggcugguccggcaugaucgacgggugguacggauuucaccacagcaauucugagggcaccgggauggcggccgaccagaaauccacacaagaagcuauugauaaaaucaccaacaaggugaauaacauugucgacaagaugaaucgggaguucgaaguugugaaccaugaguuuagcgagguggagaaaagaaucaauaugauuaacgauaagaucgacgaucagaucgaagaccucugggccuauaaugcugaacugcuuguccugcucgagaaccagaaaacgcuggaugaacacgacucuaacgugaagaaucuuuucgaugagguuaaacgccggcugagcgccaacgccauugacgcuggaaauggcuguuucgauauccuccauaagugcgacaacgaguguauggaaacaauuaagaaugggaccuacgaccacaaagaguaugaagaggaggcgaagcuggaaagauccaaaaucaacggcgugaagcuggaggaaaauaccacauacaaaucuggacgccucgucccccggggcagccccggguccggauauauuccugaggccccgagagauggccaggcuuacgugcgcaaggacggggaauggguucugcuuagcaccuuucugggaaagcccaucccuaacccccuccugggccuugauucuacaggg

SEQ ID NO: 43688 - RNA, 1698 nt, Artificial Sequence; identical to SEQ ID NO: 43686
  derived and/or modified sequence opt5 from anti-influenza_Chain

SEQ ID NO: 43689 - RNA, 1698 nt, Artificial Sequence; identical to SEQ ID NO: 43687
  derived and/or modified sequence opt5 from anti-influenza_Chain

SEQ ID NO: 43690 - RNA, 1701 nt, Artificial Sequence
  derived and/or modified sequence opt5 from anti-influenza_Chain
gacaagaucugcauuggcuaccacgccaacaauagcaccacacagguggauacgauccuggagaaaaacgucaccguuacacauuccguggaacuccuggagaaucaaaaggaagagagauucuguaaaauucuuaacaaggcuccccuggaccuccgggggugcaccaucgaaggauggauucugggcaauccucagugugaucuucugcucggggaccagucuuggagcuauaucguggagcgcccgacagcccagaacggaaucugcuaccccggcgcgcugaaugaggucgaggaacugaaagcucucauuggguccggagaaagaguggagcgguuugagauguucccuaagucuaccuggacaggcguugauaccagcuccggcgugacgaaggccugucccuauaacucugggagcuccuuuuaccgcaaucugcuuuggaucauuaaaaccaagagcgccgcuuauccugucaucaaaggaacauacaacaauaccggcucucaacccauucuguauuucuggggagugcaccauccuccggacacaaacgaacagaauacccucuacggguccggcgauagauacguucggauggggacggagagcaugaacuuugccaagucucccgaaaucgcugcccgcccugcggugaauggacagagaggccggauugacuauuacugguccguccugaaacccggcgagacacuuaacguggaaagcaacgggaaucugaucgccccuugguaugcuuacaaguucgugucuaccaacaauaagggagccaucuuuaaauccaaccuccccauugagaauugcgaugcuacaugucagaccaucgccggcguccugcgcaccaacaagacauuccaaaauguuagcccgcuguggauuggggagugcccuaaauaugugaaguccgaaucucucagacuggcgacgggacuucggaacgugccccagaucgagacccgcggccuguuuggggccauugcuggauucaucgaaggcggcuggacagggaugaucgacggaugguacggcuaucaccaugagaauagccagggguccggauacgccgcugauaaagaaagcacccagaaggccauugacggcaucacaaacaaagucaauucuauuaucgauaagaugaacacccaauuugaggccguggaccacgaguucuccaaucucgaaagacggauugacaaccugaauaagcgcauggaggauggguuucuugacguuuggacguacaacgcugaacugcucgugcugcuggagaacgaaagaacacucgaucugcacgacgcgaaugucaaaaaccuuuaugagaaggugaaaagccagcugcgggauaaugccaacgaccucggcaauggauguuucgaguucuggcauaagugcgauaacgaauguaucgagucuguuaaaaauggcaccuacgacuauccuaaguaccaggaugaaagcaagcugaacagacaagagaucgaguccgugaaacuugacaaucugggggucuaucagucuggacgccucgugccccggggcagccccggguccggauacauuccugaagcuccgagagauggccaggccuauguccgcaaggacggggagugggugcugcugagcaccuuucucggcaaacccaucccuaacccccugcuuggacuggacucuacaggc

SEQ ID NO: 43691 - RNA, 1701 nt, Artificial Sequence; identical to SEQ ID NO: 43690
  derived and/or modified sequence opt5 from anti-influenza_Chain

SEQ ID NO: 43692 - RNA, 1704 nt, Artificial Sequence
  derived and/or modified sequence opt5 from anti-influenza_Chain
gaccacaucugcauuggcuaccaugccaacaauagcaccgaacagguggauacaaucauggaaaagaacgucacgguuacccacgcucaagacauucuggagaaaacacauaaugggaagcucugugaucugaacggagugaaaccccuuauccugaaggacugcuccguggccggcuggcuccuggggaauccuaugugugaugaguucauuaacgucccggaguggucuuauaucguggaaaaagcgaaucccgcuaacgaccuuugcuacccuggaaauuuuaacgauuaugaggagcugaagcaccuccugagcagaaucaaucauuucgaaaagauucagaucauucccaaagacuccuggucugaucacgaggccagccugggcguuuccucugccuguccuuaccaggggaacagcuccuuuuuccggaauguggucuggcucaucaagaaaggaaacgcuuaucccaccauuaagaaaagcuacaauaacacaaaccaggaagaccugcuugugcuguggggcauccaccauccuaaugaugaggccgagcaaacccgccucuaucagaacccgacaaccuacauuucuaucggcacguccacccugaaucagagacuuguucccaagaucgcuacacggagcaaggugaacgggcagucuggacgcauugacuuuuucuggaccauccugaaaccuaaugaugccauuaacuuugaauccaauggcaacuucaucgcgcccgaguacgccuauaagauugucaaaaagggggacagcacaaucaugaaaucugaaguggaguacggaaauugcaacaccagaugucaaacgccuaugggcgcuaucaauuccagcaugcccuuucacaacauucauccgcucacaaucggggaaugcccuaaguaugugaaauccaauaagcugguccuggccaccggacuccggaacucuccccagcgcgagagacggcgcaagagaggccuguucggcgcuauugccggguuuaucgagggaggcuggcaggggaugguugacggaugguacggcuaucaccacagcaaugaacagggguccggauacgcggccgauaaagagagcacacaaaaggcuauugacggcgugaccaacaaagugaacucuaucaucgauaagaugaauacccaguucgaagccgucggccgggaguuuaacaaucuugaacgcagaauugagaaccugaauaaaaagauggaggacggguuccucgauguguggacauauaacgcugaacugcuuguucugauggagaaugaacggacgcucgacuuccaugauuccaacgugaagaaucuguacgacaaaguccgccugcagcucagagauaacgccaaggagcugggaaauggcuguuuugaguucuaccacaaaugcgacaacgaauguauggagagcgugcggaaugggaccuaugauuacccucaauauucugaagaggccagacuuaagcgcgaagagaucagcggaguuaaacuggaguccauuggcacauaccagucugggcggcucgugcccagaggcagccccggauccggcuauaucccugaagcuccgcgcgacgggcaggcguacguccggaaggacggagagugggugcugcuuagcaccuuucugggcaagcccauuccuaacccccuccuggggcuggauucuacagga

SEQ ID NO: 43693 - RNA, 1704 nt, Artificial Sequence
  derived and/or modified sequence opt5 from anti-influenza_Chain
gaccagaucugcauuggcuaccacgccaacaauagcaccgagcaaguggauacaaucauggaaaagaacgucacgguuacccaugcucaggacauucuggagaaaacacacaaugggaagcucugugaucuggacggagugaaaccccuuauccugagagauugcuccguggccggcuggcuccuggggaacccuaugugugacgaguucauuaaugucccggaguggucuuauaucguggaaaaggcgaaccccgcuaaugaucuuugcuacccuggaaacuuuaaugacuaugaggagcugaaacaucuccugagccggaucaaccacuucgaaaagauucagaucauucccaaguccucuuggagcgaucaugaggccuccucuggcguuagcuccgccuguccuuaccaggggacccccagcuuuuuccgcaauguggucuggcugaucaaaaagaacaauacauauccuaccauuaaaagaucuuacaacaauacaaaccaagaagaccuccugauccuuuggggcauucaccacuccaacgaugcugccgagcagaccaagcuguaucagaauccgacgaccuacaucagcgugggaacaucuacccucaaccagcggcugguucccaaaaucgcuacacgcuccaaggugaauggccaaagcgggagaauggacuuuuucuggaccauucuuaagccuaacgaugccaucaauuuugagucuaacggaaauuucauugcgcccgaauacgccuauaaaaucgucaagaaaggcgacuccgcuauugugaaguccgagguggaauacgggaacugcaauacgaaaugucagacaccuaucggagccaucaacuccucuaugcccuuucauaauauucacccgcugaccaucggcgagugcccuaaguaugucaaaagcaacaagcucguucuggcuacagggcugcggaauagcccccuccgcgaaagacggcgcaagagaggacuguucggcgccauugcgggcuuuaucgaagggggauggcagggcaugguggacgggugguacggauaucaucacagcaacgagcagggcucuggguacgccgcugauaaagaauccacccaaaaggccauugacggagugaccaauaaagucaacagcaucaucgauaagaugaacacacaguucgaggcugugggccgggaauuuaauaaccuugagcgcagaauugaaaaucugaacaaaaagauggaggacggcuuccucgauguuuggacguauaaugccgagcugcuugugcugauggaaaacgagcggacccucgacuuccacgauucuaaugucaagaaccuguacgacaaagugcgccugcagcucagagauaaugccaaggaacuggggaacggauguuuugaguucuaccauaaaugcgacaaugaauguauggagagcguucggaacggcacauaugauuacccucaauauuccgaggaagcuagacuuaagcgcgaggaaaucucuggggugaaacuggagagcauuggaaccuaccaguccggccggcucguccccagagggagccccggcucuggauauaucccugaggcgccgcgcgacggccaggccuacgugcggaaggacggggaauggguccugcuuuccacauuucugggaaagcccauuccuaauccccuccugggccuggauagcaccggg

SEQ ID NO: 43694 - RNA, 1704 nt, Artificial Sequence; identical to SEQ ID NO: 43692
  derived and/or modified sequence opt5 from anti-influenza_Chain

SEQ ID NO: 43695 - RNA, 1704 nt, Artificial Sequence; identical to SEQ ID NO: 43693
  derived and/or modified sequence opt5 from anti-influenza_Chain

SEQ ID NO: 43696 - RNA, 1707 nt, Artificial Sequence
  derived and/or modified sequence opt5 from anti-influenza_Chain
gaccagaucugcauuggcuaccacgccaacaauagcaccgagcaaguggauacaaucauggaaaagaacgucacgguuacccaugcucaggacauucuggagaaaaagcacaaugggaaacucugugaucuggacggagugaagccccuuauccugagagauugcuccguggccggcuggcuccuggggaacccuaugugugacgaauuuauuaaugucccggaguggucuuauaucguggaaaaagcgaaccccguuaaugaucuuugcuacccuggagacuuuaacgauuaugaggagcugaagcaucuccugagccggaucaaucacuucgaaaagauucagaucauucccaaauccucuuggagcucccaugaggcuucucugggcgugagcuccgccuguccuuaccaggggaaguccucuuucuuccgcaacgucguguggcucaucaaaaagaauagcacauaucccaccauuaaaagaagcuacaacaauacaaaccaagaagaccugcuuguucuguggggaauccaccacccuaaugaugccgcugagcagaccaagcucuaucagaacccgacaaccuacauuucugugggcacguccacccugaaccagcggcuugucccccgcaucgccacaagaagcaaggugaauggccaaucugggcggauggaguuuuucuggaccauccugaaaccuaacgacgcuauuaauuuugaauccaacggaaauuucaucgcccccgaguacgcguauaagauugugaaaaagggcgauagcacaaucaugaaauccgaacucgaguacgggaacugcaauaccaagugucagacgccuaugggagccauuaacucuagcaugcccuuucauaauauccacccgcugacaaucggcgaaugcccuaaauaugucaaguccaaccgccugguucucgcuaccgggcugagaaauagcccccagcgggagcgcagacggaagaaacgcggacuuuucggcgccauugcuggcuuuaucgaagggggauggcagggcaugguggacgggugguacggauaucaucacucuaacgaacaaggcuccggguacgccgcggacaaggagagcacacagaaagccauugauggagugaccaauaaggucaacucuaucauugacaaaaugaauacccaguucgaagcugugggcagagaguuuaacaaccuggaacggcgcaucgagaaucucaacaagaagauggaggauggcuuccuggacguuuggacauauaaugccgaacuucuggugcucauggagaacgaaagaacgcuggauuuccacgacagcaaugucaaaaaccuguacgauaaggugcggcuccaacugagagacaaugcuaaagagcuugggaacggauguuuugaguucuaccauaagugcgauaaugaguguauggaguccguucgcaacggcaccuaugacuacccucaguauucugaagaggcccggcugaaaagagaagagaucagcggggugaagcucgaguccauuggaaucuaccagagcggccgccuggucccccgggggucucccggcuccggauauauuccugaagccccgagagauggccaggcuuacgugcgcaaggacggggaguggguccuucugagcacauuucucggaaaacccaucccuaauccccugcugggccucgacucuaccggg

SEQ ID NO: 43697 - RNA, 1707 nt, Artificial Sequence
  derived and/or modified sequence opt5 from anti-influenza_Chain
gaccagaucugcauuggcuaccacgccaacaauagcaccgagcaaguggauacaaucauggaaaagaacgucacgguuacccaugcucaggacauucuggagaaaacacacaaugggaagcucugugaucuggacggagugaaaccccuuauccugagagauugcuccguggccggcuggcuccuggggaacccuaugugugacgaguucauuaaugucccggaguggucuuauaucguggaaaaggcgaaccccaccaaugaucuuugcuacccuggcagcuuuaacgacuaugaggagcugaaacaucuccugucccggaucaaucacuucgaaaagauucagaucauucccaagucuagcugguccgaucaugaggcuucuagcggaguuuccagcgccuguccuuaccuggggucucccuccuuuuuccgcaacguggucuggcucaucaaaaagaauagcacauauccuaccauuaaaaagucuuacaacaauacaaaccaggaagaccugcuugugcuguggggaauccaccacccgaaugaugccgcugagcaaaccagacucuaucagaaccccacgaccuacauuuccaucggcacaagcacccugaaccagcggcuuguuccuaaaaucgccacacgcucuaaggugaauggccaguccgggagaauggaguuuuucuggaccauucugaagcccaacgacgcuaucaauuuugaaagcaacggaaauuucauugccccugaguacgcguauaaaaucgucaagaaaggcgauuccgccauuaugaagucugaacucgaguacgggaacugcaauacgaaaugucaaacacccaugggagcuaucaacagcuccaugccguuucauaauauccacccucugaccauuggcgaaugccccaaguaugugaaaagcaaccggcuggugcucgccacagggcugcgcaauucuccucagagagagucccggcgcaagaagagaggacuuuucggcgcuaucgccggcuuuauugaagggggauggcagggcauggucgacgggugguacggauaucaucacagcaacgaacagggcucuggguacgcggccgacaaagagagcacccaaaaggcuaucgauggaguuaccaauaaagugaacuccauuaucgacaagaugaauacacaguucgaagccgugggccgggaguuuaacaaccuggaacgcagaaucgagaaucucaacaaaaagauggaggauggcuuccuggacgucuggacguauaaugcugaacuucuggugcucauggagaacgaacggacccuggauuuccacgacucuaauguuaagaaccuguacgauaaagugcgccuccagcugagagacaaugccaaggagcuugggaacggauguuuugaguucuaccauaaaugcgauaaugaauguauggagagcauucggaacggcacauauaauuacccccaauauuccgaagaggccagacugaagcgcgaagagaucagcggggucaaacucgagucuauuggaaccuaccaguccggccggcuggugcccagagggagcccuggcucuggauauaucccggaagcuccccgcgacggccaggcguacguucggaaggauggggagugggugcuucuguccacauuucucggaaagccuauucccaacccucugcugggccucgacagcaccggg

SEQ ID NO: 43698 - RNA, 1707 nt, Artificial Sequence
  derived and/or modified sequence opt5 from anti-influenza_Chain
gaccagaucugcauuggcuaccacgccaacaauagcaccgagcaaguggauacaaucauggaaaagaacgucacgguuacccaugcucaggacauucuggagaaaacacacaaugggaagcucugugaucuggacggagugaaaccccuuauccugagagauugcuccguggccggcuggcuccuggggaacccuaugugugacgaguuccuuaaugucucugaauggagcuauauuguggaaaagaucaacccggcgaaugaucugugcuaccccggaaacuuuaauaacuaugaggagcucaaacaucugcugucccggaucaaucgcuucgaaaagauucagaucauuccuaagucuagcuggcccgaccacgaggcuucccucggcguuucuagcgccuguccuuaccaagggggacccuccuuuuauagaaacguggucuggcugaucaaaaagaauaacaccuacccuacaauuaaaaagagcuaucauaauaccaaccaggaagaucuucuggugcucuggggcauccaccacccgaacgacgaggccgagcagacacggauuuacaaaaaucccaccacguacaucucuguuggcaccuccacacugaaccagcgccuugugccuaagaucgcuaccagaagcaaggucaaugggcagucuggacggguggaguucuuuuggacaauucugaaauccaacgauaccaucaauuucgaaagcaacggcaauuuuauugcccccgaaaacgcuuauaagaucgugaaaaagggggacucuacgauuaugaaauccgagcucgaauacggaaauugcaacacaaagugucaaaccccuaucggcgccaucaauagcuccaugcccuuccauaacauucacccgcugacaaucggggagugcccuaaauaugucaagucuaaucgccugguucucgcgaccggacugagaaacagcccccagggcgagcggcgcagaaagaaacggggccuuuuuggggccauugcuggauucaucgaaggcggguggcagggaaugguggauggcugguacggguaucaucacuccaaugagcagggaagcggcuacgccgcugacaaggaaucuacccaaaaagccauugacggcgugacaaacaaggucaacuccaucaucgauaaaaugaauacgcaguuugaggcgguggggcgcgaguucaacaaucuggaaagacggauugagaaccucaauaagaagauggaagacggauuucuggauguuuggaccuauaacgccgagcuucuggugcucauggaaaaugagcgcacacuggacuuccacgauagcaacgucaaaaaucuguacgacaaggugagacuccagcugcgggauaacgcuaaagaacuuggcaauggguguuucgaguuuuaccauagaugcgacaacgaguguauggaaucuguucgcaauggaaccuaugauuacccucaauauagcgaggaagcccggcugaagagagaggagaucuccggcgugaaacucgaaucuauugggacauaccagagcggccgccuggucccccggggaucccccggcagcggguauaucccugaggcuccgagagacggacaggccuacgugcgcaaggauggcgaauggguccuucugucuaccuuccucgggaagcccauuccuaacccccugcugggacucgacuccacgggc

SEQ ID NO: 43699 - RNA, 1707 nt, Artificial Sequence; identical to SEQ ID NO: 43696
  derived and/or modified sequence opt5 from anti-influenza_Chain

SEQ ID NO: 43700 - RNA, 1707 nt, Artificial Sequence; identical to SEQ ID NO: 43697
  derived and/or modified sequence opt5 from anti-influenza_Chain

SEQ ID NO: 43701 - RNA, 1707 nt, Artificial Sequence; identical to SEQ ID NO: 43698
  derived and/or modified sequence opt5 from anti-influenza_Chain

SEQ ID NO: 43702 - RNA, 1728 nt, Artificial Sequence
  derived and/or modified sequence opt5 from anti-influenza_Chain
aucugcauuggcuaccacgccaacaauagcaccgaacagguggacacaaucauggaaaagaacgucacgguuacccaugcucaagauauucuggagaaaacacacaaugggaagcucugugaccuggauggagugaaaccccuuauccugagagacugcuccguggccggcuggcuccuggggaacccuaugugugaugaguucauuaaugucccggaguggucuuauaucguggaaaaggcgaaccccgcuaaugaccuuugcuacccuggaaacuuuaaugauuaugaggagcugaaacaucuccugagccggaucaaccacuucgaaaagauucagaucauucccaaguccucuuggagcgaccaugaggccuccucuggcguuagcuccgccuguccuuaccaggggacccccagcuuuuuccgcaauguggucuggcugaucaaaaagaacaauacauauccuaccauuaaaagaucuuacaacaauacaaaccaggaagaucuccugauccuuugggggauucaccacuccaacgacgcugccgagcaaaccaagcuguaucagaauccgacgaccuacaucagcgugggcacaucuacccucaaccagcggcugguucccaaaaucgcuacacgcuccaaggugaauggccagaacgggagaauggauuucuucuggaccauucuuaagccuaaugacgccaucaacuuugagagcaauggaaacuucauugcgcccgaauacgccuauaaaaucgucaagaaaggcgauucugcuauugugaaguccgagguggaauacgggaauugcaacacgaaaugucaaacaccuaucggagccaucaauagcuccaugcccuuucauaacauucacccgcugaccaucggcgagugcccuaaguaugucaaaucuaauaagcucguucuggcuacagggcugcggaacagcccccucggauacauuccugaagcgccccgcgacggccaggccuaugugagaaaggacggcgagugggugcugcuuuccaccuuccugcggagcgauaaaacccauacaugucccccuugcccggcccccgagcuccugggaggaccuucugucuuucuuuuucccccuaagcccaaagacacgcugaugaucucccgcaccccggaagugacauguguuguggucgaugugagccacgaggacccugaaguuaaguuuaauugguacguggauggcgucgaggugcacaacgcuaaaaccaagcccagagaggaacaguauaacucuacauaccgggucgugagcguucucaccgugcugcaucaggacuggcugaaugggaaggaguacaaaugcaaggucuccaacaaagcccucccugcucccauugaaaagacgaucucuaaagccaagggacaaccucgcgagccccagguguauacacugccgccuagcagagaagagaugaccaagaaucagguuucccuuaccugccuggugaaaggcuucuaccccagcgauaucgccgucgaaugggagucuaacgggcaacccgagaauaacuauaagacaaccccuccggugcucgacuccgauggcagcuucuuucuguacucuaaacuuacaguggacaagucccgguggcagcagggaaauguuuucagcuguuccgucaugcacgaagcucugcauaaccacuauacgcagaaaucucucagccugucccccggcaag

SEQ ID NO: 43703 - RNA, 1728 nt, Artificial Sequence
  derived and/or modified sequence opt5 from anti-influenza_Chain
augguggucaccagcaacgccgacagaaucugcacaggcauuacguccucuaauagcccccacguugugaagaccgcuacacagggggaggugaacgucaccggagugaucccucugacaaccacaccgaccaaaucccauuucgccaaucucaagggcacggaaacccgggggaaacugugucccaagugccuuaacuguacagaucuggacguugcgcucggacgcccuaaaugcaccggcaauauucccucugcuagagugagcauccugcacgagguccggccugugacauccggguguuuucccauuaugcaugaucgcaccaagaucagacaacuuccuaaccugcuccggggauacgaacacauccgccugucuacgcauaauguuauuaacgccgagaaugccccgggcggccccuauaagaucgggacaagcggauccugcccuaacgugaccaauggcaacggguucuuugcuacaauggccugggcuguccccaaaaaugacaacaauaagaccgccaccaacagccugacaauugaagugccuuacaucuguacggagggagaggaucagauuaccguguggggcuuccacucugacaacgaaacacagauggcgaaacucuauggggauuccaagccccagaaauuuaccagcucugccaauggagucacaacccacuacguuucccaaaucggcggcuucccgaaccagacggaggacgggggacugccucagagcggcagaauugugguggauuauaugguccagaagucugggaagacaggaaccaucaccuaccaacggggcauccuucugccccagaaaguguggugcgcuuccggaaagagcaaaguuauuaaggggucccucccucugaucggcgaagccgacugucuucaugagaaauauggcgggcugaauaagucuaaacccuacuacacaggagagcacgcuaaggccauuggcaacugccccaucugggugaagaccccucucaaacuggcgaaugggacaaaguaucgcccgcccgccaaacugcucaaggaaagaggauuuuucggcgcuauugccggguuucuggagggcggaugggaaggcaugaucgcuggguggcauggauacacgagccacggcgcccacggggucgccguggcugcggaucuuaaauccacccaggaggccaucaacaagauuacaaagaaucugaacagccucucugaacuggagguuaaaaaucuucagcggcuguccggagcuauggacgagcuccauaacgaaauccuggagcuggaugaaaagguggacgaccuccgcgccgauaccauuagcucucaaaucgagcuggccguccuucugagcaaugaaggcauuaucaacuccgaggacgagcaccuccuggcucuugaaagaaaacugaagaaaaugcucgggccuucugccguggagaucggcaauggauguuucgaaacaaagcauaagugcaaccagaccugccuggaucggauugcggcuggcacguuugacgccggggaguucagccugcccaccuuugauucccucaauaucacagccgcuagccugaacgacgauggacuugacaaccacaccauucugcucuauuacucuacagccgcuuccagccuggccgucacccugaugaucgcgauuuucgugguuuauauggugucucgcgauaaugucuccuguuuccauagc

SEQ ID NO: 43704 - RNA, 1728 nt, Artificial Sequence; identical to SEQ ID NO: 43703
  derived and/or modified sequence opt5 from anti-influenza_Chain

SEQ ID NO: 43705 - RNA, 1728 nt, Artificial Sequence; identical to SEQ ID NO: 43702
  derived and/or modified sequence opt5 from anti-influenza_Chain

SEQ ID NO: 43706 - RNA, 1731 nt, Artificial Sequence
  derived and/or modified sequence opt5 from anti-influenza_Chain
gccaaggcuggcgugcagagcgucaaaauggagaagaucguucuccuguucgccauugugucccuggugaaaucugaccaaaucugcauuggguaccacgcgaacaauagcaccgaacaggucgauacaaucauggagaagaacgugacgguuacccaugcucaggacauucuugaaaagacacacaauggaaagcugugugaucucgacggcgugaagccccugauccuuagagauugcuccgucgccggguggcugcucggaaacccuaugugugacgaguuuaucaaugugccggaauggucuuauauuguugagaaagccaaccccgugaaugaucugugcuacccuggcgacuucaacgauuaugaggaacugaagcaucuccugagccggaucaaucacuuugagaaaauucagaucauucccaaguccucuuggagcucccaugaagcuagccuuggggucucuuccgccuguccuuaccaaggaaaaagcucuuucuuucgcaacgugguguggcugaucaagaaaaauuccaccuaucccacaauuaaaagaagcuacaacaauaccaaccaggaggaccuccugguccuuuggggcauccaccacccuaaugaugcugccgagcagacaaagcuguaucagaacccgaccacguacaucucuguuggcaccuccacacucaaccaacggcuggugccccgcauugcgaccagaagcaaagugaaugggcaguccggacggauggaguucuuuuggacaauccugaagccuaacgacgccauuaauuucgaaucuaacggcaauuuuaucgcucccgaauacgccuauaaaauugucaagaaaggggauagcaccaucaugaaguccgagcucgaauacggaaacugcaauacgaagugucagacaccuaugggcgcuaucaacagcucuaugcccuuccauaauauucacccgcugaccaucggggagugcccuaaauaugugaaguccaaccgccuuguucuggccacaggacucagaaauagcccccagcgggagcgcagacggaaaaagcgcggccuguuuggcgcgauugccggguucaucgaaggaggcuggcaagggaugguggacggaugguacggcuaucaucacucuaacgagcaggggagcggauacgcugccgacaaagaauccacccagaaggcuauugauggcgucaccaauaaggugaacucuaucaucgacaaaaugaauacacaauuugaggccguuggcagagaguucaacaaccuugaacggcgcauugagaaucugaacaagaaaauggaagauggguuccucgacguguggacguauaaugccgagcugcugguccucauggaaaacgagagaacccuggauuuucacgacagcaaugugaagaaccuuuacgauaaaguccggcugcagcucagagacaaugcuaaggaacugggaaacggcuguuucgaguuuuaccauaagugcgauaaugaguguauggaauccgugcgcaacgggacauaugacuacccucaguauagcgaggaagcgcggcuuaaaagagaggagaucucuggaguuaagcuggaauccauuggcaucuaccagauucucagcaucuauucuaccguggccuccagccuggcucuggcccucauggucgccgggcugucccuuuggaugugcucuaauggcagccugcaaugccgcauuuguauc

SEQ ID NO: 43707 - RNA, 1731 nt, Artificial Sequence; identical to SEQ ID NO: 43706
  derived and/or modified sequence opt5 from anti-influenza_Chain

SEQ ID NO: 43708 - RNA, 1737 nt, Artificial Sequence
  derived and/or modified sequence opt5 from anti-influenza_Chain
augguggucaccagcaacgccgacagaaucugcacaggcauuacguccucuaauagcccccacguugugaagaccgcuacacagggggaggugaacgucaccggagugaucccucugacaaccacaccgaccaaaucccauuucgccaaucucaagggcacgcaaacccgggggaaacugugucccaacugccuuaauuguacagaucuggacguugcgcucggacgcccuaagugcaugggcaccauucccucugcuaaagccagcauccugcacgaagugaagccugucacauccggguguuuucccauuaugcaugauagaaccaagauccggcagcuuccuaaccugcuccgcggauacgagaauaucagacugucugcccggaacgugauuaaugcugaaacggccccgggcggccccuauaucguugggacaagcggauccugcccuaacgugaccaauggcaaaggguucuuugcuacaauggccugggcgguccccaagaacaaaaauaagaccgccaccaacccucugacaguggaggugcccuacauuuguacgaaaggagaagaccagaucaccgucuggggcuuccacagcgauaaugaggcucagaugguuacacucuauggggacucuaagccgcaaaaguuuaccuccagcgccaacggagugacaacccauuacgugucucagauuggcggcuucccuaaccagacggaggaugaagggcugcagcaauccggacgcaucgucguggacuauaugguucagaaacccggcaagacagggaccauuguguaccagagaggaguccuucugccucagaaaguguggugcgcuagcggccggucuaagguuaucaaagggucccucccccugaucggagaggccgauugucuucacgaaaaguauggcggccugaauaaaagcaagcccuacuacaccggggagcacgcgaaggccauuggaaacugcccuaucugggugaaaacaccgcucaagcuggcuaauggcaccaaauauagacccccugccaagcugcucaaagagcgcggguuuuucggagcuauugccggcuuucuggaagggggcugggagggaaugaucgccggcuggcauggguacacaucccacggagcucauggcgucgcgguggccgcugaccuuaagucuacgcaagaagccauuaacaagaucaccaaaaaucugaacagccucuccgagcuggaagucaagaaucuucagcggcugagcggggccauggaugagcuccacaacgagauccuggaacuggacgagaaaguggaugaccuccgcgcugacacaauuucuucccagaucgaacuggccguucuucugagcaaugagggaauuaucaacucugaagaugagcaccuccuggcgcuugagagaaagcugaaaaagaugcucggccccagcgcuguggacauugggaauggcuguuucgaaaccaagcauaaaugcaaccaaacaugccuggaucggaucgccgccggaaccuuuaaugcuggcgaguucucccugccuacguuugacucucucaacaucaccgccgcuagccugaaugaugacgggcuugauaaccacacaauucugcucuauuacuccaccgccgcgagcucucuggccgucacacugaugaucgcuauuuucaucguguauaugguuucccgcgacaacguguuccuucuccaucugagcauuagaaag

SEQ ID NO: 43709 - RNA, 1737 nt, Artificial Sequence; identical to SEQ ID NO: 43708
  derived and/or modified sequence opt5 from anti-influenza_Chain

SEQ ID NO: 43710 - RNA, 1731 nt, Artificial Sequence
  derived and/or modified sequence opt5 from anti-influenza_Chain
auggagaccaucagccugauuacaauccuccugguggucacggccuccaacgcugacaagauuugcaucggccaccagucuaccaauagcacagaaaccguugauacacuuaccgagacaaacgugcccgugacccaugccaaagaacugcuccacacggagcauaaugggaugcugugugcgaccucccuuggacacccucugauucucgacacaugcaccaucgaaggccuggucuacgggaacccgucuugugaucugcuccugggaggcagagaguggagcuauaucguggagcgguccucugcuguuaaugggacaugcuaccccggaaacguggaaaaucuugaggaacugcgcacccucuucagcuccgccagcucuuaucaacgcauucagaucuuuccugacacgacauggaacgucaccuacacaggcaccucccgggccuguagcggcucuuucuaucgcuccaugagauggcugacccaaaagagcggguuuuaccccgugcaggaugcucaauauacaaauaaccggggaaaaucuauucuuuucguuuggggcauccaucacccucccacguacaccgagcagacaaaucuguacauucgcaacgacaccacaaccuccgugacgacagaggaucucaauagaaccuuuaagccugucaucgggccgcggccccuggugaacggacugcagggccgcauugacuauuacuggagcgugcucaaaccugggcagacccugagaguccgguccaauggaaaccuuaucgcccccugguauggccacguucugucuggcgggagccauggacgcauccucaagacagaucugaagggcgggaacugcguggugcaaugucagaccgaaaaaggaggccuuaauuccacacugccuuuccacaacauuagcaaguacgcuuuugggacgugccccaaauaugucagaguuaauucucucaagcuggccgugggacugcggaacgugccggcgcgcuccagcagaggccucuucggcgccaucgcuggguuuauugagggaggcuggccugggcuggucgccggaugguacggcuuccagcauucuaaugaccagggggugggcauggcugccgaucgggacagcacccaaaaagcgaucgauaagauuacauccaagguuaacaauaucguggacaaaaugaacaagcaguaugaaaucauugaccacgaguuuucugaagucgagaccagacuuaauaugaucaacaauaaaauugaugaccagauccaagaugugugggccuacaacgcugagcugcucguccugcuugaaaaucagaagacacuggacgagcacgaugccaacgugaauaaccucuacaacaaaguuaagcgcgcucugggaagcaaugccauggaagacggcaaaggguguuucgagcuguaucauaagugcgaugaccaguguauggaaaccauucggaacggaacguacaauagacgcaaguaucgggaggaguccagacucgaacgccagaaaaucgagggcgugaagcuggaaagcgaggggaccuacaaaucuggacggcuuguccccagaggcuccccugggagcggcuauauccccgaagcccccagagauggacaggcuuacgugcggaaggacggcgaguggguucugcucucuacauuucuggggaaaccuauuccgaacccccugcuuggacucgauuccaccggc

SEQ ID NO: 43711 - RNA, 1731 nt, Artificial Sequence; identical to SEQ ID NO: 43710
  derived and/or modified sequence opt5 from anti-influenza_Chain

SEQ ID NO: 43712 - RNA, 1752 nt, Artificial Sequence
  derived and/or modified sequence opt5 from anti-influenza_Chain
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaagucccauuucgcgaaucuuaaaggcacgcaaacccgggggaagcugugucccaacugcuuuaauuguacagaucucgacguggcucugggacgcccuaaaugcaugggcaacacccccucugccaaggucagcauucuucacgaagugaagccugccacauccggguguuuccccaucaugcaugauagaaccaaaauccggcagcugccuaaucuccugcgcggauacgagaacauuagacugucuacgagcaauguuaucaacacagaaaccgcuccgggcggccccuauaagguggggacauccggaagcugcccuaaugucgccaacggcaauggguuuuucaacaccauggcuugggugauucccaaagacaauaacaagaccgccaucaacccugugacagucgagguucccuacauuuguucugaaggagaggaucagaucacgguguggggcuuucacuccgacgauaaaacccagauggagcggcucuauggggacagcaauccgcaaaaguucacaucuuccgcgaacggagugaccacacauuacgucagccagauuggcggcuuuccuaaucagaccgaagaugaggggcugaagcagucuggacgcaucgugguugacuauauggugcaaaaacccggcaagacggggacaaucgucuaccagagagggauucuucugccucagaaaguguggugcgccuccggccggagcaagguuaucaaagggucccucccccugauuggagaagcugauugucuucacgagaaguauggcggccugaacaaaucuaagcccuacuacaccggggagcacgccaaggcuaucggaaauugcccuauuugggugaaaaccccgcucaagcuggccaacggcacaaaauauagacccccugcgaagcugcucaaagaacgcggguucuuuggagccaucgcuggcuuccuggagggaggcugggaaggaaugaucgccggcuggcauggguacaccagccacggagcucauggcgucgccguggccgcugaccuuaaguccacacaggaggcgauuaauaagaucacgaaaaaccugaauuaucucagcgaacuggaggucaagaaccuucaacggcugucuggggccaugaaugagcuccacgaugaaauucuggagcuggacgaaaaaguggacgaucuccgcgcugacaccaucuccagccagauugagcuggccguucuucugucuaacgaaggaaucaucaauagcgaggaugagcaccuccuggcccuugaaagaaagcugaaaaagaugcucggccccuccgcuguggagauugggaacggcuguuuugaaacaaagcauaaaugcaaucagaccugccuggaccggaucgccgcgggaacauucaacgcuggcgauuuuucucugccuaccuucgacagccucaacauuacggccgccucccugaaugaugacgggcuugauaaccacaccauccugcucuacuauagcacagcugccucuucccuggcugucacccugaugauugccaucuucauuguguacaugguuagccgcgacaaugugucuuguuccaucugccuu

SEQ ID NO: 43713 - RNA, 1752 nt, Artificial Sequence
  derived and/or modified sequence opt5 from anti-influenza_Chain
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgaagacccgggggaaacugugucccgauugccucaacuguacagaccuggauguggcucuuggacgcccuaugugcgucggcaccacacccucugccaaggccagcauucugcaugaagugagaccuguuaccuccggguguuuucccaucaugcacgaccggacgaagauccgccaacucgcuaaucugcugagaggauaugagaacauucggcucucuacacagaaugugaucgaugccgaaaaagcuccuggcggcccguaccgccuggggaccagcggauccugccccaacgccacaagcaagucuggcuucuuugcgaccauggccugggcugucccuaaagacaauaacaagaaugccaccaacccccuuacaguggaggugccuuauauuuguacggaaggggaggaucagaucaccgucuggggauuccauuccgacgauaaaacacagaugaagaaucuguacggcgacagcaacccccaaaaguuuaccucuuccgcuaaugggguuacaacccacuaugugagccagauuggaggcuucccggaucagacggaggacggcgggcucccucagucuggaagaaucguggucgauuacaugaugcaaaaacccggcaagacagggaccauuguguaucagcggggaguucugcuuccucagaaaguguggugcgccuccggccgcagcaaggucaucaaagggucccugccccucaucggagaagcggacugucugcaugagaaguacggcggccugaacaaaucuaagcccuacuauaccggggaacacgccaaggcuauuggaaacugcccuaucugggugaaaacaccgcucaagcuggccaauggcaccaaauacagacccccugcuaagcugcugaaagagcggggguuuuucggagccauugccggcuuucucgaagggggcugggaaggaaugaucgcuggcuggcacggguauacaagccauggagcgcacggcguugccguggcugccgaccugaaguccacgcaggaggccauuaacaagaucaccaaaaaucuuaacagccugucugaacucgaggucaagaaucugcaacgccuguccggggcuauggaugaacuccauaacgagauccuggagcuugacgaaaaaguggaugaccugagagccgauacaauuagcucucagaucgagcucgcgguccugcuuagcaaugaaggaauuaucaacuccgaggacgaacaccuucucgcucuggagcggaagcugaaaaagaugcucggccccucugccguggauauugggaauggcuguuucgagaccaagcacaaaugcaaccagacaugccuggaccgcaucgccgcuggaaccuuuaaugccggcgaguucagccuuccuacguuugauucccugaacaucaccgcugccagccucaaugacgaugggcuggacaaccauacaauucugcuuuacuauucuaccgcggccuccagccucgcuguuacacugaugcuggccaucuucauuguguacauggucucuagagacaauguguccuguagcaucugccuc

SEQ ID NO: 43714 - RNA, 1752 nt, Artificial Sequence
  derived and/or modified sequence opt5 from anti-influenza_Chain
augaaggccaucauugugcugcucauggucguuaccagcaacgcugacagaaucugcacaggcauuacguccucuaauagcccccacguggugaaaaccgccacacagggggaggucaacgugaccggaguuaucccucugacaaccacaccgaccaaguccuacuucgcgaaucuuaaaggcacgcggacccgcgggaagcugugucccgauugccucaacuguacagaccuggauguggcucuuggaagaccuaugugcgucggcaccacacccucugccaaagccagcauucugcaugaagugaagccuguuaccuccggguguuuucccaucaugcacgaccggacgaagauccgccaacucccuaaucugcugagaggauaugagaacauucggcucucuacacagaaugugaucgaugcugaaaaagccccgggcggccccuaccgccuggggaccagcggauccugcccuaacgcuacaagcaagucuggcuucuuugccaccauggcgugggccguccccaaagacaauaacaagaaugcuaccaacccucuuacaguggaggugcccuauauuuguacggaaggggaggaucagaucaccgucuggggauuccauuccgacgauaaaacacagaugaagaaucuguacggcgacagcaacccgcaaaaguuuaccucuuccgccaaugggguuacaacccacuaugugagccagauuggaucuuucccugaucagacggaggacggcggccucccccaguccgggagaaucguggucgauuacaugaugcaaaaaccuggaaagacaggcaccauuguguaucagcgcgggguucugcuuccccagaaaguguggugcgcuagcggacgguccaaggucaucaaaggcucucugccccucaucggggaagccgacugucugcaugagaaguacggaggccugaacaaaagcaagccuuacuauaccggcgaacacgcgaaggccauugggaacugcccgaucugggugaaaacaccccucaagcuggcuaauggaaccaaauacagaccucccgccaagcugcugaaagagcggggcuuuuucggggcuauugccggauuucucgagggcgggugggaaggcaugaucgccggauggcacggcuauacaucccauggggcucacggaguugcgguggccgcugaccuuaagagcacgcaggaggccauuaacaagaucaccaaaaaucuuaacucucuguccgaacucgaggucaagaaucugcaacgccugagcggcgccauggaugaacuccauaacgagauccuggagcuugacgaaaaaguggaugaccugagagcugauacaauuucuagccagaucgagcucgccguccugcuuuccaaugaagggauuaucaacucugaggacgaacaucugcucgcgcuggagcggaagcugaaaaagaugcucggaccuagcgcuguggagauuggcaauggguguuucgaaaccaagcacaaaugcaaccagacaugccuggaucgcaucgccgccggcaccuuuaaugcuggagaguucucccuucccacguuugacagccugaacaucaccgccgcuucucucaaugaugacggccuggauaaccacacaauucugcuuuacuauuccaccgccgcgagcucucucgccguuacacugaugcuggcuaucuucauuguguacauggucuccagagacaaugugagcuguuccaucugccuc

SEQ ID NO: 43715 - RNA, 1752 nt, Artificial Sequence; identical to SEQ ID NO: 43712
  derived and/or modified sequence opt5 from anti-influenza_Chain

SEQ ID NO: 43716 - RNA, 1752 nt, Artificial Sequence; identical to SEQ ID NO: 43713
  derived and/or modified sequence opt5 from anti-influenza_Chain

SEQ ID NO: 43717 - RNA, 1752 nt, Artificial Sequence; identical to SEQ ID NO: 43714
  derived and/or modified sequence opt5 from anti-influenza_Chain

SEQ ID NO: 43718 - RNA, 1758 nt, Artificial Sequence
  derived and/or modified sequence opt5 from anti-influenza_Chain
augaaggccaucauugugcugcucauggucguuaccagcaacgcugacagaaucauuugcacaggcaucacguccucuaauagcccccacguggugaaaaccgccacacagggggaggucaacgugaccggaguuauuccucugacaaccacaccgaccaagucccauuucgcgaaucuuaaaggcacggaaacccgggggaagcugugucccaaaugccucaacuguacagaucuggacguggcucuuggacgcccuaagugcaccggcaauauccccucugccagagucagcauccugcacgaggugcggccuguuacauccggguguuuucccauuaugcaugaucgcaccaagaucagacaacucccuaaccugcugcggggauacgaacacauucgccucucuacgcauaaugugaucaacgccgagaaugcuccgggcggccccuauaaaauugggacaagcggauccugcccuaacgucaccaauggcaacggguucuuugccacaauggcuugggccgugcccaagaaugacaacaauaaaaccgcgaccaacagccugacaaucgaagugccuuacauuuguacggagggagaggaucagaucaccgucuggggcuuccacucugacaacgaaacacagauggccaaacuuuauggggauuccaagccccagaaguuuaccagcucugcuaauggaguuacaacccacuacgugucccaaaucggcggcuucccgaaccagacggaggacgggggacugccucagagcggcagaauuguggucgauuauauggugcagaagucugggaaaacaggaaccaucaccuaccaacggggcauucuccugccccagaagguuuggugcgccuccgggcgcagcaaagugaucaagggaucccuuccucugauuggcgaagcugacugucuccaugagaaauauggcgggcugaauaagucuaaacccuacuacacaggagagcacgccaaggcgaucggcaacugccccaucugggucaagaccccucugaaacucgccaaugggacaaaguauagaccgcccgcuaaacugcuuaaggaacggggauuuuucggcgccauugcuggguuucuggagggcggaugggaaggcaugaucgccggguggcauggauacacgagccacggcgcccacgggguggcuguugcggccgaucucaaauccacccaggaggcuauuaacaagaucacaaagaaucugaacagccuuucugaacuggaggugaaaaaucuccagcgccuguccggagccauggacgagcugcauaacgaaauucucgagcuggaugaaaaggucgacgaccuuagagccgauaccaucagcucucaaaucgagcuggcugugcuccugagcaaugaaggcauuaucaacuccgaggacgagcaccuucuggcccucgaacggaaacugaagaaaaugcuggggccuucugcggucgagauuggcaauggauguuucgaaacaaagcauaagugcaaccagaccugccucgaucgcaucgcugccggcacguuugacgccggggaguucagccugcccaccuuugauucccuuaauauuacagcugccagccugaacgacgauggacucgacaaccacaccauccugcuguauuacucuacagcugccuccagccuugcggugacccucaugauugccaucuucguuguguauauggucucuagagauaauguguccuguagcaucugccug

SEQ ID NO: 43719 - RNA, 1758 nt, Artificial Sequence; identical to SEQ ID NO: 43718
  derived and/or modified sequence opt5 from anti-influenza_Chain

SEQ ID NO: 43720 - RNA, 1749 nt, Artificial Sequence
  derived and/or modified sequence opt5 from anti-influenza_Chain
auggaggccagacugcucgugcugcuuugcgcuuucgccgcgaccaacgcugacacaaucuguauuggcuaccacgccaauaacagcacggauaccgucgacacaguucuggaaaagaaugugaccgugacacauuccgucaaccuccuggaggauucucacaaugggaaacuuugcaagcugaaaggaaucgcuccccuccagcugggcaaguguaacauugccggguggcugcucggaaauccugaaugcgaccugcuucugaccgccagcuccuggucuuauaucguggagacaagcaacuccgaaaauggcaccuguuacccgggggauuuuauugacuaugaggagcuccgggaacaacugucuagcguuuccagcuucgagaaauuugaaaucuuccccaagacgucuuccuggccuaaccaugagaccacaaagggagugaccgcugccugcagcuacgcgggcgccucuuccuuuuaucgcaaucuucuguggcucaccaaaaagggcagcucuuaccccaaacuguccaagagcuaugucaacaauaaagggaaggaggugcugguucucuggggagugcaccauccucccacaggcacggaucagcagucccuguaccagaacgcugacgccuacgucucuguggggagcuccaaguauaauagacgguucacaccugaaaucgcugcccgcccgaaagugagagaucaagcgggacggaugaacuacuauuggacccuucuggagcccggcgacacaauuaccuuugaagccaccgggaaccucaucgcuccuugguacgccuucgcucugaaucgcggaagcggcucuggcauuaucacauccgaugcccccguccacgacuguaacacgaagugccagaccccucacggggccauuaauagcucucuucccuuucagaacauccauccgguuacaauuggagaguguccuaaauaugugagaagcaccaagcugcggauggcuacaggccuccgcaauauccccuccauccagucuagagggcuguucggagcgauugccggcuuuaucgaagggggauggaccggcaugauugauggcugguacggguaucaccaucaaaacgagcagggaagcggcuacgcugccgaccagaaauccacgcagaaugccaucgacgggauuacaaacaaggugaauagcgucaucgagaaaaugaacacccaauucaccgcugugggaaaggaauuuaauaaccuggagcggcgcaucgaaaaucucaacaagaaaguugaugacggcuuccuggauauuuggacauacaaugccgagcuucuggugcuccuggaaaacgagagaacccuugacuuccacgauucuaacguccggaaucuguaugagaaggugaaaucccagcucaagaacaaugcgaaagaaaucgggaacggcugcuuugaguucuaccacaagugugacgaugcuugcauggaaagcguucgcaauggaacauaugacuacccuaaguauucugaggaauccaaacugaacagagaggagauugauggcgugaagcuggaaagcaugggggucuaccaguccggacggcucgugcccagaggcucucccgggagcggauauaucccugaggccccgcgcgacggccaagccuacguccggaaagauggggaaugggugcugcuuuccacguuucugggcaagcccauuccuaauccccuccugggacuggacucuaccggc

SEQ ID NO: 43721 - RNA, 1749 nt, Artificial Sequence; identical to SEQ ID NO: 43720
  derived and/or modified sequence opt5 from anti-influenza_Chain

SEQ ID NO: 43722 - RNA, 1755 nt, Artificial Sequence
  derived and/or modified sequence opt5 from anti-influenza_Chain
auggagagaaccgugcugcuccuggccacagucagccuuguuaaguccgaccagaucugcauuggcuaccacgcuaacaauucuacggaacaaguggauaccaucauggagaaaaacgugacagucacccaugcccaggacauucuggaacggacacacaaugggaagcucugugaucugaacggagugaaaccccuuauccugcgcgacugcagcguugcgggcuggcuccuggggaauccuaugugugaugaguucauuaacgugccggaaugguccuauaucgucgagaaggcuucucccgccaaugaccugugcuacccuggaaacuuuaaugauuaugaggaacucaaacaucugcuuagcagaaucaaccacuucgagaagauucagaucauucccaaguccucuuggagcaaucaugacgccuccagcggcgugucuuccgcuuguccuuaccuggggcggagcuccuuuuuccgcaacguuguguggcucaucaaaaagaacucugccuaucccaccauuaaaagaagcuacaauaauacaaaccaggaagaucugcuuguccuguggggagugcaccacccuaacgacgcugccgagcaaaccaagcucuaucagaauccgacgaccuacaucucugugggcacauccacccugaaccagcggcugguccccgagauugcgacacgcccuaaaguuaauggccagagcgggagaauggaauuuuucuggaccauccucaagcccaacgaugccaucaauuuugaguccaacggaaauuucauugcuccugaauacgccuauaagaucgugaaaaagggcgacucuacgauuaugaaaagcgagcuggaauacgggaacugcaauacaaagugucaaacccccaugggagcuaucaacuccagcaugccguuucauaauauucacccucuuacaaucggcgagugccccaaauaugugaagucuaaccggcugguccucgccaccgggcugcgcaauaccccucagagagagcggcgccggaaaaagagaggacuuuucggcgcgaucgccggcuuuauugaagggggauggcagggcaugguggaugggugguacggauaucaucacuccaacgagcagggcagcuguuacucugcugacaaggaaagcacacaaaaagccaucgacgggguuacgaauaaggugaacuccauuaucaacaaaaugaauacccaguucgaggcugucggacgcgaauuuaacaaucuggagagacggauugagaaccucaauaagaaaauggaagauggcuuccuggacguguggacauauaacgccgagcugcucguucugauggaaaaugagagaacccuugauuuccacgacucuaacgugaagaaucuguacgauaagguccgccuccagcugcgggacaacgccaaagaacuuggcaaugggugcuuugaguucuaccauaagugugauaacgagugcauggaaagcgugaaaaauggaacauaugacuacccccaauauuccgaggaagcuagacugaaccgcgaggagaucagcggcgucaagcucgaaucuauggggaccuaccaguccggacggcuggugcccagaggcagcccugggucuggcuauaucccggaggcgccccgcgauggacaggccuacguucggaaagacggcgaaugggugcugcucuccacguuucuggggaagccuauucccaauccucuucugggacucgauagcacaggc

SEQ ID NO: 43723 - RNA, 1755 nt, Artificial Sequence; identical to SEQ ID NO: 43722
  derived and/or modified sequence opt5 from anti-influenza_Chain

SEQ ID NO: 43724 - RNA, 1947 nt, Artificial Sequence
  derived and/or modified sequence opt5 from anti-influenza_Chain
augggcgacaagaucaacuucauuuuugggauccacaaucaucagccccugggaaacuucggcuggguguuugaggaagccuacgagaaaugcuauuggccuuuccucgaaacccuggaggaauacccgaauaugaaggucgcuauucacacaagcgggccccuuaucgaguggcugcaagauaacagaccugaguauauugaccuccugcggucccuuguuaaacgcggacagguggaaaucguggucgccggcuuuuacgagcccgugcuggcgucuaucccuaaggaagauagaauugagcagauccggcucaugaaagagugggcuaagagcauuggguucgacgcccgcggaguuuggcugacggaaagaguguggcagcccgagcuggucaagacccucaaagaauccggcaucgauuaugugauuguugacgauuaccauuuuaugucugccggccugagcaaggaggaacuuuauuggccuuacuacacagaggacgggggagaggugaucgcugucuucccgauugaugaaaaacugcgguaucucauccccuuucgcccuguggacaaggugcuggaguaccuucacucccugaucgauggcgacgaaucuaaagucgccguuuuccaugaugacggggagaaguuuggaauuuggcccggcaccuaugaauggguguacgagaagggguggcucagagaguucuuugaccggaucagcuccgaugaaaagauuaaucugaugcuguauacagaguaccucgaaaaguauaaaccucgcggacugguguaccuucccaucgcuagcuacuucgagaugucugaauggucccugccggccaagcaagcgagacucuucgucgaguuugugaacgagcugaaaguuaagggcauuuucgaaaaauaucggguguuuguccgcggcgggaucuggaagaauuucuuuuacaaguauccugagagcaacuacaugcacaaaagaaugcuuauggugucuaagcugguucggaauaaccccgaagcccgcaaauaucuccugagagcucaguguaaugacgccuacuggcacggacuguucggcgggguguaucucccucaucugcggagagcuaucuggaacaaucuuauuaaggccaacuccuacgucagccugggaaaagugauccgcgauauugacuacgauggcuuugaggagguccucaucgaaaaugacaacuucuaugcgguguuuaagcccucuuacgggggaucccugguugaguucagcuccaagaaccggcuugugaauuaugucgaugugcuggccagacgcugggaacacuaccauggcuauguugagucucaguuugacggcguggcuagcauucacgaacucgagaaaaagauccccgaugagauccggaaagaagucgccuacgacaaguauagacgcuucaugcugcaggaucacguggugccucuggggaccacacucgaggacuuuauguucucccggcaacaggaaauuggagaguucccgagaguucccuacagcuacgaacugcuugacggcgggauccgccugaaacgggagcaucucggaauugaggucgaaaagaccgugaagcuggugaacgauggcuuugaggucgaauauaucgugaauaacaaaacggggaauccuguucuguucgcuguggagcuuaacgucgccgugcagucuauuauggaaucccccggcguucucagaggaaaggagaucguggucgacgauaaauacgccgugggcaaguuugcucugaaauucgaggacgaaauggagguuuggaaguauccugugaagacccugagccagucugaaagcgggugggaucucauucaacagggagucuccuacaucgugcccauccgccuggaggacaaaauucgguuuaaacuuaaauucgaggaagcgucuggc

SEQ ID NO: 43725 - RNA, 1947 nt, Artificial Sequence
  derived and/or modified sequence opt5 from anti-influenza_Chain
augagcagaaugacccugaaguccucuaugaaaaagcgggugcucagccugcuuaucgccgucguuuuccugucccucacaggcguguuucccucugggcugauugagacgaaagugagcgcugccaagaucaccgaaaacuaccaguucgacucccgcauuagacuuaauucuaucggauuuauuccuaaccacagcaaaaaggcgacaaucgcugccaauugcuccaccuucuaugucgugaaggaggauggcacaaucguuuacaccgggacagccaccagcauguuugacaacgauacgaaagaaaccguguauauugcugacuucucuuccgucaaugaggaaggaacauacuaucuggccgugccgggcguugggaaaagcgugaacuuuaaaaucgcuaugaaugucuacgaggaugccuucaagaccgcgaugcucggaauguaucugcugcgguguggcacaucuguguccgccaccuacaacggcauucauuacagccacgggcccugccauacgaaugacgcuuaucucgauuacaucaacggacaacacacaaagaaggacucuaccaagggcuggcaugaugccggggacuauaauaaauacguggucaacgcuggaauuacaguuggcuccauguuucuggccugggagcacuucaaggaucagcuugaaccuguggcgcuggagauccccgagaaaaauaacagcauuccugacuuucucgaugaacugaaguaugagaucgacuggauccuuaccaugcaguaccccgacggguccggacgcguggcccacaaagucucuaccagaaauuucggcggcuuuauuaugccugaaaacgagcaugaugaacgguucuucgugccguggagcuccgcugccacagcugacuuuguugccaugacggccauggcugcgcgcaucuucagacccuaugauccucaguacgccgagaaguguauuaacgcugccaaagugagcuacgaauuucugaagaauaaccccgccaaugucuucgcuaaccaaucuggguuuuccaccggagaguaugccacagugagcgacgcggaugaccggcucugggcugccgccgagaugugggaaacccugggcgaugaggaauaccugcgcgacuucgagaauagagcugcccaguuuucuaagaaaaucgaagcugauuucgacugggauaacguugccaaucucgggauguuuacauaucugcuuagcgagcggccuggaaagaaccccgcgcuggugcaguccauuaaagacucucuccugagcaccgccgacuccaucguccgcacgagccagaaucacggcuacgggagaacacuuggaaccaccuauuacuggggcugcaacggcacagugguccggcaaaccaugauccuccagguggcuaauaagauuucuccgaacaaugauuauguuaacgccgcucuggacgccaucucccauguguucgggcgcaauuacuacaacagaagcuaugucacaggacugggcauuaacccucccaugaauccucacgaucggagaucuggggcggacggaaucugggagcccuggcccggcuaccugguugggggcggauggccuggcccgaaagauuggguggacauucaggauuccuaucagacgaacgaaaucgccaucaauuggaacgcugcccucauuuacgcucuggccggguuugugaauuauaacagcccccaaaaugagguccuuuacggagacgugaacgaugacggcaagguuaauuccaccgaucugacacuccugaagcgcuaugugcuuaaagccgucucuacccugccuagcuccaaggcugagaaaaacgcggacgugaaucgggaugggagagugaacucuagcgacgucacaauccucucccgcuaccugauucgggugaucgaaaagcugcccauu

SEQ ID NO: 43726 - RNA, 1947 nt, Artificial Sequence; identical to SEQ ID NO: 43724
  derived and/or modified sequence opt5 from anti-influenza_Chain

SEQ ID NO: 43727 - RNA, 1947 nt, Artificial Sequence; identical to SEQ ID NO: 43725
  derived and/or modified sequence opt5 from anti-influenza_Chain

SEQ ID NO: 43728 - RNA, 2046 nt, Artificial Sequence
  derived and/or modified sequence opt5 from anti-influenza_Chain
augaagcccagccacuucaccgagaaaagauuuaugaagaaagugcugggccucuuccuggucguugugaugcuugccuccguggggguccugccuacaucuaaggugcaggcugccggaacgaccguuacaagcauggaauacuuuuccccggcggacggccccgugaucucuaaaagcggggucggaaaggcuuccuauggcuucgugaugccuaaguuuaacgggggaucugccaccuggaaugauguuuacagcgacgugggcgucaacgugaaagugggcaauaacugggucgauauugaccaggccgggggauauaucuacaaucagaacuggggccauugguccgaugggggauucaauggcuauugguuuacacucagcgcuaccacagagauucagcuguacucuaaggccaacgggguuaaacuugaauaucagcugguguuccaaaauaucaacaagaccacgauuaccgcuaugaaucccacacagggaccucagaucaccgccuccuuuacaggcggcgcgggguucaccuaccccacguuuaacaaugacagcgccgugacauacgaggcugucgccgaugaccucaaaguguauguuaagccugugaacucuuccagcuggaucgauauugacaauaacgcugccucuggauggaucuacgaucacaacuucggccaguuuaccgacgggggaggcggguauugguucaaugucacagaauccauuaacgugaagcuggagagcaaaaccuccucugcgaaucugguuuacaccaucacauucaacgagccgacgcggaauagcuaugugauuacccccuacgaaggaacaaccuuuacagccgaugcuaacggcuccaucggcauuccucuccccaagaucgacgggggagccccuaucgcuaaagagcugggcaauuucgucuaucaaauuaacaucaaugggcaguggguggaccuuagcaacucuucccagagcaaguuugccuacucugccaauggauacaacaauaugagcgaugcuaaccaguggggcuauugggcggacuacauuuaugggcugugguuccaacccauccaggaaaauaugcagauucgcaucggcuacccgcucaacggacaagccggcgggaacaucggaaauaacuuugucaauuauaccuucauuggcaacccuaaugcucccagaccugauguguccgaccaggaggauaucucuauugggacgcccacagaccccgccaucgccggaaugaaccugauuuggcaggaugaguuuaauggcaccacccuugacacaagcaaauggaacuacgaaaccggguauuaccugaauaacgauccugcuacauggggcuggggaaaugccgagcuccagcauuacacgaacuccacccaaaauguuuaugugcaggacggcaagcugaacaucaaagcgaugaaugauagcaagucuuucccgcaggaccccaaccgguacgcucaguauuccagcgggaagaucaacacaaaagacaagcugucucucaaauacggacgcgucgauuuuagagccaagcugccuaccggcgacgggguguggcccgcccuuuggaugcugccuaaagauuccguuuauggaacaugggcugccagcggcgaaauugacgugauggaggcucgggggcgccuccccggcuccgucucuggaaccauccacuucggcgggcaauggccggugaaucagagcuccggaggcgauuaccauuuuccugaagggcagacguucgccaacgacuaucacguguacucuguugucugggaggaggauaauauuaagugguacguggacggaaaguuuuucuauaaagugaccaaccagcaaugguacagcacagcggcccccaauaacccuaaugcucccuucgaugaaccuuuuuaucugaucaugaaccuugccgucggcgggaauuucgacggcggaagaacccccaacgcuuccgauauuccggccacaaugcaaguggacuacguucggguguauaaggagcag

SEQ ID NO: 43729 - RNA, 2046 nt, Artificial Sequence; identical to SEQ ID NO: 43728
  derived and/or modified sequence opt5 from anti-influenza_Chain

SEQ ID NO: 43730 - RNA, 2058 nt, Artificial Sequence
  derived and/or modified sequence opt5 from anti-influenza_Chain
augaccaagagcaucuacuucucccugggcauucacaaccaucagcccguggggaauuuugacuucgucaucgagagagccuaugaaaugucuuacaaaccucucauuaacuuuuucuuuaagcacccggauuuccccaucaauguucauuuuagcggauuccugcuucuguggcucgagaaaaaccacccugaauauuuugagaagcugaaaauuauggcugaacggggccaaaucgaguucguguccgggggauuuuacgagcccauccuuccuauuauccccgacaaggauaaggugcagcagauuaaaaagcugaauaaauauaucuacgacaaguucggccagacaccuaaagggauguggcucgccgaacgcgucugggagccgcaucuggugaaguauauugcggaagcuggaaucgaguacguuguggucgaugacgcccacuuuuucucugugggccugaaggaggaagaucucuucggcuacuaucugauggaggaacaaggguacaaacuugccguuuuucccauuagcaugaagcugagauaucucaucccuuucgcugaccccgaggaaacgaucaccuaccuggauaaauuugccuccgaggacaagucuaaaauugcucuccuguucgaugacggagagaaguuuggccucuggccugauacauaucggaccguguacgaagagggguggcuggaaacauucgucagcaaaaucaaggagaacuuucugcucgugacccccgugaaucuguauacauacaugcagcgcgucaagccgaaaggaagaauuuaccuuccuaccgccuccuaucgggaaaugauggaguggguucuguuccccgaggcgcagaaggaacucgaggaacugguggagaaacuuaagacggaaaaccugugggacaaauuuagcccuuacgugaagggcggguucuggcgcaauuuucucgccaaguaugacgagucuaaccacaugcagaaaaagaugcuguacgucuggaaaaaggugcaagauucccccaaugaggaaguuaaagagaaggcuauggaagagguguuccagggacaggccaacgacgcuuauuggcauggcaucuuuggcgggcuguaccucccccaccugagaaccgccauuuaugagcaucuuaucaaggcggaaaauuaccuggagaacagcgaaauccgguucaauauuuucgauuuugacugcgauggaaacgacgagaucauugucgaaucuccuuucuuuaaccucuaccuguccccgaaucacggcgggagcgugcuugagugggauuucaaaacaaaggccuuuaaccugaccaauguucucacacgcagaaaagaggcuuaucacucuaagcuguccuacgugaccagcgaagcccagggaaaauccauccaugagcgguggacggcuaaggaagagggccuggaaaacauucucuucuaugacaaucaccgcagagucucuuuuacagagaagaucuucgagagcgaacccgugcuggaggaucuuuggaaagacuccagccggcuggaagucgauucuuuuuacgagaacuaugacuacgaaaucaauaaggacgagaacaaaauucgcgugcuuuucuccgggguuuuuagaggauucgagcuguguaagagcuauauccuguacaaagauaagucuuuuguggacgucguguacgaaauuaaaaauguuagcgagaccccuaucucccuuaacuucggcugggaaauuaaucucaacuuccuggcccccaaucauccugauuauuacuuucugaucggcgaccaaaaguauccccucucuagcuucgggauugagaaggugaacaauuggaaaaucuuuuccggaaucggcauugagcuggaaugcguccuugauguggaggccagccuguaccgguauccgaucgaaacagugucucucuccgaggaaggguucgagagaguuuaccagggaagcgcucugauucacuuuuauaaggucgaccugccugugggcucuaccuggcgcaccacaauccgguucugggugaaa

SEQ ID NO: 43731 - RNA, 2058 nt, Artificial Sequence; identical to SEQ ID NO: 43730
  derived and/or modified sequence opt5 from anti-influenza_Chain

SEQ ID NO: 43732 - RNA, 2115 nt, Artificial Sequence
  derived and/or modified sequence opt5 from anti-influenza_Chain
augcccaccaaccuguucuuuaaugcccaccauagcccugugggcgcuuucgccuccuuuacacucggguucccgggaaagucuggcgggcuggaccuugagcuggcgagacccccucggcagaacguccucaucggaguugaaagccugcacgaguccggccuuuaccaugugcugcccuuucucgaaacggcugaggaagaugagucuaaacgcuaugacauugagaauccugaucccaacccucaaaagccgaauauccugauucccuucgccaaagaagagauccagagagaauuucacguggccaccgacacauggaaggcuggggaucugaccuucacaauuuacagcccugucaaagccgugcccaacccugagaccgcugacgaggaggaacucaagcuggcccuuguucccgcggugaucgucgaaaugacaaucgauaauaccaacggaacgcgggcccgcagagccuuuuucggcuuugagggcaccgacccguauacauccaugcggcgcauugaugauaccugcccucagcugagaggggugggacagggccggauccucucuauuguuagcaaggacgaaggggugcgcuccgcucugcauuucagcauggaggacauccuuacagcucaacuggaggaaaauuggaccuuuggacucggcaaagucggggcccugauuguggaugugcccgcgggagagaagaaaacguaccaguucgccgucuguuucuauagaggcggcuacguuacagcugggauggacgccucuuauuuuuacacccgguucuuucagaacaucgaagaggugggacuguacgcucucgaacaggccgaggugcugaaggagcaauccuuccgcagcaauaaacuuauugaaaaggaguggcugucugacgaucagacauuuaugauggcccacgcuaucagauccuauuacggcaacacccagcuccuggaacacgaggggaagccuaucugggucgugaaugaaggagaguaucggaugaugaacaccuucgaccuuacaguugaucagcuguuuuucgagcucaaacugaaucccuggacggugaagaacguccuggaccucuacguggaacgcuauagcuacgaggauagaguucgguuucccggcgaagagaccgaguauccuucugggauuuccuucacacaugacaugggaguggcgaacaccuuuagcagaccgcacuacuccucuuacgaacuguauggcaucagcggcugcuucucccauaugacacacgagcaacuugucaauugggugcugugugccgcugucuacauugaacagaccaaagauugggccuggcgcgacaagcggcucgccauccuggagcagugccuugaaagcauggugagacgcgaucaccccgacccugagcaacggaacgggguuaugggacuggauucuacgagaacaaugggcggggcugagauuaccaccuaugacucccucgacgugagccugggacaggcccgcaauaaccuguaccucgcgggcaaauguugggcugccuaugucgcccuggaaaaacuuuuucgggauguggggaaggaggaacuggcugcccucgcuggcgagcaggccgaaaagugcgcggccacaaucguuucucaugugaccgacgauggauacauccccgcuauuaugggcgaggggaaugacagcaagaucauuccugccaucgagggacuggucuuccccuauuucacaaacugucacgaagcucuggaugagaauggcagauuuggggccuacauucaggcgcuucgcaaccaucuccaauacgugcugcgggaaggaaucugccuguucccggacggcggguggaaaaucuccucuacgagcaauaacuccuggcucagcaagauuuaucugugucaguuuaucgccagacacauucuuggcugggagugggaugaacagggaaaacgcgcugacgccgcucauguggccuggcugacccacccuacacucucuaucugguccuggagcgaucagauuaucgccggcgagauuaccgggucuaaguacuauccccggggaguuacauccauccuguggcuggaggaaggcgag

SEQ ID NO: 43733 - RNA, 2115 nt, Artificial Sequence; identical to SEQ ID NO: 43732
  derived and/or modified sequence opt5 from anti-influenza_Chain

SEQ ID NO: 43734 - RNA, 2148 nt, Artificial Sequence
  derived and/or modified sequence opt5 from anti-influenza_Chain
auggaggacuucgugagacagugcuuuaaccccaugaucgucgaacuggccgagaaggcuaugaaagaauacggcgaggaucucaagauugaaaccaauaaauucgccgcgaucuguacacaccuggagguuugcuuuauguauagcgacuuccauuuuauuaacgagcaaggggaauccaucauuguggagccugaagauccgaaugcucuccugaagcaccgguucgagaucaucgagggacgcgacagaacgauggccuggaccguggucaacucuauuuguaauacaaccggcgccgaaaaacccaaguuucucccugaucuguacgacuauaaggagaaccgguucaucgaaauuggggugacacgcagagagguucauaucuacuaucuugaaaaagcuaauaagauuaaaagcgagaagacccacauccauaucuuuuccuucacaggagaggaaauggccaccaaagcugauuacacgcuggacgaggaaucucgggcccgcauuaagaccagacucuuuacaauccggcaggagauggcgagccgcggccugugggauuccuucagacagucugaacgcggggaggagaccauugaggaacgguuugaaaucacaggaaccaugagacggcuggccgaccagagccuucccccuaacuucuccugccuggagaauuuccgcgcuuauguggauggcuuugaacccaacggcuacauugaggggaaacuuagccaaaugucuaaagaggucaaugccagaaucgaaccuuuccugcggacgacaccgagacccauucgccucccugacggacccccuuguuuucagcgguccaaguuccugcuuauggauagccugaaacucucuaucgaggaccccucccacgaaggcgaggggaucccgcuguacgacgcuauuaagugcaugagaaccuuuuucggauggaaagagccuagcgugguuaagccccacggcaaagggaucaacccuaauuaucugcucucuuggaaacaggugcuggccgaacuucaggauauugaguccgaagagaagaucccccgcacaaagaacaugaagaaaaccagccaacugaagugggcgcucggagaaaauauggcccccgagaaagucgacuuugaugacuguaaggauauuuccgaccugaagcaguacgauucugacgagccugaacuucggagccuguccagcuggauccagaacgaguucaacaaggcuugcgaacucaccgauucuaucuggauugagcuggacgaaaucggcgaggauguggccccgauugagcauaucgcuuccaugagacgcaauuauuuuacagccgaagugagccacugucgggccacggaguacauuaugaagggcgucuauaucaacaccgcucugcucaaugcgucuugcgccgcuauggacgacuuccagcugauucccaugaucagcaaauguagaacaaaggaagggcgccggaaaaccaaccuuuacggauuuaucauuaagggcagaucccaucugcgcaaugauacagacguugugaacuucgugucuauggaguuuagccucaccgauccucggcuggaaccccacaagugggagaaauauugcguccuugagaucggggacaugcugcucagauccgccauuggacaagugagccggccuauguuccuguacguucgcacgaauggcacaucuaagaucaaaaugaagugggggauggaaaugagacggugccugcuccagucccugcagcaaauugagagcaugaucgaagccgagucuuccgugaaagagaaggauaugaccaaggaguucuuugaaaacagaagcgaaaccuggcccaucggagaguccccgaaaggcgucgaagagggcucuauugggaaggugugucgcacacuucuggcuaaaagcguuuucaauucccucuacgccucuccucagcuggagggauuuagcgcggaaucccggaagcugcuucucaucgugcaggcucugagagacaaccuggagcccggcaccuucgaucucgggggacuguaugaagccauugaggaaugccuuaucaaugacccuuggguccugcucaacgccagcugguuuaauucuuuccugacacacgcucugcgc

SEQ ID NO: 43735 - RNA, 2148 nt, Artificial Sequence; identical to SEQ ID NO: 43734
  derived and/or modified sequence opt5 from anti-influenza_Chain

SEQ ID NO: 43736 - RNA, 2256 nt, Artificial Sequence
  derived and/or modified sequence opt5 from anti-influenza_Chain
augaacaucaaucccuacuuccuguuuauugacgugccuauccaggccgcuauuagcaccacauucccguauacgggcguucccccuuacucccacgggaccggaacaggcuauaccaucgauacagucauuagaacccaugaguacucuaacaaggggaaacaauauaucagcgacgugacaggaugcgugauggucgaucccaccaauggcccucuccccgaagacaacgagccuuccgccuacgcgcagcuggauugugugcuugaagcucuggaccggauggaugaggaacacccggggcucuuucaggccggaucucagaaugccauggaggcucugaugguuacgaccguggacaagcugacacaaggccgccagaccuucgauuggacagucugcagaaaccagcccgccgcuaccgcccuuaauacgacaaucaccagcuuucggcucaacgaccugaauggcgcggauaaagggggacuggugccuuucugucaggacauuaucgauucccucgacaagcccgagaugaucuuuuucacaguuaaaaacauuaagaagaaacugccugccaagaaucgcaaaggcuuucuuauuaagagaauccccaugaaagugaaggaccggauuacccgcgucgaauauaucaagagagcucugucucucaacaccaugacaaaagaugccgagcgggggaagcugaaacgcagagcuaucgccacggcggggauucaaauccggggcuucgugcuuguggucgaaaaucuggccaagaacauuugcgagaaucucgagcagagcgggcugccgguuggaggcaacgaaaagaaggcuaaacuguccaacgccguggcuaagaugcucagcaauuguccucccggcgggaucucuaugaccgugacaggagacaacaccaaguggaaugagugccugaacccucgcauuuuucuugccaugacagaaagaaucacccgggauucccccaucugguuccgcgacuuuuguagcauugcccccguccuguucucuaauaaaaucgcuagacucggcaagggguucaugauuacguccaaaacaaagcggcugaaagcgcagaucccuugcccggaucuuuuuaacauuccccuggagagauacaaugaagagacccgcgccaagcucaagaaacugaagccuuucuuuaacgaggaaggaaccgcuagccugucucccggcaugaugauggggauguucaauaugcucuccacagugcugggaguugccgcccuuggcaucaaaaacaucggcaauaaggaguaccugugggacgggcuccagagcuccgaugacuuugcucuguucgugaacgccaaagaugaagagaccuguauggaaggaauuaaugacuuuuaucggacaugcaaacuucugggcaucaacaugucuaagaaaaagagcuacuguaaugagacggggauguucgaguuuaccuccauguucuauagagauggauuugucagcaacuucgcgauggaacucccuucuuuuggcguggcugggguuaacgaguccgccgacauggccauuggcaugacaaucauuaaaaauaacaugaucaauaacggaaugggccccgcuaccgcccaaacagcuauucagcuguucaucgccgacuaccgcuauaccuacaagugccaucggggagauagcaaaguggaaggaaagagaaugaagaucauuaaagagcugugggaaaauacgaagggccgcgacgggcuccuggucgcggauggaggcccgaaccuuuauaaucugcggaaccuccacaucccugagauuauccugaaauacaauauuauggaccccgaguacaaggggagacugcuucauccucagaaccccuucgugggccaccucucuaucgaaggaaucaaagaggccgauauuaccccugcucacggccccaucaagaaaauggacuaugaugccgucagcgggacacauuccuggcgcaccaagcggaauagaucuauucugaacacagaccaacgcaauaugauccuggaggaacagugcuacgcuaaguguugcaaccucuuugaggccuguuucaauagcgcguccuaucggaaaccggugggacagcacagcaugcuggaagccauggcucauagacuucggauggaugcccgccuggacuacgagucuggcagaauguccaaggaagauuuugagaaagcuauggcccaccucggggaaauuggauauaug

SEQ ID NO: 43737 - RNA, 2256 nt, Artificial Sequence; identical to SEQ ID NO: 43736
  derived and/or modified sequence opt5 from anti-influenza_Chain

SEQ ID NO: 43738 - RNA, 2265 nt, Artificial Sequence
  derived and/or modified sequence opt5 from anti-influenza_Chain
auggccguggacaucaagaaaauuaucaagcagaugacccuggaggaaaaagcuggccucugcagcgggcuggauuucuggcacacaaagcccgucgagagacuuggcauuccuuccaucaugaugacggacggaccgcaugggcugcggaaacaacgcgaagaugccgagauugcggacaucaacaauucuguucccgcuaccuguuuuccuagcgccgccggacucgcuugcuccugggauagagaacugguggagcgggugggcgccgcucuuggggaggaaugucaggccgagaacgucucuauccugcucggacccggcgcgaauauuaagcgcagcccucugugcggcagaaacuucgaauacuuuuccgaggaccccuaucugucuagcgagcucgccgcuucccacaucaagggggugcagagccagggaguuggcgccugucugaaacauuucgcugccaauaaccaagaacaccggcgcaugacaguggauaccauugucgacgagagaacacuucgggaaaucuacuuugcgucuuucgagaaugccgugaagaaagcucgcccuuggguugugaugugcgccuauaacaagcugaauggggaauacuguuccgagaacagauaucuccugaccgagguccuuaaaaaugaauggaugcaugauggauuuguggugagcgacuggggcgcugucaacgaucggguuucugggcuggacgccggacucgaucuggagaugccgacaucccacggcauuaccgacaagaagaucguggaagccgugaaaagcggcaagcugucugagaauauucucaaccgcgcugucgaaagaauccugaaagugaucuucauggcgcuugagaauaagaaagagaacgcccaguacgacaaggaugcucaccaucggcuggcccgccaggccgcugccgaauccaugguucuccugaaaaacgaggacgaugugcuuccccugaagaagucugggacgauugcgcucaucggagcuuuugucaaaaagccuagauaucagggcuccgggucuagccacauuacccccacacggcuggacgauaucuacgaagagauuaaaaaggccggaggcgacaaagugaaucugguuuacuccgaaggguauagacucgagaacgauggaaucgacgaggaacugaucaaugaggccaagaaggcugccagcagcuccgauguggcugucguguucgccggccuuccugacgaauacgagagcgagggcuuugaucgcacccauaugucuauucccgaaaaccaaaaucggcugaucgaggcggucgccgaagugcagagcaacauuguugugguccuccugaauggguccccgguggagaugccuuggaucgacaaaguuaagucugugcuugaggcuuaucugggaggccaggcccucgggggagcucuggccgacguccuguucggcgaagugaaccccagcgggaaacucgcggagacauuuccugugaagcugucccacaaucccagcuaccuuaacuuccccggcgaagaugacagaguugaguauaaagaaggacuguucgucggcuaccgcuauuacgauaccaaggggauugagccucucuuuccguucggacacggccugucuuacacgaaguuugaauauuccgacaucagcguggauaaaaaggacgugucugauaauuccaucauuaacgucagcgugaaaguuaagaauguggggaaaauggccggaaaggagaucguccagcuguacgugaaggacguuaaauccucugugcggagacccgagaaggaacuuaaaggcuucgagaaggucuuucucaacccuggggaagagaaaacagugaccuucacacuggauaagcgcgcuuuugccuauuacaauacccaaauuaaagacuggcauguugaaagcggcgaguuccugauccucauuggacgguccucuagagauaucgugcugaaggagagcguccgcgugaacuccaccgugaagauucggaaaagauuuacagucaacagcgcuguugaagacgugaugucugauuccagcgccgccgcugugcuuggccccguccugaaggagaucacggacgcgcuccagaucgacauggauaaugcccacgacaugauggcugccaacauuaaaaauaugccucugcgcucucuggugggguauucccagggacggcuuagcgaagagaugcucgaggaacugguugauaagaucaacaauguggag

SEQ ID NO: 43739 - RNA, 2265 nt, Artificial Sequence; identical to SEQ ID NO: 43738
  derived and/or modified sequence opt5 from anti-influenza_Chain

SEQ ID NO: 43740 - RNA, 2277 nt, Artificial Sequence
  derived and/or modified sequence opt5 from anti-influenza_Chain
auggagagaaucaaggaacugcggaaccucaugagccagucccgcaccagagagauucugacaaaaacgaccguggaccacauggccaucauuaagaaauacacaucuggccggcaagaaaagaaucccgcccuucgcaugaaauggaugauggcuaugaaguauccuaucaccgcggauaagagaauuacagagaugaucccggaacggaacgagcaggggcagacccuguggagcaaaaugaaugacgcuggauccgaucgcgucaugguuucuccccucgccgugacaugguggaacagaaauggcccuaugaccaacacggugcauuaccccaagaucuauaaaaccuacuucgagcgggucgaacgccugaagcacgggacauuuggaccugugcauuucagaaaucagguuaaaauucggcgcagaguggacaucaaccccggccacgccgaucuuagcgcuaaggaggcccaagacgucauuauggaagugguuuuuccuaaugaggugggggcucggauccugaccuccgagucucagcucacaauuaccaaggagaaaaaggaggaacugcaggauugcaaaaucagcccgcugauggucgccuauaugcucgagcgcgaacuggugagaaagacgcgguuccuucccguggcgggaggcacauccagcgucuacauugagguucugcaucucacccagggcacauguugggagcaaauguauaccccugggggagaagugaaaaacgacgauguggaccagucucugaucaucgccgcuagaaauauuguccgccgggccgcuguguccgccgauccccuugcgagccugcucgagaugugccacucuacccagaucggcgggauuagaaugguugacauccugaagcagaacccuacagaagaacaagccgugggaauuuguaaagcugccaugggccugcgcaucuccagcucuuuuuccuucgggggauuuacguucaagcggaccagcggcuccucugucaagagagaagaggaggugcucacaggcaaucugcagacccuuaaaauccgcguucacgaaggguacgaggaauuuacaauggugggacggagagcuaccgccauucugcgcaaggccacgcggagacucauccagcugauugucagcggccgcgaugagcaauccaucgcugaagcgauuaucguggccauggucuucagccaggaggacugcaugaucaaagcugugagaggggaccuuaacuuuguuaaucgggccaaccagcggcugaaccccaugcaucagcuccugcgccacuuccaaaaggaugccaaagugcuguuucagaauuggggagucgagccgauugacaacgugaugggcaugaucgggauucucccugauaugacacccucuaucgaaauguccaugagaggaguucggauuagcaagaugggcguggacgaguacucuagcaccgaaagagucgugguguccaucgaucgcuuccugcggguuagagaccagcgcggcaauguccuucugucuccugaggaggugagcgaaacccaggggacagagaagcucaccauuacauauuccagcucuaugaugugggaaaucaacggacccgaguccgugcuggucaauacguaccaauggaucauuagaaacugggaaaccgugaaaauccaguggagccagaaucccacaaugcuuuauaacaagauggaguucgagccuuuucagucucugguuccgaaagcuauucggggccaauacuccggguucgugcgcacccucuuucagcagaugagagauguccugggaacauucgacaccgcccagaucauuaagcugcuccccuuugcggcugccccucccaaacaaagccggaugcaguucuccucuuuuacggugaauguucgcggcagcgggaugagaauccuggugcggggcaacuccccugucuucaauuauaacaaggccaccaagcgccuuacagugcugggaaaagaugcuggcacccucacagaagaccccgaugaggggaccgccggaguugaaucugcugugcugagaggcuuucugauccuugggaaggaggaccggcgcuacggaccggcccucagcauuaaugaacuguccaaccuggcgaaaggcgagaaggccaauguccucaucgggcagggcgacguggugcuggucaugaaaagaaagcgggauagcucuauucuuacggacucccaaacagcuaccaagagaauccgcauggccauuaac

SEQ ID NO: 43741 - RNA, 2277 nt, Artificial Sequence; identical to SEQ ID NO: 43740
  derived and/or modified sequence opt5 from anti-influenza_Chain

SEQ ID NO: 43742 - RNA, 2472 nt, Artificial Sequence
  derived and/or modified sequence opt5 from anti-influenza_Chain
augaugcugagaaagaaaaccaagcagcucaucagcuccauucugauccuugugcugcuccugucucuuuuccccgccgcucuggccgcggagggcaacacacgggaagacaauuuuaaacaccuccuggggaacgauaaugucaagcgcccuagcgaggcuggagcccugcaacuccaggaaguugacggccagaugacgcugguggaucagcauggggagaaaauucaacuuagaggaauguccacccacggccugcagugguucccggaaauccucaacgacaaugccuacaaggcucugucuaacgauugggacagcaauaugauucggcuugccauguaugugggggagaacggauacgcuacaaaucccgagcugaucaagcagcgcgucaucgauggcauugaacucgccaucgagaacgacauguaugugauuguugauuggcaugugcacgcgccuggcgaccccagagauccugucuacgccggggcuaaagacuuuuuccgggaaaucgccgcucuguaucccaauaacccucauauuaucuacgagcuggccaaugagccguccucuaacaauaacggaggcgcggggauucccaacaaugaagagggauggaaggccgugaaagaauaugcugauccuaucguugagaugcuccgcaagagcggcaacgccgacgacaauaucauuaucguggggucccccaacuggagccagagaccugaucuggcugccgacaaucccauugaugaccaccacaccauguacacaguccauuuuuacaccggaucucacgccgcuuccacagaaagcuauccgucugagaccccuaacuccgagcggggcaaugugaugagcaacacgcgcuacgcgcuugaaaauggcguggccgucuucgcuaccgagugggggacaucucaagccuccggagauggcgggcccuauuuugacgaagccgauguuuggaucgaguuccugaacgaaaauaacauuagcugggcuaauuggucccucaccaacaaaaaugaggugucuggagccuuuacaccuuucgagcugggcaagagcaacgcgaccaaccuugaccccgggcccgaucaugugugggcuccugaggaacugucccucagcggagaauacgucagagcccggaucaagggcgugaauuaugagccgaucgaccgcacgaaauacacaaagguucugugggauuuuaacgacggcaccaaacagggguucggagugaauagcgacucccccaacaaggaacugauugccgucgauaaugagaacaauacacucaaagugagcggccuggacguuucuaacgaugugagcgacgggaauuuuugggcuaacgccagacuuuccgcuaauggauggggcaagucugucgauauccugggggccgagaaacucaccauggacgugauugucgaugaaccuaccacaguggcgaucgccgcuauuccccagagcuccaagagcggcugggccaacccugagcgggcuguucgcgugaaugccgaagacuucguccagcaaacggauggaaaguauaaagcgggccugaccaucacaggggaggacgcccccaaccuuaagaauaucgcuuuccacgaggaagauaacaacaugaauaacauuauccuguuugugggaaccgacgccgcugauguuauuuaccucgacaauaucaaagugauuggcacagaggucgaaaucccgguggugcacgacccuaagggggaggccguucugcccucugucuucgaagauggaaccagacagggcugggacugggccggggaguccggcgugaaaacggcucugacaauugaggaagcgaacggaagcaaugcccucucuugggaguuuggcuacccugaagugaagcccuccgauaacugggcuaccgccccucggcuggacuucuggaagucugaucuugucagaggggagaaugacuauguggccuuugauuucuaccuggaccccguucgcgcuaccgaaggagccaugaacaucaaucucguguuucagccgccuacaaacggcuauuggguccaagcgcccaaaaccuacacaaucaauuucgaugagcuggaggaagcuaaccaggugaaugggcuguaucauuacgagguuaagauuaacgugcgggacaucacgaauauucaggaugacacccuucucagaaacaugaugaucauuuuugccgaugucgaauccgacuucgccggacgcguguuuguugacaacgugcgguucgagggcgcugccacaaccgaacccgucgagccugagccgguggaucccggggaagagacaccucccguggacgaaaaagaggcgaagaaagagcagaaggaagcugagaaggaagagaaagaagccgucaaggaggagaaaaaggaagccaaagaggaaaagaaggcuguuaaaaaugaggccaagaaaaag

SEQ ID NO: 43743 - RNA, 2472 nt, Artificial Sequence; identical to SEQ ID NO: 43742
  derived and/or modified sequence opt5 from anti-influenza_Chain

SEQ ID NO: 43744 - RNA, 3063 nt, Artificial Sequence
  derived and/or modified sequence opt5 from anti-influenza_Chain
auggccggcccccacagaagccgggcugccgggccuccgcccuucgcgguggacgagcaugucgcucuggaaaugguugccuuucgcggagagguguucgccggccacgggcuccuggcugaucagagacuuaucgcccauaccggacggccugcucugaacgcccaacgcauuacacagcagaagcagagagaccaaugccggggccagcgccacagacaucaccaagggggacggaaucuccgcaaagcgcacagaacguuucaugaacaccaguccacccaggaucaggcccaugacgcuccccacggccagcaggccaagacaggccacgaggggcugggacaugaacacgcucaagcccagcaucagcaaggccagucuaacguggucgaucggcaggacggggagccuguggaggcgcagcaccaaaaagauggagcccagcgcgcuggcaaugcccccgcugggagaguugaacuugagcagcagccuguggaagcccaacaucagcagcaggagggagacguccggaucggcaagcgcagacaaaacgccuucgcuccgcccgcgcuggaucacgugcacggcgggccuggacggcuccagagacauggccuggccguugagcgccacgugcccgcuguccagcagcaucaacagcgggugcagagagggcgccaacagauugaccacgugcugggacacggccucccugggcggcagagacuggccuuucgcgauggaccccggagaccggucggcguugccagcccugugcuuggccagcgccccuguccugggcaucggaucgugcaaaaucuguucagacacggaauugaccccugccgcgucggccgguguagacggucccccucugaacuccaugggaugggaugcgcugaugugcgcgccagaggccacgggcggcauaugagaggccagcgcgacgagcacccuggacggggcagaccgugugcgcgcagacggcacguugacgaugaccgcgauagaacaccccaggaaaaacuguacgacguggcucgggggcuugaugagccugcccgcagaguccauuuugacgaugaagccgaccggagcguguuccgcggacuggcucagcccgccccugaugagcccgagggcagacggcgcgacagacucguucugcaacggcaguccgugaaccacagacgcgggcggcugucuagacaucgccagcagcaccaaccgcagcagcaacggccucauggaaaucaggcuuuucucggcaaguaugaaaagagacgccggaaacccaccgccugccuuaagagccugagacgcuucccugauaaagacgcgcccguccuguacuuugugaaccagcucgagaagaccaaacggagaaugacacugcuucuggucuggcucaucuucaccgggguggccggcgaaauccggcuggaggcugaagacggagagcugcucggcguugccguggauuccacgcugaccggguauagcggacgcggcuacgucacaggguuugacgcuccugaggauucugugagauucuccuucgaagcgccccggggaguuuaucgcguggucuuuggcgugagcuucucuuccagauuugccagcuacgcccuucggguggacgauuggcaccagaccgggucucugauuaagagaggcggaggcuucuuugaggcuuccaucggggaaauuuggcucgacgagggagcccacacaauggcuuuccaacugaugaauggcgcccuugauuauguucgccuggaaccggucagcuacgggccucccgcccggcccccugcucagcucuccgacucucaggcgaccgccagcgcucaggcccuguuugccuuccugcucuccgaguacggaagacauauccuggcuggccaacagcagaacccguaucgccgggauuuugacgccauuaauuacgugagaaacgugacggggaaggagcccgcgcuugucagcuucgaucugaucgacuauucuccuacacgcgaagcucacggcgugguucauuaccagacccccgaggauuggauugccugggccggacgggacggcaucgugucccucauguggcacuggaaugcuccuacagaccugaucgaagaucccagccaagacuguuauuggugguacggguuuuauaccagaugcaccacauucgaugucgccgcggcucuggccgacacgucuagcgagcgcuacagacuucuccugcgggauauugacgugaucgccgcucagcugcagaaauuucagcaagccgauauuccuguucucuggcgcccccugcacgaggcugccggaggcugguucugguggggagcgaaggggccggaaccuuucaaacagcuuuggagacugcucuacgagcggcuggugcaucaccauggccugcacaaccuuaucugggucuauacccaugaacccggcgccgcugagugguacccuggggacgccuauguggauauuguuggacgcgacguguacgcugaugaccccgaugcccucaugagauccgacuggaaugaacugcagacacuguuuggcgggcggaagcucgucgcccugaccgagacaggaacccuuccggacguggaggugaucacggauuauggcaucugguggucuugguucagcauuuggacagacccuuuucugagagaugucgaccccgaucgccucacccggguuuaccacuccgaaagagugcugacccgcgacgagcugccugauuggcggagcuaugugcuucacgcuacaaccguccaacccgcgggggaccucgcccuggcuguguaccccaacccuggagccggcagacugcauguugaagugggccucccggucgccgcucccgugguuguggaggucuucaaccugcuugggcagcggguguuucaguaccaggccggaaugcaaccugcgggccuguggcgcagagcuuucgaacucgcccuggcccccgggguuuaucuggugcagguccgggcuggaaaucuuguggcccgcagacggugggugucuguccgc

SEQ ID NO: 43745 - RNA, 3063 nt, Artificial Sequence; identical to SEQ ID NO: 43744
  derived and/or modified sequence opt5 from anti-influenza_Chain

SEQ ID NO: 43746 - RNA, 3165 nt, Artificial Sequence
  derived and/or modified sequence opt5 from anti-influenza_Chain
augagaaagaaacggcgcggcuuccugaacgccagcaccgcugugcucgucgggauccuggccggauuucuuggcguugugcuggcggcuacaggggcccucggauucgccgugagagagucccugcuucugaagcaguuucucuuccugucuuuugaaggcaauacggacggggcuagccccuucggaaaagaugucgugguuaccgccucccaagacguggcugccgauggcgaguacucucugaaggucgaaaaccggacaagcgugugggacggcguugagauugaucucaccgggaaagugaauacaggaaccgacuaucugcuuuccuuucacgucuaccagacaucugauagcccucagcuguucuccgugcucgcgcgcaccgaagacgagaagggcgagagauauaagauccuggccgauaaaguggucguuccgaacuacuggaaggaaauucuugugcccuuuagcccuacguucgaggggacccccgcuaaauuuucucugaucauuacauccccuaagaaaaccgacuucguguuuuaugucgauaaugugcagguucucacacccaaggaagccggaccuaagguggucuacgagaccagcuucgagaaaggcaucggggacuggcaaccgcggggaucugaugugaagaucuccauuagccccaaaguugcucauucuggcaagaaaucccuguucgugagcaaccgccagaagggcuggcacggggcccagaucucccugaaaggcauucucaagacgggaaagacauaugcguuugaagccugggucuaccaggagucugggcaagaccagaccaucauuaugacaaugcagagaaaauacagcuccgacagcucuaccaaguaugaauggaucaaagcugccaccgugccuuccggacaguggguccaacugagcggcacauacacgauucccgcuggggugaccguugaggaucuuacacuguauuucgaaucucagaauccuacccucgaguuuuacguggacgaugucaaggugguugacacaaccagcgccgagaucaaacuggaaaugaaccccgaggaagagaucccggcccuuaaggaugugcugaaggacuauuuccgggucggaguggcucucccuuccaaaguguuuauuaaucagaaggauaucgcgcugauuucuaaacauagcaacuccagcacggccgaaaaugagaugaagcccgacucucugcucgcuggcaucgagaacggcaaacugaaguuccgcuuugaaacagccgauaaguacauugaguucgcccaacagaaugggaugguugucagaggacacacccuuguguggcauaaccagaccccugaaugguuuuucaaagacgagaauggcaaccugcucuccaaggaagagaugacagagcggcugcgcgaauauauccacaccguggucgggcacuuuaaaggaaagguguacgcuugggauguugugaacgaggccgucgaccccaaucagcccgacggccuuagacggagcacaugguaccaaaucauggggccugauuauauugaacuggcguucaaauuugcucgcgaggccgacccgaacgccaaacucuucuacaaugauuauaacacguucgagcccaagaagagagacaucauuuacaaucuggugaagucucugaaagaaaagggccucaucgauggaauuggcaugcagugccauaucucccuggcuaccgacauccggcagauugaggaagccaucaaaaaguuuagcacaauuccugggaucgagauucacaucaccgaacuugauauuuccguuuauagagacucuacaagcaacuacuccgaggcuccccgcaccgcccugaucgagcaggcgcauaaaauggcccaacucuucaagaucuuuaagaaauauucuaaugugauuacgaacgucaccuucuggggacugaaggaugacuacagcuggcgggcuacaagacgcaaugauuggccucugaucuuugacaaagauuaccaggccaaacuugcuuauugggccauuguggcgcccgaaguucucccgccucugcccaaggaguccaagaucagcgaaggcgaggccguggucguggggaugauggacgacucuuacaugauguccaagccuauugaaaucuaugaugaggagggaaacgugaaagcuaccauccgggccauuuggaaggacagcacaaucuacgucuauggcgaaguucaggaugcuaccaaaaagcccgccgaggacgggguggccauuuucaucaauccuaacaaugaaagaacgcccuaccugcagccggaugacacauaugugguccucuggaccaacuggaaaucugaggugaaucgcgaagauguugaggugaagaaguuugucggcccuggauuccggagauacuccuuugagaugagcauuacaauccccggcguggaguucaaaaaggacucuuacaucggguuugauguugcugugauugacgauggaaaaugguauagcugguccgacaccaccaacagccaaaagacaaacacgaugaauuacggcacccugaaacuugaaggggucaugguggcgacagccaaguauggaacccccguuaucgauggcgaaauugacgacaucuggaacacaaccgaggagauugaaacgaagucuguggcuauggggucccuggagaaaaaugccacagccaagguccgcgugcucugggaugaagagaaccuguacgugcuggcuaucgucaaagacccuguucuuaauaaggauaacagcaauccgugggaacaggacuccguggagaucuucauugaugagaacaaucacaaaaccggcuauuacgaagacgaugacgcccaguuucgggugaacuauaugaaugagcagucuuucggaaccggcgcgagcgcugccagauucaagacagccgucaaacucaucgaagggggauacauuguggaggcugccaucaaguggaagaccauuaaacccuccccuaacacaguuaucggcuuuaaugugcaagucaacgaugcgaaugaaaaggggcagcgcgugggaauuaucucuuggagcgaccccacgaacaacuccuggcgggauccuucuaaauucggcaaucugagacugaucaag

SEQ ID NO: 43747 - RNA, 3165 nt, Artificial Sequence; identical to SEQ ID NO: 43746
  derived and/or modified sequence opt5 from anti-influenza_Chain

SEQ ID NO: 43748 - RNA, 3177 nt, Artificial Sequence
  derived and/or modified sequence opt5 from anti-influenza_Chain
augcaagugagaaagcggcgcggccugcucgacgucagcaccgccguucugguggggauccuugcuggauuccugggcgugguccucgccgcguccggggugcugucuuuuggaaaagaggcuagcuccaagggcgauucuagccuugaaacaguucuggcccucuccuucgaggggacgaccgaaggagugguccccuuuggcaaagacgugguucugacagccucucaggauguggcugccgacggcgaguacagccugaaggucgaaaacagaaccuccccuugggaugggguggagauugaccucacaggaaaagugaaguccggcgcugauuaucugcuuucuuuccaggucuaccaguccagcgacgccccgcagcuguuuaauguuguggcgcggaccgaggaugaaaagggggagcgcuaugacgugauccucgauaaagucgugguuucugaccacuggaaggaaauucuggugcccuucuccccuacauuugagggaacccccgccaaauacagccuuaucauugucgcuucuaagaacacgaauuucaacuuuuaucuggauaaagugcaaguucucgccccuaaggaguccggccccaaggugaucuacgaaaccagcuucgagaauggggucggagacuggcagccuagaggcgacgugaacaucgaagcuagcucugaggucgcccauagcggcaaauccagccuguuuauuucuaaucggcagaagggguggcagggagcgcaaaucaaccugaaaggcauucucaagacagggaaaaccuaugccuucgaggcuuggguguaccaaaauuccggacaggaucagacaaucauuaugaccaugcagcgcaaguacagcucugacgccagcacgcaguaugaauggaucaaauccgcuacaguuccgucuggccagugggugcaacugagcgggaccuacacaauucccgccggagucaccguggaggaucuuacccuguauuuugaaucccagaacccuacacucgaguucuacguugacgaugugaagaucgucgacacgaccagcgccgaaaucaagauugagauggaacccgagaaagagaucccugcucugaaggaagugcuuaaagauuauuucaaggugggcguugcgcugcccucuaaagucuuucucaauccgaaggacauugagcugaucacaaagcacuucaacuccauuaccgccgaaaaugagaugaaaccugaaagccugcucgcuggcaucgagaacgggaagcugaaauuuagauucgagacagccgauaaguacauccaguuuguggaagagaauggaauggugauucggggccauacccuugucuggcacaaccagacgcccgacugguucuuuaaagaugaaaacgggaaucugcucucuaaggaggccaugacagagcgccugaaggaauauauccauaccgugguuggacacuucaaaggcaagguguacgcuugggacgucgugaacgaggccguugacccuaaucaacccgaugggcuuagacgguccaccugguaccagauuaugggccccgacuauaucgaacuggcguuuaaauucgcucgcgaggccgauccugacgccaagcucuuuuacaacgauuauaauacauucgaaccgagaaaacgggacauuaucuacaaccuggugaaggaucugaaggagaaaggacucaucgacggcauugggaugcagugccacaucagccuggcuaccgauauuaagcagaucgaggaagccauuaaaaaguuuuccacaauccccggaauugagauccauaucacggaacuugacaugucugucuaucgcgauagcuccucuaauuacccugaggcucccagaaccgcccugauugaacaagcgcacaaaaugaugcaacucuucgagaucuucaagaaauauagcaacgugauuacaaauguuaccuuuuggggccugaaggacgauuacuccuggcgggccacaagacgcaacgacuggccucugaucuucgacaaggaucaucaggcuaaacuugccuacugggcuauuguggcccccgagguccucccgccucugcccaaggaaagccggaucucugagggggaagcggugguggucggaaugauggacgauuccuaucugaugagcaaaccuaucgagauucucgacgaagagggcaauguuaaggccaccaucagagcuguguggaaagauucuacgauuuacaucuauggggaggugcaggacaagaccaagaaacccgccgaagauggcgucgcuauuuuuaucaacccuaauaacgagcgcacacccuaccugcagccggacgauaccuaugccgugcuuuggacaaauuggaagaccgaaguuaaccgggaggacgugcaggucaaaaaguucgugggaccuggcuuuagacgcuacuccuucgagaugagcaucacgauucccgggguugaauuuaaaaaggauucuuauaucggauucgacgccgcugugauugaugacggcaagugguacagcugguccgacacaaccaacagccagaaaacaaauaccaugaacuacgggacccugaagcucgagggaaucauggucgcgacagccaaauauggcacgcccgugauugauggggaaaucgacgagaucuggaauaccacagaagagauugagaccaaggcuguugccaugggcucucuggauaaaaacgccacagcuaaggugcggguccugugggacgaaaauuaccuuuaugugcucgccaucgugaaggauccuguccugaacaaagacaauuccaacccgugggagcaggauagcguugaaauuuuuaucgacgagaauaaccacaagaccggauacuaugaagaugacgaugcgcaauucagagugaauuacaugaacgagcagacguuuggcacagggggaucccccgcucgcuucaaaaccgccgugaagcugauugagggcggguauaucgucgaagccgcuauuaaauggaagaccaucaaaccuacacccaauaccgugaucggauuuaacauucagguuaaugacgccaacgagaagggccaacggguggggaucauuucuuggagcgacccuacaaacaauuccuggagagaucccucuaaguucggcaaccuccgccugaucaaa

SEQ ID NO: 43749 - RNA, 3177 nt, Artificial Sequence; identical to SEQ ID NO: 43748
  derived and/or modified sequence opt5 from anti-influenza_Chain

SEQ ID NO: 43750 - RNA, 318 nt, Artificial Sequence
  derived and/or modified sequence opt5 from anti-OX40_LightChain
gagaucguggucacccagagccccgccacacugucccucucuccuggcgaaagagcuacgcugagcugccgggccucccaaucuguuagcuccuaccuugcgugguaucagcagaagccggggcaggcuccccgccugcucauuuacgacgccucuaacagagccaccggaaucccugcucgguucagcggcuccgggagcggaacagauuuuacccugacaauuucuucccuugagcccgaagacuucgccguguauuacugucaacagcgcagcaauuggccuaccuuuggccaggggacaaaaguggagaucaag

SEQ ID NO: 43751 - RNA, 321 nt, Artificial Sequence
  derived and/or modified sequence opt5 from anti-OX40_LightChain
gacauccagaugacccaaagccccuccucucugagcgccuccgugggcgauagagucacaauuacgugccgggcuucucaggggaucagcuccuggcucgccugguaccagcagaagccugagaaagcgccgaagucucugauuuaugcugccagcucccuucaaagcggaguucccucucgcuucuccggcagcgggucuggaaccgacuuuacacugaccaucuccagccuccagccugaagauuucgccacauacuauugucagcaguacaacucuuaucccccuaccuuuggcgggggaacaaaaguggagauuaag

SEQ ID NO: 43752 - RNA, 321 nt, Artificial Sequence
  derived and/or modified sequence opt5 from anti-OX40_LightChain
gacauccagaugacccaaagccccuccucucugagcgccuccgugggcgauagagucacaauuacgugccgggcuucucaggacaucagcaacuaccucaauugguaucagcagaagccugggaaagccccgaagcugcuuauuuacuauaccucccgccugagaucuggaguucccagccgguucuccggcagcgggucuggaacagauuuuacccucacaaucuccagccugcaaccugaggacuucgcgaccuacuauugucagcagggccacacacuucccccuaccuuugggcagggaacgaaaguggaaauuaag

SEQ ID NO: 43753 - RNA, 321 nt, Artificial Sequence
  derived and/or modified sequence opt5 from anti-OX40_LightChain
gacauccagaugacccaaagccccuccucucugagcgccuccgugggcgauagagucacaauuacgugccgggcuucucaggacaucagcaacuaccucaauugguaucagcagaagccugggaaaaccguuaagcugcuuauuuacuauacaucccgccugagaucuggagugccgagccgguucuccggcagcgggucuggaaccgauuuuacacucaccaucuccagccugcaacccgaggacuucgccacauacuauugucagcagggccacacccuuccucccacguuugggcagggaaccaaaguggaaauuaag

SEQ ID NO: 43754 - RNA, 321 nt, Artificial Sequence
  derived and/or modified sequence opt5 from anti-OX40_LightChain
gacauccagaugacccaaagccccuccucucugagcgccuccgugggcgauagagucacaauuacgugccgggcuucucaggacaucagcaacuaccucaauugguaucagcagaagccugggaaaaccguuaagcugcuuauuuacuauacaucccgccugagaucuggagugccgagccgguucuccggcagcgggucuggaaaagauuacacccucacaaucuccagccugcaacccgaggacuuugccaccuauuucugucagcagggccacacacuuccucccaccuuugggcagggaacgaagguggaaauuaaa

SEQ ID NO: 43755 - RNA, 321 nt, Artificial Sequence
  derived and/or modified sequence opt5 from anti-OX40_LightChain
gacauccagaugacccaaagccccuccucucugagcgccuccgugggcgauagagucacaauuacgugccgggcuucucaggacaucagcaacuaccucaauugguaucagcagaagccugggaaagccccgaagcugcuuauuuacuauaccucccgccugagaucuggaguucccagccgguucuccggcagcgggucuggaacagauuuuacccucacaaucuccagccugcaaccugaggacuucgcgaccuacuauugucagcagggccacacacuucccgcuaccuuugggcagggaacgaaaguggaaauuaag

SEQ ID NO: 43756 - RNA, 321 nt, Artificial Sequence
  derived and/or modified sequence opt5 from anti-OX40_LightChain
gacauccagaugacccaaagccccuccucucugagcgccuccgugggcgauagagucacaauuacgugccgggcuucucaggacaucagcaacuaccucaauugguaucagcagaagccugggaaagccccgaagcugcuuauuuacuauaccucccgccugagaucuggaguucccagccgguucuccggcagcgggucuggaacagauuuuacccucacaaucuccagccugcaaccugaggacuucgcgaccuacuauugucagcagggccacacagcucccccuaccuuugggcagggaacgaaaguggaaauuaag

SEQ ID NO: 43757 - RNA, 321 nt, Artificial Sequence
  derived and/or modified sequence opt5 from anti-OX40_LightChain
gacauccagaugacccaaagccccuccucucugagcgccuccgugggcgauagagucacaauuacgugccgggcuucucaggacaucagcaacuaccucaauugguaucagcagaagccugggaaagccccgaagcugcuuauuuacuauaccucccgccugagaucuggaguucccagccgguucuccggcagcgggucuggaacagauuuuacccucacaaucuccagccugcaaccugaggacuucgcgaccuacuauugucagcagggcgcuacacuucccccuaccuuugggcagggaacgaaaguggaaauuaag

SEQ ID NO: 43758 - RNA, 321 nt, Artificial Sequence
  derived and/or modified sequence opt5 from anti-OX40_LightChain
gacauccagaugacccaaagccccuccucucugagcgcuuccgugggcgauagagucacaauuacgugccgggcuucucaggacaucagcaacuaccucaauugguaucagcagaagccugggaaagccccgaagcugcuuauuuacuauaccucccgccugagaucuggaguucccagccgguucuccggcagcgggucuggaacagauuuuacccucacaaucuccagccugcaaccugaggacuucgcgaccuacuauugucagcagggccacgcccuucccccuacauuugggcagggaaccaaaguggaaauuaag

SEQ ID NO: 43759 - RNA, 321 nt, Artificial Sequence
  derived and/or modified sequence opt5 from anti-OX40_LightChain
gacauccagaugacccaaagccccuccucucugagcgccuccgugggcgauagagucacaauuacgugccgggcuucucaggacaucagcaacuaccucaauugguaucagcagaagccugggaaagccccgaagcugcuuauuuacuauaccucccgccugagaucuggaguucccagccgguucuccggcagcgggucuggaacagauuuuacccucacaaucuccagccugcaaccugaggacuucgcgaccuacuauugucagcaggcucacacacuucccccuaccuuuggccaggggacgaaaguggaaauuaag

SEQ ID NO: 43760 - RNA, 321 nt, Artificial Sequence
  derived and/or modified sequence opt5 from anti-OX40_LightChain
gacauccagaugacccaaagccccuccucucugagcgccuccgugggcgauagagucacaauuacgugccgggcuucucaggacaucagcaacuaccucaauugguaucagcagaagccugggaaagccccgaagcugcuuauuuacuauaccucccgccugagaucuggaguucccagccgguucuccggcagcgggucuggaacagauuuuacccucacaaucuccagccugcaaccugaggacuucgcgaccuacuauugucagcagggccacacacuugcucccaccuuugggcagggaacgaaaguggaaauuaag

SEQ ID NO: 43761 - RNA, 321 nt, Artificial Sequence
  derived and/or modified sequence opt5 from anti-OX40_LightChain
gacauccagaugacccaaagccccuccucucugagcgccuccgugggcgauagagucacaauuacgugccgggcuucucaggacaucagcaacuaccucaauugguaucagcagaagccugggaaagccccgaagcugcuuauuuacuauaccucccgccugagaucuggaguucccagccgguucuccggcagcgggucuggaacagauuuuacccucacaaucuccagccugcaaccugaggacuucgcgaccuacuauugucaggcuggccacacacuucccccuaccuuugggcagggaacgaaaguggaaauuaag

SEQ ID NO: 43762 - RNA, 321 nt, Artificial Sequence
  derived and/or modified sequence opt5 from anti-OX40_LightChain
gacauccagaugacccaaagccccuccucucugagcgcuuccgugggcgauagagucacaauuacgugccgggcuucucaggacaucagcaacuaccucaauugguaucagcagaagccugggaaagccccgaagcugcuuauuuacuauaccuccaaacugcacucuggaguucccagccgcuucuccggcagcgggucuggaacagauuacacccucacaaucuccagccugcaaccugaggacuuugcgaccuauuacugucagcagggcucugcccuucccuggacauucgggcagggaaccaagguggaaauuaaa

SEQ ID NO: 43763 - RNA, 321 nt, Artificial Sequence
  derived and/or modified sequence opt5 from anti-OX40_LightChain
gacauccagaugacccaaagccccuccucucugagcgcuuccgugggcgauagagucacaauuacgugccgggcuucucaggacaucagcaacuaccucaauugguaucagcagaagccugggaaagccguuaagcugcuuauuuacuauaccuccaaacugcacucuggagugccgagccgcuucuccggcagcgggucuagaacagauuacacccucacaaucuccagccugcaacccgaggacuuugcgaccuauuacugucagcagggaucugcccuuccuuggacauucggccaggggaccaagguggaaauuaaa

SEQ ID NO: 43764 - RNA, 351 nt, Artificial Sequence
  derived and/or modified sequence opt5 from anti-OX40_HeavyChain
gaggugcagcugguccaaagcggcgccgaaguuaagaaacccggggccuccgugaaggugucuugcaaagccagcggauacaccuucacagacuccuauaugucuugggucagacaggcgccuggccaggggcucgaguggaucggagauauguacccggacaacggcgauagcuccuauaaucagaaguuucgggaacgcgugacgauuaccagagacacaucuaccagcacagcuuaccuggagcuuuccagccugcggucugaagauaccgccguuuauuacugugugcucgcuccccgcugguauuucuccgucugggggcaaggaacacuggugaccguuagcucu

SEQ ID NO: 43765 - RNA, 351 nt, Artificial Sequence
  derived and/or modified sequence opt5 from anti-OX40_HeavyChain
gaggugcagcugguccaaagcggcgccgaaguuaagaaacccggggccuccgugaaggugucuugcaaagccagcggauacaccuucacagacuccuauaugucuugggucagacaggcgccuggccaggggcucgaguggaucggagauauguacccggacaacggcgauagcuccuauaaucagaaguuucgggaacgcgugacgauuaccguugacacaucuaccagcacagcuuaccuggagcuuuccagccugagaucugaagauaccgccguguauuacuguguccucgcuccccggugguauuucuccgugugggggcaaggaacacugguuaccgugagcucu

SEQ ID NO: 43766 - RNA, 351 nt, Artificial Sequence
  derived and/or modified sequence opt5 from anti-OX40_HeavyChain
gaggugcagcugguccaaagcggcgccgaaguuaagaaacccggggccuccgugaaggugucuugcaaagccagcggauacaccuucacagacuccuauaugucuugggucagacaggcgccuggccaggggcucgaguggaucggagauauguacccggacaacggcgauagcuccuauaaucagaaguuucgggaacgcgugacgcugaccguugacacaucuaccagcacagcuuaccuugagcuguccagccucagaucugaagauaccgccguguauuacuguguccuggcuccccggugguauuucuccgugugggggcaaggaacacuuguuaccgugagcucu

SEQ ID NO: 43767 - RNA, 351 nt, Artificial Sequence
  derived and/or modified sequence opt5 from anti-OX40_HeavyChain
gaggugcagcugguccaaagcggcgccgaaguuaagaaacccggggcuuccgugaaggugucuugcaaagccagcggauacaccuucacagacgcguauauguccugggucagacaggcuccuggccaggggcucgaguggaucggagauauguacccggacaacggcgauucuagcuauaaucagaaguuucgggaacgcgugacgauuaccagagacacauccaccucuacagccuaccuggagcuuagcucccugcggagcgaagauaccgccguuuauuacugugugcucgcuccccgcugguauuucucugucugggggcaaggaacacuggugaccguuuccagc

SEQ ID NO: 43768 - RNA, 351 nt, Artificial Sequence
  derived and/or modified sequence opt5 from anti-OX40_HeavyChain
gaggugcagcugguccaaagcggcgccgaaguuaagaaacccggggccuccgugaaggugucuugcaaagccagcggauacaccuucacagaguccuauaugucuugggucagacaggcgccuggccaggggcucgaauggaucggagacauguacccggauaacggcgacagcuccuauaaucagaaguuucgggagcgcgugacgauuaccagagauacaucuaccagcacagcuuaccuggaacuuuccagccugcggucugaggacaccgccguuuauuacugugugcucgcuccccgcugguauuucuccgucugggggcaaggaacacuggugaccguuagcucu

SEQ ID NO: 43769 - RNA, 351 nt, Artificial Sequence
  derived and/or modified sequence opt5 from anti-OX40_HeavyChain
gaggugcagcugguccaaagcggcgccgaaguuaagaaacccggggcuuccgugaaggugucuugcaaagccagcggauacaccuucacagacuccuauaugucuugggucagacaggcgccuggccaggggcucgaguggaucggagauauguacccggacaacgcugauagcuccuauaaucagaaguuucgggaacgcgugacgauuaccagagacacaucuaccagcacagccuaccuggagcuuuccagccugcggucugaagauaccgccguuuauuacugugugcucgcuccccgcugguauuucuccgucuggggccaagggacacuggugaccguuagcucu

SEQ ID NO: 43770 - RNA, 351 nt, Artificial Sequence
  derived and/or modified sequence opt5 from anti-OX40_HeavyChain
gaggugcagcugguccaaagcggcgccgaaguuaagaaacccggggccuccgugaaggugucuugcaaagccagcggauacaccuucacagacuccuauaugucuugggucagacaggcgccuggccaggggcucgaguggaucggagauauguacccggacaacgcugaugccagcuauaaucagaaguuucgggaacgcgugacgauuaccagagacacauccaccucuacagccuaccuggagcuuagcucccugcggagcgaagauaccgcuguuuauuacugugugcucgcuccccgcugguauuucucugucuggggccaagggacacuggugaccguuuccagc

SEQ ID NO: 43771 - RNA, 351 nt, Artificial Sequence
  derived and/or modified sequence opt5 from anti-OX40_HeavyChain
gaggugcagcugguccaaagcggcgccgaaguuaagaaacccggggcuuccgugaaggugucuugcaaagccagcggauacaccuucacagacuccuauaugucuugggucagacaggcgccuggccaggggcucgaguggaucggagauauguacccggacaacggcgaugcuagcuauaaucagaaguuucgggaacgcgugacgauuaccagagacacauccaccucuacagccuaccuggagcuuagcucccugcggagcgaagauaccgccguuuauuacugugugcucgcuccccgcugguauuucucugucugggggcaaggaacacuggugaccguuuccagc

SEQ ID NO: 43772 - RNA, 351 nt, Artificial Sequence
  derived and/or modified sequence opt5 from anti-OX40_HeavyChain
gaggugcagcugguccaaagcggcgccgaaguuaagaaacccggggccuccgugaaggugucuugcaaagccagcggauacaccuucacagacuccuauaugucuugggucagacaggcgccuggccaggggcucgaguggaucggagauauguacccggacagcggcgauuccucuuauaaccagaaguuucgggaacgcgugacgauuaccagagacacaagcaccuccacagcuuaccuggagcuuagcucucugcgguccgaagauaccgccguuuauuacugugugcucgcuccccgcugguauuucagcgucugggggcaaggaacacuggugaccguuucuucc

SEQ ID NO: 43773 - RNA, 351 nt, Artificial Sequence
  derived and/or modified sequence opt5 from anti-OX40_HeavyChain
gaggugcagcugguccaaagcggcgccgaaguuaagaaacccggggccuccgugaaggugucuugcaaagccagcggauacaccuucacagacuccuauaugucuugggucagacaggcgccuggccaggggcucgaguggaucggagauauguacccggacaacggcagcuccucuuauaaucagaaguuucgggaacgcgugacgauuaccagagauacaagcaccuccacagcuuaccuggagcuuagcucucugcgguccgaagacaccgccguuuauuacugugugcucgcuccccgcugguauuucagcgucugggggcaaggaacacuggugaccguuucuucc

SEQ ID NO: 43774 - RNA, 351 nt, Artificial Sequence
  derived and/or modified sequence opt5 from anti-OX40_HeavyChain
gaggugcagcugguccaaagcggcgccgaaguuaagaaacccggggcuuccgugaaggugucuugcaaagccagcggauacaccuucacagacgcguauauguccugggucagacaggcuccuggccaggggcucgaguggaucggagauauguacccggacaacgccgaugccucuuauaaucagaaguuucgggaacgcgugacgauuaccagagacacaagcaccuccacagcuuaccuggagcuuucuagccugcgguccgaagauaccgccguuuauuacugugugcucgcuccccgcugguauuucagcgucuggggccaagggacacuggugaccguuucuucc

SEQ ID NO: 43775 - RNA, 351 nt, Artificial Sequence
  derived and/or modified sequence opt5 from anti-OX40_HeavyChain
gaggugcagcugguccaaagcggcgccgaaguuaagaaacccggggcuuccgugaaggugucuugcaaagccagcggauacaccuucacagacuccuauaugucuugggucagacaggcgccuggccaggggcucgaguggaucggagauauguacccggacaacggcgauagcuccuauaaucagaaguuucgggaacgcgugacgauuaccagagacacaucuaccagcacagcuuaccuggagcuuuccagccugcggucugaagauaccgccguuuauuacugugugcucgcuccccgcugguauuucuccgccugggggcaaggaacacuggucaccgugagcucu

SEQ ID NO: 43776 - RNA, 351 nt, Artificial Sequence
  derived and/or modified sequence opt5 from anti-OX40_HeavyChain
gaggugcagcugguccaaagcggcgccgaaguuaagaaacccggggcuuccgugaaggugucuugcaaagccagcggauacaccuucacagacuccuauaugucuugggucagacaggcgccuggccaggggcucgaguggaucggagauauguacccggacaacggcgauagcuccuauaaucagaaguuucgggaacgcgugacgauuaccagagacacaucuaccagcacagcuuaccuggagcuuuccagccugcggucugaagauaccgccguuuauuacugugugcucgcuccccgcugguauuucgccgucugggggcaaggaacacuggugaccguuuccagc

SEQ ID NO: 43777 - RNA, 351 nt, Artificial Sequence
  derived and/or modified sequence opt5 from anti-OX40_HeavyChain
gaggugcagcugguccaaagcggcgccgaaguuaagaaacccggggcuuccgugaaggugucuugcaaagccagcggauacaccuucacagacuccuauaugucuugggucagacaggcgccuggccaggggcucgaguggaucggagauauguacccggacaacggcgauagcuccuauaaucagaaguuucgggaacgcgugacgauuaccagagacacaucuaccagcacagcuuaccuggagcuuuccagccugcggucugaagauaccgccguuuauuacugugcccucgcuccccgcugguauuucuccgugugggggcaaggaacacuggucaccgugagcucu

SEQ ID NO: 43778 - RNA, 351 nt, Artificial Sequence
  derived and/or modified sequence opt5 from anti-OX40_HeavyChain
gaggugcagcugguccaaagcggcgccgaaguuaagaaacccggggcuuccgugaaggugucuugcaaagccagcggauacaccuucacagacuccuauaugucuugggucagacaggcgccuggccaggggcucgaguggaucggagauauguacccggacaacggcgauagcuccuauaaucagaaguuucgggaacgcgugacgauuaccagagacacaucuaccagcacagcuuaccuggagcuuuccagccugcggucugaagauaccgccguuuauuacuguguggccgcuccccgcugguauuucuccgucugggggcaaggaacacucgugaccguuagcucu

SEQ ID NO: 43779 - RNA, 354 nt, Artificial Sequence
  derived and/or modified sequence opt5 from anti-OX40_HeavyChain
gaggugcagcuggucgaaagcggcgggggacucguucaacccggcgggucccugagacuuucuugcgccgcuagcggauucaccuuuuccucuuacagcaugaauugggugcggcaggccccuggcaaggggcuggaguggguguccuauaucucuagcuccagcucuacaauugacuacgcggauuccgucaaaggacgcuucacgaucagcagagacaaugcuaagaacucucucuaucugcagaugaacucccuucgggaugaagacaccgccguguacuauugugcccgcgagagcggcugguaccuguuugauuauuggggccaggggacacucguuaccgugucuucc

SEQ ID NO: 43780 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggaggcagcuucuccucuggguauuggaacuggaucagacagcacccgggaaaaggccuggaauggauuggguacaucagcuauaauggaauuacguaccauaaccccucccucaagucucggaucaccauuaauccugacacaagcaaaaaccaauuuucccugcagcuuaauagcgugacccccgaggauacagcuguguauuacugugcccgcuauagauacgacuacgauggcggccacgcgauggacuauugggggcagggaacccuggucacagugucuucc

SEQ ID NO: 43781 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggaggcagcuucuccucuggguauuggaacuggaucagaaaacacccgggaaagggccuggaauggauuggguacaucagcuauaauggaauuacguaccauaaccccucccucaaaucucggaucaccauuaaucgcgacacaagcaagaaccaguuuucccugcaacuuaauagcgugaccccugaggauacagcuguguauuacugugccagauaucgguacgacuacgauggcggccacgcgauggacuauugggggcagggaacccuggucacagugucuucc

SEQ ID NO: 43782 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggagacagcuucuccucuggcuauuggaacuggaucagaaaacacccggggaagggacuggaauacaugggcuauauuagcuacaaugggaucacguaucauaaccccucccucaaaucucggauuaccaucaaucgcgauacaagcaagaaccaguacucccugcaacuuaauagcgugaccccugaggacacagcuguguauuuuugugccagauaccgguacgauuaugacggaggccacgcgauggauuacuggggccaggggacccuggucacagugucuucc

SEQ ID NO: 43783 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggagacagcuucuccucuggcuauuggaacuggaucagaaaacacccggggaagggacuggaauacauuggcuauaucagcuacaaugggauuacguaucauaaccccucccucaaaucucggaucaccauuaaucgcgauacaagcaagaaccaguacucccugcaacuuaauagcgugaccccugaggacacagcuguguauuuuugugccagauaccgguacgauuaugacggaggccacgcgauggauuacuggggccaggggacccuggucacagugucuucc

SEQ ID NO: 43784 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggagacagcuucuccucuggcuauuggaacuggaucagaaaacacccggggaagggacuggaauacauuggcuauaucagcuacaaugggauuacguaucauaaccccucccucaaaucucggaucaccauuaaucgcgauacaagcaagaaccaguuuucccugcaacuuaauagcgugaccccugaggacacagcuguguacuucugugccagauaucgguacgauuacgacggaggccacgcgauggauuauuggggccaggggacccuggucacagugucuucc

SEQ ID NO: 43785 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggagacagcuucuccucuggcuauuggaacuggaucagaaaacacccggggaagggacuggaauacauuggcuauaucagcuacaaugggauuacguaucauaaccccucccucaaaucucggaucaccauuaaucgcgauacaagcaagaaccaguacucccugcaacuuaauagcgugaccccugaggacacagcuguguauuacugugccagauaccgguaugauuacgacggaggccacgcgauggauuauuggggccaggggacccuggucacagugucuucc

SEQ ID NO: 43786 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggagacagcuucuccucuggcuauuggaacuggaucagaaaacacccggggaagggacuggaauacauuggcuauaucagcuacaaugggauuacguaucauaaccccucccucaaaucucggaucaccauuaaucgcgauacaagcaagaaccaguuuucccugcaacuuaauagcgugaccccugaggacacagcuguguacuauugugccagauaccgguacgauuaugacggaggccacgcgauggauuacuggggccaggggacccuggucacagugucuucc

SEQ ID NO: 43787 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggaggcagcuucuccucuggguauuggaacuggaucagaaaacacccgggaaagggccuggaauacauuggguauaucagcuacaauggaauuacguaucauaaccccucccucaaaucucggaucaccauuaauccugacacaagcaagaaccaguacucccugcaacuuaauagcgugacccccgaggauacagcuguguauuuuugugcccgcuacagauacgacuaugauggcggccacgcgauggacuacugggggcagggaacccuggucacagugucuucc

SEQ ID NO: 43788 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggaggcagcuucuccucuggguauuggaacuggaucagaaaacacccgggaaagggccuggaauacauuggguauaucagcuacaauggaauuacguaucauaaccccucccucaaaucucggaucaccauuaaucgcgacacaagcaagaaccaguacucccugcaacuuaauagcgugaccccugaggauacagcuguguauuuuugugccagauaccgguacgacuaugauggcggccacgcgauggacuacugggggcagggaacccuggucacagugucuucc

SEQ ID NO: 43789 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggaggcagcuucuccucuggguauuggaacuggaucagaaaacacccgggaaagggccuggaauacauuggguauaucagcuacaauggaauuacguaucauaaccccucccucaaaucucggaucaccauuaaucgcgacacaagcaagaaccaguacucccugcaacuuaauagcgugaccccugaggauacagcuguguauuacugugccagauaccgguaugacuacgauggcggccacgcgauggacuauugggggcagggaacccuggucacagugucuucc

SEQ ID NO: 43790 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggaggcagcuucuccucuggguauuggaacuggaucagaaaacacccgggaaagggccuggaauacauuggguauaucagcuacaauggaauuacguaucauaaccccucccucaaaucucggaucaccauuaauccugacacaagcaagaaccaguacucccugcaacuuaauagcgugacccccgaggauacagcuguguauuacugugcccgcuacagauaugacuacgauggcggccacgcgauggacuauugggggcagggaacccuggucacagugucuucc

SEQ ID NO: 43791 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggaggcagcuucuccucuggguauuggaacuggaucagaaaacacccgggaaagggccuggaauacauuggguauaucagcuacaaugcuauuacguaucauaaccccucccucaaaucucggaucaccauuaaucgcgacacaagcaagaaccaguacucccugcaacuuaauagcgugaccccugaggauacagccguguauuacugugcgagauacaaauaugacuacgaugcuggacacgccauggacuauuggggccagggcacccuggucacagugucuucc

SEQ ID NO: 43792 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggaggcagcuucuccucuggguauuggaacuggaucagaaaacacccgggaaagggccuggaauacauuggguauaucagcuacaaugcuauuacguaucauaaccccucccucaaaucucggaucaccauuaaucgcgacacaagcaagaaccaguacucccugcaacuuaauagcgugaccccugaggauacagccguguauuacugugcgagauaccgguaugacuacgauggaggccacgcuauggacuauuggggccaggggacccuggucacagugucuucc

SEQ ID NO: 43793 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggaggcagcuucuccucuggguauuggaacuggaucagaaaacacccgggaaagggccuggaauacauuggguauaucagcuacaauggaauuacguaucauaaccccucccucaaaucucggaucaccauuaaucgcgacacaagcaagaaccaguacucccugcaacuuaauagcgugaccccugaggauacagcuguguauuacugugccagauacaaauaugacuacgauggcggccacgcgauggacuauugggggcagggaacccuggucacagugucuucc

SEQ ID NO: 43794 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggaggcagcuucuccucuggguauuggaacuggaucagaaaacacccgggaaagggccuggaauacauuggguauaucagcuacuccggaauuacguaucauaaucccucucucaaaagccggaucaccauuaaccgcgacacauccaagaaucaguacagccugcaacuuaacucugugaccccugaggauacagcuguguauuacugugccagauaccgguaugacuacgauggcggccacgcgauggacuauugggggcagggaacccuggucacaguguccagc

SEQ ID NO: 43795 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggaggcagcuucuccucuggguauuggaacuggaucagaaaacacccgggaaagggccuggaauacauuggguauaucagcuacuccggaauuacguaucauaaucccucucucaaaagccggaucaccauuaaccgcgacacauccaagaaucaguacagccugcaacuuaacucugugaccccugaggauacagcuguguauuacugugccagauacaaauaugacuacgauggcggccacgcgauggacuauugggggcagggaacccuggucacaguguccagc

SEQ ID NO: 43796 - RNA, 363 nt, Artificial Sequence
  derived and/or modified sequence opt5 from anti-OX40_HeavyChain
gaggugcagcugcaagaaagcggccccucccucgucaagccuucucagacccugagccuuacaugcuccguuacgggggacucuuucaccagcggauacuggaacuggaucagaaaauuuccgggcaaucggcuggaguauaugggguacauuuccuauaacgccaucacauaccacaaucccucucucaagagccgcauuuccaucaccagagauacaagcaaaaaccauuauuaccugcagcuuaauucugugaccacagaagacaccgcuacguauuucugugcccgguaccgcuacgauuaugacggaggccacgcgauggauuacugggggcagggaacccuggugacagucuccagc

SEQ ID NO: 43797 - RNA, 363 nt, Artificial Sequence
  derived and/or modified sequence opt5 from anti-OX40_HeavyChain
caggugcaacugcaggagagcggccccgggcucgucaagccuucccagacccugucucuuacaugcgccguuuacggaggcagcuucuccucuggguauuggaacuggaucagaaaacacccgggaaagggccuggaauacauuggguauaucagcuacaaugcuauuacguaucauaaccccucccucaaaucucggaucaccauuaaucgcgacacaagcaagaaccaguacucccugcaacuuaauagcgugaccccugaggauacagccguguauuacugugcgagauacaaauaugacuacgauggaggccacgcuauggacuauuggggccaggggacccuggucacagugucuucc

SEQ ID NO: 43798 - RNA, 372 nt, Artificial Sequence
  derived and/or modified sequence opt5 from anti-OX40_HeavyChain
gaggugcagcuggucgaaagcggcgggggacucguucaacccggcagaucccugcggcuuucuugcgccgcuagcggguucaccuuugacgauuacgccaugcacugggugcgccaggcgccuggaaagggccuggaguggguguccgggaucucuuggaacagcggauccauuggcuaugcugacucugucaaaggcagauucacaaucagccgggauaaugccaagaacucccucuaccugcagaugaauagccuucgcgccgaagacacggcucuguauuacugugccaaagaucagucuaccgcugacuauuacuuuuauuacgggauggauguguggggacaaggcacaaccguuacaguguccagc

SEQ ID NO: 43799 - RNA, 381 nt, Artificial Sequence
  derived and/or modified sequence opt5 from anti-OX40_LightChain
auggagacccccgcccagcuccuguuccugcuucugcucuggcugccugacacaacgggcgaaaucgugcuuacccaaagcccggggacacugucccucucucccggagagagagcuauucugagcugccgggccucccagucugucagcuccucuuuucuggcgugguaccagcagaagccuggccaagcuccccgccuccugaucuauggggccuucagcagagccaccggcauuccugaucgguuuuccggaagcgggucuggaacagacuucacccuuacaaucucccgccuggaacccgaggauuuugcuguuuacuauugucagcaguacgacagcucuagaaccuucggccagggcacgaaaguggaaauuaag

SEQ ID NO: 43800 - RNA, 381 nt, Artificial Sequence
  derived and/or modified sequence opt5 from anti-OX40_LightChain
auggaggcccccgcucagcuccuguuccugcuucugcucuggcugccugacaccacaggcgaaaucgugcuuacgcaaagcccggccacccugucccucucucccggggagagagcgacacugagcugccgggcuucccagggagucucuagcuaccuggccugguaucagcagaagccuggccaagcuccccgccuccugauuuacgaugccuccaacagagccaccgggaucccugcucgguuuucuggaagcggccccgggacagacuucacccuuacaauuuccagccuggaaccugaggauuuugccguuuauuacugucagcagcgcucuaauuggcacccgaccuucggacagggcacgaaaguggaaaucaag

SEQ ID NO: 43801 - RNA, 381 nt, Artificial Sequence
  derived and/or modified sequence opt5 from anti-OX40_LightChain
auggaggcccccgcucagcuccuguuccugcuucugcucuggcugccugacaccacaggcgaaaucgugcuuacgcaaagcccggccacccugucccucucucccggggagagagcgacacugagcugccgggcuucccagucugucagcuccuaccuggccugguaucagcagaagccuggacaagcuccccgccuccugauuuacgaugccucuaacagagccaccggcaucccugcucgguuuagcggguccggaagcggcacagacuucacccuuacaauuucuucccuggaacccgaggauuuugccguuuauuacugucagcagcgcagcaauuggccuaucaccuucgggcagggaacgagacucgaaauuaaa

SEQ ID NO: 43802 - RNA, 387 nt, Artificial Sequence
  derived and/or modified sequence opt5 from anti-OX40_LightChain
auggagacccccgcccagcuccuguuccugcuucugcucuggcugccugacacaacgggcgaaaucgugcuuacccaaagcccggggacacugucccucucucccggagagagagcuacccugagcugccgggccucccagucugucagcuccucuuaccuggcgugguaucagcagaagccuggccaagcuccccgccuccugauuuacggggccagcuccagagccacaggaaucccugaucgguuuagcggcucuggguccggaaccgacuucacacuuaccauuagccgccuggaacccgaggauuuugcuguuuauuacugucagcaguaugacucuucccucacguucggcggcgggaccaaaguggaaaucaagagaaca

SEQ ID NO: 43803 - RNA, 390 nt, Artificial Sequence
  derived and/or modified sequence opt5 from anti-OX40_LightChain
auggacaugagagugcuggcccagcuccugggccuucugcuccugugcuuccccggggcucggugugauauccaaaugacccagagcccuuccucucuuagcgccuccgucggaaaccgcguuacaauuacgugcagagcgucucaggacaucagcuccuggcuggcuugguaccagcaaaagccggagaaagcccccaagucucucauuuaugccgcuagcucccugcagagcggcgugccuucucgguuuuccgggagcggaucuggcaccgauuucacacugaccaucuccagccuccagcccgaagacuuugccacauacuauugucagcaauacaauucuuauccucugaccuucgggcagggaacacgccuugagauuaaaaga

SEQ ID NO: 43804 - RNA, 408 nt, Artificial Sequence
  derived and/or modified sequence opt5 from anti-OX40_HeavyChain
auggacacccugugcagcacacuccugcuucugacgauccccuccugggugcucucucagauuacccugaaggagagcggcccuacacuugucaaaccgacccaaacacugacccucuccuguacauucucuggguuuagccuguccaccucuggaguuggcgugggguggaucagacagcccccuggaaaggcccuggaauggcucgcucugauucacugggaugacgccgagcgguacagccccucccuuaaaagccgccugacgaucaccaaggauacaucuaaaaaccaggugguccucaccaugacaaauauggaccugguggauaccgcgacguauuacugcgcucauacaagaggcgccuucgacauuugggggcagggaaccaugguuacaguguccagc

SEQ ID NO: 43805 - RNA, 408 nt, Artificial Sequence
  derived and/or modified sequence opt5 from anti-OX40_HeavyChain
auggacacccugugcagcacacuccugcuucugacgauccccuccugggugcucucucagauuacccugaaggagagcggcccuacacuugucaaaccgacccaaacacugacccucacauguaccuucuccggguuuucucugagcacguccggaguuggcgugggguggaucagacagcccccuggaaaggcccuggaauggcucgcucugauuuacugggaugaccacucucccuauagcccuucccuuaaaagccggcugaccaucacaaaggauaccucuaaaaaccaggugguccucacaaugaccaauauggaccccguggauacggccacauacuauugcgcgcgcaccagaggcgcuuucgacauuugggggcagggaacaaugguuaccguguccagc

SEQ ID NO: 43806 - RNA, 420 nt, Artificial Sequence
  derived and/or modified sequence opt5 from anti-OX40_HeavyChain
auggaguggggccccugcuggguguuccuggucguuauccucgaaggggugcaguguggagugcaacuggucgagagcggcgggggacuugugcagccuggcgggucccugagacucucuugcgccgcuagcggauuuaccuucuccucuuacagcaugaacuggguucggcaggccccgggcaagggccuggaauggguguccuauauuucuagcuccagcucuacaaucuacuaugcggacuccgucaaagggcgcuuuacgauuagcagagauaaugcuaagaacucucuuuaccugcagaugaacucccuccgggacgaggauaccgccguguauuacugugcccgcggaguuuaucacaauggcuggagcuucuuugacuacugggggcaaggaacacugcugaccgugucuucc

SEQ ID NO: 43807 - RNA, 423 nt, Artificial Sequence
  derived and/or modified sequence opt5 from anti-OX40_HeavyChain
auggacacccugugcagcacacuccugcuucugacgauccccuccugggugcucucucagauuacccugaaggagagcggcccuacacuugucaaaccgaagcaaacccugacacucaccuguacauucuccggguuuucucugagcaccuccggaaugggcguuggguggaucagacagcccccuggaaaagcccuggaauggcucgcugugauuuacugggaugaccaccagcuguauucucccagccuuaagucccggcugacgaucaccaaagauacaagcaagaaccaggugguccucaccaugacaaauauggacccuguggauaccgccacguacuauugcgcgcaucgcagaggcgcuuuccaacacugggggcagggaacacugguuaccgugucuuccgccagcacaaagggc

SEQ ID NO: 43808 - RNA, 462 nt, Artificial Sequence
  derived and/or modified sequence opt5 from anti-OX40_HeavyChain
augaccaugaucacacccagccuggugccuuccucugacccgcucgucacggccgcuagcguucuggaguucgcccuucugauuagacucaccaucggccaggcggugguguccacacaaucuaccgggggaggccugguccagcccgggcggagccuucgccuguccugcgcugccucuggauuuacacucgaugacuacggcaugcacugggugagacaggccccugggaagggacuggaauggguuagcggcauuuccuggaauagcgauucuaucggcuauguggacuccgucaaagggcgguucaccauuagccgcgauaaugcuaagaacucucuguaccuccagaugaacucccugagaguggaggacacagcccuuuauuacuguguuaaagauaucagcggaugguauucuuuugacuacuggggccaagggacccuggugacggucuccagc

SEQ ID NO: 43809 - RNA, 639 nt, Artificial Sequence
  derived and/or modified sequence opt5 from anti-OX40_LightChain
gagaucguggucacccagagccccgccacacugagccucucuccuggcgaaagagcuacgcugagcugccgggccucccaaucuguuagcuccuaccuugcgugguaucagcagaagccggggcaggcuccccgccugcucauuuacgacgccucuaacagagccaccggaaucccugcucgguucagcggcuccgggagcggaacagauuuuacccugacaauuucuucccuugagcccgaagacuucgccguguauuacugucaacagcgcagcaauuggccuaccuuuggccaggggacaaaaguggagaucaagagaaccgucgcugcccccucuguguucauuuuuccuccguccgaugaacagcugaaaagcggaacggcgucuguugugugccuccugaacaauuucuauccccgggaggccaagguccaauggaaaguggacaacgcucugcaguccggcaauagccaggaguccguuaccgaacaggauucuaaggacagcacauacucccucagcucuacccugacacuuuccaaggccgauuaugagaaacacaagguguacgcuugugaagucacccaucaaggccugagcucuccugugacgaaauccuuuaaccgcggggagugc

SEQ ID NO: 43810 - RNA, 1350 nt, Artificial Sequence
  derived and/or modified sequence opt5 from anti-OX40_HeavyChain
gaggugcagcuggucgaaagcggcgggggacucguucaacccggcagaucccugcggcuuucuugcgccgcuagcggguucaccuuugacgauuacgccaugcacugggugcgccaggcgccuggaaagggccuggaguggguguccgggaucucuuggaacagcggauccauuggcuaugcugacucugucaaaggcagauucacaaucagccgggauaaugccaagaacucccucuaccugcagaugaauagccuucgcgccgaagacacggcucuguauuacugugccaaagaucagucuaccgcugacuauuacuuuuauuacgggauggauguguggggacaaggcacaaccguuacaguguccagcgccucuaccaaggggccguccgucuucccccucgcgccuugcagcagaucuacauccgagagcaccgccgcucugggaugucuggugaaagacuacuuucccgaaccuguuacgguguccuggaacucuggcgcccucaccagcgggguccauacauuccccgcugugcugcaguccagcggacuuuauucucuguccagcguggucaccguuccuucuagcaauuuuggcacacagaccuacacgugcaacguggaucacaagccguccaauacaaagguggacaaaaccgucgagcggaaguguugcguggagugucccccuugccccgccccucccguugcgggcccgucuguguuccucuuuccucccaaaccuaaggauacacugaugauuagccgcacccccgaagucaccugugugguuguggacgucucccaugaggaucccgaagugcaguucaacugguaugucgacgggguggagguucacaaugccaaaacaaagccuagagaggaacaauuuaacagcacguuccggguggucucugugcuuaccguugugcaucaggacuggcugaauggaaaggaguacaaaugcaaggucuccaacaaaggccucccggcucccaucgaaaagacaauuagcaaaaccaaggggcagccucgcgagccccagguguauacacugccucccucuagagaagagaugaccaaaaaucaagugucccugacgugucucguuaagggauuuuacccgagcgauaucgccgucgagugggaauccaacggccagccugagaauaacuauaagacaacacccccuaugcuggacucugaugggagcuucuuccuuuacuccaaacugaccguggacaagucucgguggcagcaaggaaacguguuuagcugcuccgucaugcacgaagcucuccacaaucauuacacccagaaaagccugucucuuucccccggcaag

SEQ ID NO: 43811 - RNA, 21 nt, Artificial Sequence
  derived and/or modified sequence opt5 from anti-HIV_VRC01_VRC02_NIH45-46_LightChain_CDR
ugccagcaauacgaguucuuu

SEQ ID NO: 43812 - RNA, 42 nt, Artificial Sequence; identical to SEQ ID NO: 28528
  derived and/or modified sequence opt5 from anti-HIV_VRC01_HeavyChain_CDR

SEQ ID NO: 43813 - RNA, 21 nt, Artificial Sequence
  derived and/or modified sequence opt5 from anti-HIV_3BNC60_LightChain_CDR
ugccagguguacgaguucauc

SEQ ID NO: 43814 - RNA, 36 nt, Artificial Sequence
  derived and/or modified sequence opt5 from anti-HIV_3BNC60_HeavyChain_CDR
gccagacagcggagcgacuucugggauuuugacgug

SEQ ID NO: 43815 - RNA, 36 nt, Artificial Sequence; identical to SEQ ID NO: 28531
  derived and/or modified sequence opt5 from anti-HIV_5H/I1-BMV-D5_HeavyChain_CDR

SEQ ID NO: 43816 - RNA, 33 nt, Artificial Sequence; identical to SEQ ID NO: 28532
  derived and/or modified sequence opt5 from anti-HIV_8ANC195_LightChain_CDR

SEQ ID NO: 43817 - RNA, 33 nt, Artificial Sequence; identical to SEQ ID NO: 28533
  derived and/or modified sequence opt5 from anti-HIV_CH01_CH02_CH03_LightChain_CDR

SEQ ID NO: 43818 - RNA, 78 nt, Artificial Sequence
  derived and/or modified sequence opt5 from anti-HIV_CH01_HeavyChain_CDR
gccagaggcaccgacuacacaaucgaugacgcugggauucacuaucagggaagcggcacguucugguacuuugaucug

SEQ ID NO: 43819 - RNA, 78 nt, Artificial Sequence
  derived and/or modified sequence opt5 from anti-HIV_CH02_HeavyChain_CDR
gccagaggcaccgacuacacaaucgaugaccaggggcgguucuaucaaggaagcggcacguuuugguacuucgauuuu

SEQ ID NO: 43820 - RNA, 78 nt, Artificial Sequence
  derived and/or modified sequence opt5 from anti-HIV_CH03_HeavyChain_CDR
gccagaggcaccgacuacacaaucgaugaccaggggauuuucuauaagggaagcggcacguuuugguacuucgaucug

SEQ ID NO: 43821 - RNA, 33 nt, Artificial Sequence; identical to SEQ ID NO: 28537
  derived and/or modified sequence opt5 from anti-HIV_CH04_LightChain_CDR

SEQ ID NO: 43822 - RNA, 78 nt, Artificial Sequence
  derived and/or modified sequence opt5 from anti-HIV_CH04_HeavyChain_CDR
gccagaggcaccgacuacacaaucgaugaccaggggauucgguaucaaggaagcggcacguucugguacuuugaugug

SEQ ID NO: 43823 - RNA, 54 nt, Artificial Sequence
  derived and/or modified sequence opt5 from anti-HIV_NIH45-46_HeavyChain_CDR
accagaggcaaguacugcacagcccgggacuauuacaacugggauuucgagcac

SEQ ID NO: 43824 - RNA, 90 nt, Artificial Sequence; identical to SEQ ID NO: 28540
  derived and/or modified sequence opt5 from anti-HIV_PG16_HeavyChain_CDR

SEQ ID NO: 43825 - RNA, 36 nt, Artificial Sequence
  derived and/or modified sequence opt5 from anti-HIV_PGT122_LightChain_CDR
cacaucugggacagcagacggcccaccaacugggug

SEQ ID NO: 43826 - RNA, 72 nt, Artificial Sequence
  derived and/or modified sequence opt5 from anti-HIV_PGT122_HeavyChain_CDR
accaagcacggcagacggaucuacgggguggucgccuucaaagagugguuuacauauuucuacauggacguu

SEQ ID NO: 43827 - RNA, 36 nt, Artificial Sequence; identical to SEQ ID NO: 28543
  derived and/or modified sequence opt5 from anti-HIV_PGT123_LightChain_CDR

SEQ ID NO: 43828 - RNA, 72 nt, Artificial Sequence
  derived and/or modified sequence opt5 from anti-HIV_PGT123_HeavyChain_CDR
gcccugcacggcaagagaaucuacgggauuguggcucucggagagcuguucaccuauuuuuacauggacguc

SEQ ID NO: 43829 - RNA, 30 nt, Artificial Sequence; identical to SEQ ID NO: 13261
  derived and/or modified sequence opt5 from anti-HIV_PGT125_PGT128_LightChain_CDR

SEQ ID NO: 43830 - RNA, 57 nt, Artificial Sequence; identical to SEQ ID NO: 28546
  derived and/or modified sequence opt5 from anti-HIV_PGT125_HeavyChain_CDR

SEQ ID NO: 43831 - RNA, 30 nt, Artificial Sequence; identical to SEQ ID NO: 13263
  derived and/or modified sequence opt5 from anti-HIV_PGT126_PGT127_LightChain_CDR

SEQ ID NO: 43832 - RNA, 57 nt, Artificial Sequence; identical to SEQ ID NO: 28548
  derived and/or modified sequence opt5 from anti-HIV_PGT126_HeavyChain_CDR

SEQ ID NO: 43833 - RNA, 57 nt, Artificial Sequence; identical to SEQ ID NO: 28549
  derived and/or modified sequence opt5 from anti-HIV_PGT127_HeavyChain_CDR

SEQ ID NO: 43834 - RNA, 57 nt, Artificial Sequence; identical to SEQ ID NO: 28550
  derived and/or modified sequence opt5 from anti-HIV_PGT128_HeavyChain_CDR

SEQ ID NO: 43835 - RNA, 30 nt, Artificial Sequence; identical to SEQ ID NO: 28551
  derived and/or modified sequence opt5 from anti-HIV_PGT130_LightChain_CDR

SEQ ID NO: 43836 - RNA, 57 nt, Artificial Sequence; identical to SEQ ID NO: 28552
  derived and/or modified sequence opt5 from anti-HIV_PGT130_HeavyChain_CDR

SEQ ID NO: 43837 - RNA, 30 nt, Artificial Sequence; identical to SEQ ID NO: 28553
  derived and/or modified sequence opt5 from anti-HIV_PGT131_LightChain_CDR

SEQ ID NO: 43838 - RNA, 57 nt, Artificial Sequence; identical to SEQ ID NO: 28554
  derived and/or modified sequence opt5 from anti-HIV_PGT131_HeavyChain_CDR

SEQ ID NO: 43839 - RNA, 27 nt, Artificial Sequence
  derived and/or modified sequence opt5 from anti-HIV_PGT135_PGT136_PGT137_LightChain_CDR
cagcaauacgaggaauggcccagaacc

SEQ ID NO: 43840 - RNA, 54 nt, Artificial Sequence; identical to SEQ ID NO: 28556
  derived and/or modified sequence opt5 from anti-HIV_PGT135_HeavyChain_CDR

SEQ ID NO: 43841 - RNA, 54 nt, Artificial Sequence; identical to SEQ ID NO: 28557
  derived and/or modified sequence opt5 from anti-HIV_PGT136_HeavyChain_CDR

SEQ ID NO: 43842 - RNA, 54 nt, Artificial Sequence; identical to SEQ ID NO: 28558
  derived and/or modified sequence opt5 from anti-HIV_PGT137_HeavyChain_CDR

SEQ ID NO: 43843 - RNA, 27 nt, Artificial Sequence
  derived and/or modified sequence opt5 from anti-HIV_PGT141_PGT142_PGT143_PGT144_LightChain_CDR
augcagggccugaacagacccuggacc

SEQ ID NO: 43844 - RNA, 96 nt, Artificial Sequence
  derived and/or modified sequence opt5 from anti-HIV_PGT141_HeavyChain_CDR
ggcagcaagcacagacugcgggacuacgugcucuaugaugacuacgggcugaucaacuaucaggaauggaaugauuaccuugaguuccuggacguc

SEQ ID NO: 43845 - RNA, 96 nt, Artificial Sequence
  derived and/or modified sequence opt5 from anti-HIV_PGT144_HeavyChain_CDR
ggcagcaagcacagacugcgggacuacgugcucuaugaugacuacgggcugaucaaccagcaagaauggaaugauuaucuugaguuccuggacguc

SEQ ID NO: 43846 - RNA, 27 nt, Artificial Sequence
  derived and/or modified sequence opt5 from anti-HIV_PGT145_LightChain_CDR
augcagggccugcacagccccuggacc

SEQ ID NO: 43847 - RNA, 93 nt, Artificial Sequence
  derived and/or modified sequence opt5 from anti-HIV_PGT145_HeavyChain_CDR
ggcagcaagcacagacugcgggacuacuuccucuauaacgaguacgggcccaauuaugaagaguggggagauuaccuggccacccuugacgug

SEQ ID NO: 43848 - RNA, 21 nt, Artificial Sequence
  derived and/or modified sequence opt5 from anti-HIV_VRC-CH30_VRC-CH31_VRC-CH32_VRC-CH33_VRC-CH34_LightChain _CDR
ugccagcaauacgagaccuuc

SEQ ID NO: 43849 - RNA, 45 nt, Artificial Sequence
  derived and/or modified sequence opt5 from anti-HIV_VRC-CH30_VRC-CH31_VRC-CH32_VRC-CH34_HeavyChain_CDR
gccagagcucagaagcggggccgcagcgagugggccuacgcgcac

SEQ ID NO: 43850 - RNA, 45 nt, Artificial Sequence
  derived and/or modified sequence opt5 from anti-HIV_VRC-CH33_HeavyChain_CDR
gccagagcucagaagcgggcccgcagcgagugggcguacgcucac

SEQ ID NO: 43851 - RNA, 21 nt, Artificial Sequence
  derived and/or modified sequence opt5 from anti-HIV_VRC-PG04_LightChain_CDR
ugccagcaacuggaguucuuu

SEQ ID NO: 43852 - RNA, 48 nt, Artificial Sequence; identical to SEQ ID NO: 28568
  derived and/or modified sequence opt5 from anti-HIV_VRC-PG04_HeavyChain_CDR

SEQ ID NO: 43853 - RNA, 21 nt, Artificial Sequence
  derived and/or modified sequence opt5 from anti-HIV_VRC-PG04b_LightChain_CDR
ugccagcaaguggaguucuuu

SEQ ID NO: 43854 - RNA, 48 nt, Artificial Sequence
  derived and/or modified sequence opt5 from anti-HIV_VRC-PG04b_HeavyChain_CDR
gccagacagaaguucgagcggggcgggcaaggaugguacuuugaccug

SEQ ID NO: 43855 - RNA, 21 nt, Artificial Sequence
  derived and/or modified sequence opt5 from anti-HIV_VRC03_LightChain_CDR
ugccagcaauucgaguuuuuc

SEQ ID NO: 43856 - RNA, 48 nt, Artificial Sequence
  derived and/or modified sequence opt5 from anti-HIV_VRC03_HeavyChain_CDR
gugagacggggcagcugcgacuacuguggggauuuccccuggcaguau

SEQ ID NO: 43857 - RNA, 21 nt, Artificial Sequence
  derived and/or modified sequence opt5 from anti-HIV_1TJG_P-Chain
gagcuggacaagugggccagc

SEQ ID NO: 43858 - RNA, 69 nt, Artificial Sequence
  derived and/or modified sequence opt5 from anti-HIV_2B1H_P-Chain
aacaauaccaagaaaagcaucaagauuagaccccggcaggccuucuacgcuacaaacggcaucauuggg

SEQ ID NO: 43859 - RNA, 69 nt, Artificial Sequence
  derived and/or modified sequence opt5 from anti-HIV_2B1A_P-Chain
aacaauaccagaaagagcauccaccugggccccgggcgggccuucuacgcuacaggagacauuaucggc

SEQ ID NO: 43860 - RNA, 57 nt, Artificial Sequence
  derived and/or modified sequence opt5 from anti-HIV_2B0S_P-Chain
aagagaaaacggauccacauuggccccgggcgcgccuucuacaccacaaagaacgcu

SEQ ID NO: 43861 - RNA, 69 nt, Artificial Sequence
  derived and/or modified sequence opt5 from anti-HIV_3UJJ_P-Chain
aacaauaccagaaagagcauccggauuggccccgggcaggccuucuacgcuacaggagacaucauuggc

SEQ ID NO: 43862 - RNA, 69 nt, Artificial Sequence
  derived and/or modified sequence opt5 from anti-HIV_3UJI_P-Chain
uacaacaagagaaaacggauccacauuggccccgggcgcgccuucuauaccacaaagaauaucauugga

SEQ ID NO: 43863 - RNA, 75 nt, Artificial Sequence
  derived and/or modified sequence opt5 from anti-HIV_3MLZ_P-Chain
agcaacaauaccagaaagggcauccacauugggcccggacgggccuucuacgcuacaggccagaucacgggggac

SEQ ID NO: 43864 - RNA, 60 nt, Artificial Sequence
  derived and/or modified sequence opt5 from anti-HIV_3MLV_Q-Chain
aacaauaccagaaagcggauccgcgugggccccgggcagacagucuacgccacgaacgcu

SEQ ID NO: 43865 - RNA, 69 nt, Artificial Sequence
  derived and/or modified sequence opt5 from anti-HIV_3MLU_P-Chain
aacaauaccagaaagagcauccggauuggccccgggcaggccuucuacgcuacaggaggcaucauuggg

SEQ ID NO: 43866 - RNA, 60 nt, Artificial Sequence
  derived and/or modified sequence opt5 from anti-HIV_3MLR_P-Chain
aacaauaccaagaaaggcaucgccauugggcccggaagaacacuguacgcucgggagaag

SEQ ID NO: 43867 - RNA, 48 nt, Artificial Sequence; identical to SEQ ID NO: 28583
  derived and/or modified sequence opt5 from anti-HIV_4XCF_P-Chain

SEQ ID NO: 43868 - RNA, 45 nt, Artificial Sequence; identical to SEQ ID NO: 28584
  derived and/or modified sequence opt5 from anti-HIV_4XBE_P-Chain

SEQ ID NO: 43869 - RNA, 48 nt, Artificial Sequence; identical to SEQ ID NO: 28585
  derived and/or modified sequence opt5 from anti-HIV_4XAW_P-Chain

SEQ ID NO: 43870 - RNA, 45 nt, Artificial Sequence
  derived and/or modified sequence opt5 from anti-HIV_2QSC_P-Chain
agaaagcggauccacauuggccccgggcgcgccuucuacaccaca

SEQ ID NO: 43871 - RNA, 60 nt, Artificial Sequence
  derived and/or modified sequence opt5 from anti-HIV_3MLS_S-Chain
gccugccaggcuuucuacgccagcucccccagaaagucuauccacauuggcgcgugugcu

SEQ ID NO: 43872 - RNA, 42 nt, Artificial Sequence
  derived and/or modified sequence opt5 from anti-HIV_3GO1_P-Chain
agaaagcggauccacauuggccccgggcgcgccuucuacacc

SEQ ID NO: 43873 - RNA, 42 nt, Artificial Sequence
  derived and/or modified sequence opt5 from anti-HIV_4M1D_Q-Chain
ugcagaauccacauuggccccgggcgggccuucuacaccugu

SEQ ID NO: 43874 - RNA, 39 nt, Artificial Sequence; identical to SEQ ID NO: 28590
  derived and/or modified sequence opt5 from anti-HIV_3C2A_Q-Chain

SEQ ID NO: 43875 - RNA, 12 nt, Artificial Sequence
  derived and/or modified sequence opt5 from anti-HIV_CDR
cagagcaagacc

SEQ ID NO: 43876 - RNA, 12 nt, Artificial Sequence
  derived and/or modified sequence opt5 from anti-HIV_CDR
gaccugaucgau

SEQ ID NO: 43877 - RNA, 15 nt, Artificial Sequence
  derived and/or modified sequence opt5 from anti-HIV_CDR
gaccacuacuggagc

SEQ ID NO: 43878 - RNA, 15 nt, Artificial Sequence
  derived and/or modified sequence opt5 from anti-HIV_CDR
ggcagauucuggagc

SEQ ID NO: 43879 - RNA, 15 nt, Artificial Sequence
  derived and/or modified sequence opt5 from anti-HIV_CDR
aacuacuauuggacc

SEQ ID NO: 43880 - RNA, 15 nt, Artificial Sequence
  derived and/or modified sequence opt5 from anti-HIV_CDR
gacgccuacuggagc

SEQ ID NO: 43881 - RNA, 15 nt, Artificial Sequence
  derived and/or modified sequence opt5 from anti-HIV_CDR
gacagcuacuggucc

SEQ ID NO: 43882 - RNA, 15 nt, Artificial Sequence
  derived and/or modified sequence opt5 from anti-HIV_CDR
gacaacuacuggagc

SEQ ID NO: 43883 - RNA, 15 nt, Artificial Sequence
  derived and/or modified sequence opt5 from anti-HIV_CDR
aacagcuacuggacc

SEQ ID NO: 43884 - RNA, 15 nt, Artificial Sequence
  derived and/or modified sequence opt5 from anti-HIV_CDR
agcuacuauuggucc

SEQ ID NO: 43885 - RNA, 15 nt, Artificial Sequence
  derived and/or modified sequence opt5 from anti-HIV_CDR
agcuucggcaugcac

SEQ ID NO: 43886 - RNA, 15 nt, Artificial Sequence
  derived and/or modified sequence opt5 from anti-HIV_CDR
gccgcuuuccagugg

SEQ ID NO: 43887 - RNA, 15 nt, Artificial Sequence
  derived and/or modified sequence opt5 from anti-HIV_CDR
cagcaacugagaacc

SEQ ID NO: 43888 - RNA, 15 nt, Artificial Sequence
  derived and/or modified sequence opt5 from anti-HIV_CDR
cagcaauacgacagc

SEQ ID NO: 43889 - RNA, 15 nt, Artificial Sequence
  derived and/or modified sequence opt5 from anti-HIV_CDR
cagcaacuggccacc

SEQ ID NO: 43890 - RNA, 15 nt, Artificial Sequence
  derived and/or modified sequence opt5 from anti-HIV_CDR
gagagcuuccagugg

SEQ ID NO: 43891 - RNA, 15 nt, Artificial Sequence
  derived and/or modified sequence opt5 from anti-HIV_CDR
gaaguguacgaguuc

SEQ ID NO: 43892 - RNA, 15 nt, Artificial Sequence
  derived and/or modified sequence opt5 from anti-HIV_CDR
gccagccuggaguuc

SEQ ID NO: 43893 - RNA, 15 nt, Artificial Sequence
  derived and/or modified sequence opt5 from anti-HIV_CDR
agcguguacgaguuc

SEQ ID NO: 43894 - RNA, 15 nt, Artificial Sequence
  derived and/or modified sequence opt5 from anti-HIV_CDR
gccgcucuggaguuc

SEQ ID NO: 43895 - RNA, 15 nt, Artificial Sequence
  derived and/or modified sequence opt5 from anti-HIV_CDR
gccguggucgaguuc

SEQ ID NO: 43896 - RNA, 15 nt, Artificial Sequence
  derived and/or modified sequence opt5 from anti-HIV_CDR
cagcuguucgaguuu

SEQ ID NO: 43897 - RNA, 15 nt, Artificial Sequence
  derived and/or modified sequence opt5 from anti-HIV_CDR
gccguguuccagugg

SEQ ID NO: 43898 - RNA, 15 nt, Artificial Sequence
  derived and/or modified sequence opt5 from anti-HIV_CDR
gccgugcuggaguuc

SEQ ID NO: 43899 - RNA, 15 nt, Artificial Sequence
  derived and/or modified sequence opt5 from anti-HIV_CDR
aacggcuucgacgug

SEQ ID NO: 43900 - RNA, 15 nt, Artificial Sequence
  derived and/or modified sequence opt5 from anti-HIV_CDR
cagcaauacgaguuc

SEQ ID NO: 43901 - RNA, 15 nt, Artificial Sequence
  derived and/or modified sequence opt5 from anti-HIV_CDR
cagcacuacgaguuc

SEQ ID NO: 43902 - RNA, 15 nt, Artificial Sequence
  derived and/or modified sequence opt5 from anti-HIV_CDR
cagguguacgagguc

SEQ ID NO: 43903 - RNA, 15 nt, Artificial Sequence
  derived and/or modified sequence opt5 from anti-HIV_CDR
cagguguacgaguuc

SEQ ID NO: 43904 - RNA, 15 nt, Artificial Sequence
  derived and/or modified sequence opt5 from anti-HIV_CDR
uucagcaaggagucc

SEQ ID NO: 43905 - RNA, 15 nt, Artificial Sequence
  derived and/or modified sequence opt5 from anti-HIV_CDR
cugaagcucagcucc

SEQ ID NO: 43906 - RNA, 15 nt, Artificial Sequence
  derived and/or modified sequence opt5 from anti-HIV_CDR
uacaaggugagcucc

SEQ ID NO: 43907 - RNA, 15 nt, Artificial Sequence
  derived and/or modified sequence opt5 from anti-HIV_CDR
cccccucaggagagc

SEQ ID NO: 43908 - RNA, 15 nt, Artificial Sequence
  derived and/or modified sequence opt5 from anti-HIV_CDR
accgccagagacuac

SEQ ID NO: 43909 - RNA, 15 nt, Artificial Sequence
  derived and/or modified sequence opt5 from anti-HIV_CDR
augcagagcauccaa

SEQ ID NO: 43910 - RNA, 15 nt, Artificial Sequence
  derived and/or modified sequence opt5 from anti-HIV_CDR
caccagcuggacacc

SEQ ID NO: 43911 - RNA, 15 nt, Artificial Sequence
  derived and/or modified sequence opt5 from anti-HIV_CDR
caccagcuggacagc

SEQ ID NO: 43912 - RNA, 15 nt, Artificial Sequence
  derived and/or modified sequence opt5 from anti-HIV_CDR
cagcaacugggcacc

SEQ ID NO: 43913 - RNA, 15 nt, Artificial Sequence
  derived and/or modified sequence opt5 from anti-HIV_CDR
cagaaggccaccaca

SEQ ID NO: 43914 - RNA, 15 nt, Artificial Sequence
  derived and/or modified sequence opt5 from anti-HIV_CDR
cuguucgccggcacc

SEQ ID NO: 43915 - RNA, 18 nt, Artificial Sequence
  derived and/or modified sequence opt5 from anti-HIV_CDR
gugagaggcagcuccccc

SEQ ID NO: 43916 - RNA, 18 nt, Artificial Sequence
  derived and/or modified sequence opt5 from anti-HIV_CDR
ggccuccuguucgugguc

SEQ ID NO: 43917 - RNA, 18 nt, Artificial Sequence
  derived and/or modified sequence opt5 from anti-HIV_CDR
auggacuggaccuggagc

SEQ ID NO: 43918 - RNA, 18 nt, Artificial Sequence
  derived and/or modified sequence opt5 from anti-HIV_CDR
auggacuggaccuggaga

SEQ ID NO: 43919 - RNA, 18 nt, Artificial Sequence
  derived and/or modified sequence opt5 from anti-HIV_CDR
augaagcaccugugguuc

SEQ ID NO: 43920 - RNA, 18 nt, Artificial Sequence
  derived and/or modified sequence opt5 from anti-HIV_CDR
auggacuggaucuggaga

SEQ ID NO: 43921 - RNA, 18 nt, Artificial Sequence
  derived and/or modified sequence opt5 from anti-HIV_CDR
auggacuggaccuggaca

SEQ ID NO: 43922 - RNA, 18 nt, Artificial Sequence
  derived and/or modified sequence opt5 from anti-HIV_CDR
augaagcaccuguuccuc

SEQ ID NO: 43923 - RNA, 18 nt, Artificial Sequence
  derived and/or modified sequence opt5 from anti-HIV_CDR
cagcugcuccaaagcaac

SEQ ID NO: 43924 - RNA, 18 nt, Artificial Sequence
  derived and/or modified sequence opt5 from anti-HIV_CDR
ggcgggagccccgagcac

SEQ ID NO: 43925 - RNA, 18 nt, Artificial Sequence
  derived and/or modified sequence opt5 from anti-HIV_CDR
cuggagggcaccgacuac

SEQ ID NO: 43926 - RNA, 18 nt, Artificial Sequence
  derived and/or modified sequence opt5 from anti-HIV_CDR
cagcaauaccccagcacc

SEQ ID NO: 43927 - RNA, 21 nt, Artificial Sequence
  derived and/or modified sequence opt5 from anti-HIV_CDR
aacaaucacgacagacccagc

SEQ ID NO: 43928 - RNA, 21 nt, Artificial Sequence
  derived and/or modified sequence opt5 from anti-HIV_CDR
aacaaucaggacagacccgcc

SEQ ID NO: 43929 - RNA, 21 nt, Artificial Sequence
  derived and/or modified sequence opt5 from anti-HIV_CDR
aacaauaacgacagacccagc

SEQ ID NO: 43930 - RNA, 21 nt, Artificial Sequence
  derived and/or modified sequence opt5 from anti-HIV_CDR
aacaaucaggacagacccagc

SEQ ID NO: 43931 - RNA, 21 nt, Artificial Sequence
  derived and/or modified sequence opt5 from anti-HIV_CDR
gacgauagcgacagacccucc

SEQ ID NO: 43932 - RNA, 21 nt, Artificial Sequence
  derived and/or modified sequence opt5 from anti-HIV_CDR
ugggccagcaccagacacaca

SEQ ID NO: 43933 - RNA, 21 nt, Artificial Sequence
  derived and/or modified sequence opt5 from anti-HIV_CDR
ggcgccaccgcuagagacuuc

SEQ ID NO: 43934 - RNA, 21 nt, Artificial Sequence
  derived and/or modified sequence opt5 from anti-HIV_CDR
gccagcaucaagcuggcucuc

SEQ ID NO: 43935 - RNA, 21 nt, Artificial Sequence
  derived and/or modified sequence opt5 from anti-HIV_CDR
cagcaauacggcagaagcccc

SEQ ID NO: 43936 - RNA, 21 nt, Artificial Sequence
  derived and/or modified sequence opt5 from anti-HIV_CDR
cagcaauacuauaucagcccc

SEQ ID NO: 43937 - RNA, 21 nt, Artificial Sequence
  derived and/or modified sequence opt5 from anti-HIV_CDR
cagcaaagccacucccccucu

SEQ ID NO: 43938 - RNA, 21 nt, Artificial Sequence
  derived and/or modified sequence opt5 from anti-HIV_CDR
ggcagaugcgcccggcgcugg

SEQ ID NO: 43939 - RNA, 21 nt, Artificial Sequence
  derived and/or modified sequence opt5 from anti-HIV_CDR
agauuccuguuuguggucgcc

SEQ ID NO: 43940 - RNA, 21 nt, Artificial Sequence
  derived and/or modified sequence opt5 from anti-HIV_CDR
augagcguguccuuccugauc

SEQ ID NO: 43941 - RNA, 21 nt, Artificial Sequence
  derived and/or modified sequence opt5 from anti-HIV_CDR
ggcagcuccaacagaugcccc

SEQ ID NO: 43942 - RNA, 21 nt, Artificial Sequence
  derived and/or modified sequence opt5 from anti-HIV_CDR
augaagcaccugugguucuuu

SEQ ID NO: 43943 - RNA, 21 nt, Artificial Sequence
  derived and/or modified sequence opt5 from anti-HIV_CDR
gccagcugggacuucgauuuu

SEQ ID NO: 43944 - RNA, 21 nt, Artificial Sequence
  derived and/or modified sequence opt5 from anti-HIV_CDR
gagaucggcguggccgaacac

SEQ ID NO: 43945 - RNA, 21 nt, Artificial Sequence
  derived and/or modified sequence opt5 from anti-HIV_CDR
cagaaguacgacaccgccccc

SEQ ID NO: 43946 - RNA, 21 nt, Artificial Sequence
  derived and/or modified sequence opt5 from anti-HIV_CDR
cagcaaagcuccucuaccccc

SEQ ID NO: 43947 - RNA, 21 nt, Artificial Sequence
  derived and/or modified sequence opt5 from anti-HIV_CDR
cagcaaagcgccggcaccccc

SEQ ID NO: 43948 - RNA, 21 nt, Artificial Sequence
  derived and/or modified sequence opt5 from anti-HIV_CDR
cagcaaagcuccucuaagccc

SEQ ID NO: 43949 - RNA, 21 nt, Artificial Sequence
  derived and/or modified sequence opt5 from anti-HIV_CDR
caggaguacaacaccuauaca

SEQ ID NO: 43950 - RNA, 21 nt, Artificial Sequence
  derived and/or modified sequence opt5 from anti-HIV_CDR
caggaguacaacaauuauaac

SEQ ID NO: 43951 - RNA, 21 nt, Artificial Sequence
  derived and/or modified sequence opt5 from anti-HIV_CDR
cacuacgacgcccuggauuau

SEQ ID NO: 43952 - RNA, 24 nt, Artificial Sequence
  derived and/or modified sequence opt5 from anti-HIV_CDR
gccaucuucaagggcgugcagugc

SEQ ID NO: 43953 - RNA, 24 nt, Artificial Sequence
  derived and/or modified sequence opt5 from anti-HIV_CDR
ggcccccugggggacuacgauuuc

SEQ ID NO: 43954 - RNA, 24 nt, Artificial Sequence
  derived and/or modified sequence opt5 from anti-HIV_CDR
cagcaauacggcagcucccugaga

SEQ ID NO: 43955 - RNA, 24 nt, Artificial Sequence
  derived and/or modified sequence opt5 from anti-HIV_CDR
cagcaauacagccacuauagaacc

SEQ ID NO: 43956 - RNA, 24 nt, Artificial Sequence
  derived and/or modified sequence opt5 from anti-HIV_CDR
caguacuauggcaugagcgugacc

SEQ ID NO: 43957 - RNA, 24 nt, Artificial Sequence
  derived and/or modified sequence opt5 from anti-HIV_CDR
cagcaauacgagaacuggcugacc

SEQ ID NO: 43958 - RNA, 24 nt, Artificial Sequence
  derived and/or modified sequence opt5 from anti-HIV_CDR
agcggcgugcacuacauggacguc

SEQ ID NO: 43959 - RNA, 24 nt, Artificial Sequence
  derived and/or modified sequence opt5 from anti-HIV_CDR
cagcaauacagcggcccccugacc

SEQ ID NO: 43960 - RNA, 24 nt, Artificial Sequence
  derived and/or modified sequence opt5 from anti-HIV_CDR
cagcaauacuauaccgugcccagc

SEQ ID NO: 43961 - RNA, 24 nt, Artificial Sequence
  derived and/or modified sequence opt5 from anti-HIV_CDR
cagcaauacggcagcuccaucacc

SEQ ID NO: 43962 - RNA, 24 nt, Artificial Sequence
  derived and/or modified sequence opt5 from anti-HIV_CDR
caccaguacaacaagugggacacc

SEQ ID NO: 43963 - RNA, 24 nt, Artificial Sequence
  derived and/or modified sequence opt5 from anti-HIV_CDR
cagcaaagcuacaccacaccccug

SEQ ID NO: 43964 - RNA, 24 nt, Artificial Sequence
  derived and/or modified sequence opt5 from anti-HIV_CDR
cagagaugggagaccaucgacuac

SEQ ID NO: 43965 - RNA, 24 nt, Artificial Sequence
  derived and/or modified sequence opt5 from anti-HIV_CDR
ugcagcuacgccggcuccuauacc

SEQ ID NO: 43966 - RNA, 24 nt, Artificial Sequence
  derived and/or modified sequence opt5 from anti-HIV_CDR
cagcaauacgacaaccugcccacc

SEQ ID NO: 43967 - RNA, 24 nt, Artificial Sequence
  derived and/or modified sequence opt5 from anti-HIV_CDR
cagcaaugcacccugccccucaca

SEQ ID NO: 43968 - RNA, 24 nt, Artificial Sequence
  derived and/or modified sequence opt5 from anti-HIV_CDR
cagcaaagcuacuccucugugacc

SEQ ID NO: 43969 - RNA, 24 nt, Artificial Sequence
  derived and/or modified sequence opt5 from anti-HIV_CDR
cagcaaagccacaccuccgugaca

SEQ ID NO: 43970 - RNA, 24 nt, Artificial Sequence
  derived and/or modified sequence opt5 from anti-HIV_CDR
cagcaaaccuacgccagcgugaca

SEQ ID NO: 43971 - RNA, 24 nt, Artificial Sequence
  derived and/or modified sequence opt5 from anti-HIV_CDR
cagcaauacaacagcgacuauacc

SEQ ID NO: 43972 - RNA, 24 nt, Artificial Sequence
  derived and/or modified sequence opt5 from anti-HIV_CDR
caccuguacgugagcagacccguc

SEQ ID NO: 43973 - RNA, 24 nt, Artificial Sequence
  derived and/or modified sequence opt5 from anti-HIV_CDR
cagcaauacggcagaagcccccug

SEQ ID NO: 43974 - RNA, 24 nt, Artificial Sequence
  derived and/or modified sequence opt5 from anti-HIV_CDR
cagcaauacggcuccagcccccug

SEQ ID NO: 43975 - RNA, 24 nt, Artificial Sequence
  derived and/or modified sequence opt5 from anti-HIV_CDR
cagcaauacaacgacuggcccgcc

SEQ ID NO: 43976 - RNA, 24 nt, Artificial Sequence
  derived and/or modified sequence opt5 from anti-HIV_CDR
caccaguacggcagcucccaaaga

SEQ ID NO: 43977 - RNA, 24 nt, Artificial Sequence
  derived and/or modified sequence opt5 from anti-HIV_CDR
cagcaaaccuacagcuccgugaca

SEQ ID NO: 43978 - RNA, 24 nt, Artificial Sequence
  derived and/or modified sequence opt5 from anti-HIV_CDR
cagcaaaccuacagaagcgugaca

SEQ ID NO: 43979 - RNA, 24 nt, Artificial Sequence
  derived and/or modified sequence opt5 from anti-HIV_CDR
cagcaauacggcagcuccuggacc

SEQ ID NO: 43980 - RNA, 24 nt, Artificial Sequence
  derived and/or modified sequence opt5 from anti-HIV_CDR
agcuccuacgccggcaucaacaau

SEQ ID NO: 43981 - RNA, 24 nt, Artificial Sequence
  derived and/or modified sequence opt5 from anti-HIV_CDR
cagaaguacggcagcucccugacc

SEQ ID NO: 43982 - RNA, 24 nt, Artificial Sequence
  derived and/or modified sequence opt5 from anti-HIV_CDR
augcaggcccuggagacccucggc

SEQ ID NO: 43983 - RNA, 24 nt, Artificial Sequence
  derived and/or modified sequence opt5 from anti-HIV_CDR
cagcaauacgccggcagccugacc

SEQ ID NO: 43984 - RNA, 24 nt, Artificial Sequence
  derived and/or modified sequence opt5 from anti-HIV_CDR
agaaacuggggcaauuucgaccac

SEQ ID NO: 43985 - RNA, 27 nt, Artificial Sequence
  derived and/or modified sequence opt5 from anti-HIV_CDR
cagcaacacuacaccacacccuggacg

SEQ ID NO: 43986 - RNA, 27 nt, Artificial Sequence
  derived and/or modified sequence opt5 from anti-HIV_CDR
caacagagcuucgccgugcccuacacc

SEQ ID NO: 43987 - RNA, 27 nt, Artificial Sequence
  derived and/or modified sequence opt5 from anti-HIV_CDR
cagcaauacaagagcuauuccggcacc

SEQ ID NO: 43988 - RNA, 27 nt, Artificial Sequence
  derived and/or modified sequence opt5 from anti-HIV_CDR
caccaguacgccuauagccccagaacc

SEQ ID NO: 43989 - RNA, 27 nt, Artificial Sequence
  derived and/or modified sequence opt5 from anti-HIV_CDR
cagcaauacaacagcuucccucccacc

SEQ ID NO: 43990 - RNA, 27 nt, Artificial Sequence
  derived and/or modified sequence opt5 from anti-HIV_CDR
cagcaaaccuacagcaaccccagaaug

SEQ ID NO: 43991 - RNA, 27 nt, Artificial Sequence
  derived and/or modified sequence opt5 from anti-HIV_CDR
cagcaauacgaggacccucccuggacc

SEQ ID NO: 43992 - RNA, 27 nt, Artificial Sequence
  derived and/or modified sequence opt5 from anti-HIV_CDR
caccaguacuucaacacccccagaaca

SEQ ID NO: 43993 - RNA, 27 nt, Artificial Sequence
  derived and/or modified sequence opt5 from anti-HIV_CDR
caccaguacuucagcacccccagaaca

SEQ ID NO: 43994 - RNA, 27 nt, Artificial Sequence
  derived and/or modified sequence opt5 from anti-HIV_CDR
cagcacagaagcaacuggcccuggacc

SEQ ID NO: 43995 - RNA, 27 nt, Artificial Sequence
  derived and/or modified sequence opt5 from anti-HIV_CDR
agaggccggcgccagaucggggacuac

SEQ ID NO: 43996 - RNA, 27 nt, Artificial Sequence
  derived and/or modified sequence opt5 from anti-HIV_CDR
cagcaauacggccugagccccuggacc

SEQ ID NO: 43997 - RNA, 27 nt, Artificial Sequence
  derived and/or modified sequence opt5 from anti-HIV_CDR
cagcaaaccuacacaagccccaucacg

SEQ ID NO: 43998 - RNA, 27 nt, Artificial Sequence
  derived and/or modified sequence opt5 from anti-HIV_CDR
cagcaauacggcagcuccccucccacc

SEQ ID NO: 43999 - RNA, 27 nt, Artificial Sequence
  derived and/or modified sequence opt5 from anti-HIV_CDR
cagcaauacggcaccagcuccugcaca

SEQ ID NO: 44000 - RNA, 27 nt, Artificial Sequence
  derived and/or modified sequence opt5 from anti-HIV_CDR
cagcaauacgacgaugcccccaucacc

SEQ ID NO: 44001 - RNA, 27 nt, Artificial Sequence
  derived and/or modified sequence opt5 from anti-HIV_CDR
ggcccccugcucagauaccuggacagc

SEQ ID NO: 44002 - RNA, 27 nt, Artificial Sequence
  derived and/or modified sequence opt5 from anti-HIV_CDR
ugccugaagaaaaccagcuccuacgug

SEQ ID NO: 44003 - RNA, 27 nt, Artificial Sequence
  derived and/or modified sequence opt5 from anti-HIV_CDR
cagcaauacaaccacuggccccagacc

SEQ ID NO: 44004 - RNA, 27 nt, Artificial Sequence
  derived and/or modified sequence opt5 from anti-HIV_CDR
cagcaauacagcaaccugcccuauacc

SEQ ID NO: 44005 - RNA, 27 nt, Artificial Sequence
  derived and/or modified sequence opt5 from anti-HIV_CDR
cagcaauacgacaccuaucccggcaca

SEQ ID NO: 44006 - RNA, 27 nt, Artificial Sequence
  derived and/or modified sequence opt5 from anti-HIV_CDR
caggaguacagcuccacccccuauaac

SEQ ID NO: 44007 - RNA, 27 nt, Artificial Sequence
  derived and/or modified sequence opt5 from anti-HIV_CDR
ggcgccugggacgauacccuguacgug

SEQ ID NO: 44008 - RNA, 27 nt, Artificial Sequence
  derived and/or modified sequence opt5 from anti-HIV_CDR
gccgcuugggacgauacccuguacgug

SEQ ID NO: 44009 - RNA, 27 nt, Artificial Sequence
  derived and/or modified sequence opt5 from anti-HIV_CDR
cagcaauacuauagcgacuccaucacc

SEQ ID NO: 44010 - RNA, 27 nt, Artificial Sequence
  derived and/or modified sequence opt5 from anti-HIV_CDR
cagcaauacggcagaagccccuauacc

SEQ ID NO: 44011 - RNA, 27 nt, Artificial Sequence
  derived and/or modified sequence opt5 from anti-HIV_CDR
cagcaauacaccaacuaucccuggaca

SEQ ID NO: 44012 - RNA, 27 nt, Artificial Sequence
  derived and/or modified sequence opt5 from anti-HIV_CDR
cagcaaagacacaacuggcccaucagc

SEQ ID NO: 44013 - RNA, 27 nt, Artificial Sequence
  derived and/or modified sequence opt5 from anti-HIV_CDR
cagcaauaccacaacuggcccagaacc

SEQ ID NO: 44014 - RNA, 27 nt, Artificial Sequence
  derived and/or modified sequence opt5 from anti-HIV_CDR
cagcaaagaagcaccuggcccccuaca

SEQ ID NO: 44015 - RNA, 27 nt, Artificial Sequence
  derived and/or modified sequence opt5 from anti-HIV_CDR
cagcaauacgacagcuucuccuggacc

SEQ ID NO: 44016 - RNA, 27 nt, Artificial Sequence
  derived and/or modified sequence opt5 from anti-HIV_CDR
cagcaauacaacaaucugcccgugacc

SEQ ID NO: 44017 - RNA, 27 nt, Artificial Sequence
  derived and/or modified sequence opt5 from anti-HIV_CDR
cagcaauacaacagauauagcuacacc

SEQ ID NO: 44018 - RNA, 27 nt, Artificial Sequence
  derived and/or modified sequence opt5 from anti-HIV_CDR
caggaguacuauauccugcccugcagc

SEQ ID NO: 44019 - RNA, 27 nt, Artificial Sequence
  derived and/or modified sequence opt5 from anti-HIV_CDR
cagcaauacgacaaccugcucgcccac

SEQ ID NO: 44020 - RNA, 27 nt, Artificial Sequence
  derived and/or modified sequence opt5 from anti-HIV_CDR
caccagugcgacaaccugaucgccaga

SEQ ID NO: 44021 - RNA, 27 nt, Artificial Sequence
  derived and/or modified sequence opt5 from anti-HIV_CDR
caacagagcuucuccacccuguggaca

SEQ ID NO: 44022 - RNA, 27 nt, Artificial Sequence
  derived and/or modified sequence opt5 from anti-HIV_CDR
caccagagcuacuccacacccccuacc

SEQ ID NO: 44023 - RNA, 27 nt, Artificial Sequence
  derived and/or modified sequence opt5 from anti-HIV_CDR
cagcaaggcuacagcacccccuggaca

SEQ ID NO: 44024 - RNA, 27 nt, Artificial Sequence
  derived and/or modified sequence opt5 from anti-HIV_CDR
cagcaauacagcaccacacccagaacg

SEQ ID NO: 44025 - RNA, 27 nt, Artificial Sequence
  derived and/or modified sequence opt5 from anti-HIV_CDR
cagcuguacaacagcgugccccaaacc

SEQ ID NO: 44026 - RNA, 27 nt, Artificial Sequence
  derived and/or modified sequence opt5 from anti-HIV_CDR
cagcaaagaaccagcuggccccagaca

SEQ ID NO: 44027 - RNA, 27 nt, Artificial Sequence
  derived and/or modified sequence opt5 from anti-HIV_CDR
cagcaauucaacaccuacagccagaca

SEQ ID NO: 44028 - RNA, 27 nt, Artificial Sequence
  derived and/or modified sequence opt5 from anti-HIV_CDR
augcagagccugcaaacccccaucaca

SEQ ID NO: 44029 - RNA, 27 nt, Artificial Sequence
  derived and/or modified sequence opt5 from anti-HIV_CDR
cagcaauacaacagcuauccccugacc

SEQ ID NO: 44030 - RNA, 27 nt, Artificial Sequence
  derived and/or modified sequence opt5 from anti-HIV_CDR
cagcaauacaacagcuauuccggcacc

SEQ ID NO: 44031 - RNA, 27 nt, Artificial Sequence
  derived and/or modified sequence opt5 from anti-HIV_CDR
cagagcuacgacuccucucugagcggc

SEQ ID NO: 44032 - RNA, 27 nt, Artificial Sequence
  derived and/or modified sequence opt5 from anti-HIV_CDR
agccagggcaacaccgccaucgacuac

SEQ ID NO: 44033 - RNA, 27 nt, Artificial Sequence
  derived and/or modified sequence opt5 from anti-HIV_CDR
gaggaacccagagacgccuucgaucug

SEQ ID NO: 44034 - RNA, 27 nt, Artificial Sequence
  derived and/or modified sequence opt5 from anti-HIV_CDR
cagcaaagcuacaccacacccgugacg

SEQ ID NO: 44035 - RNA, 27 nt, Artificial Sequence
  derived and/or modified sequence opt5 from anti-HIV_CDR
gccggcagagaggggugguucgacccc

SEQ ID NO: 44036 - RNA, 27 nt, Artificial Sequence
  derived and/or modified sequence opt5 from anti-HIV_CDR
cagcaauacuauagcacaccccacacc

SEQ ID NO: 44037 - RNA, 27 nt, Artificial Sequence
  derived and/or modified sequence opt5 from anti-HIV_CDR
cagcaaagcuacuccaucgccggcacc

SEQ ID NO: 44038 - RNA, 27 nt, Artificial Sequence
  derived and/or modified sequence opt5 from anti-HIV_CDR
cagaacuacaauaagcccccuagaacc

SEQ ID NO: 44039 - RNA, 27 nt, Artificial Sequence
  derived and/or modified sequence opt5 from anti-HIV_CDR
augcagagcauccaacugccccucacc

SEQ ID NO: 44040 - RNA, 27 nt, Artificial Sequence
  derived and/or modified sequence opt5 from anti-HIV_CDR
augcaggcccugcaaaccagccucaca

SEQ ID NO: 44041 - RNA, 27 nt, Artificial Sequence
  derived and/or modified sequence opt5 from anti-HIV_CDR
cagcaauacagcuccucucccagaacc

SEQ ID NO: 44042 - RNA, 27 nt, Artificial Sequence
  derived and/or modified sequence opt5 from anti-HIV_CDR
caggccugggacagcuccaccgcugug

SEQ ID NO: 44043 - RNA, 27 nt, Artificial Sequence
  derived and/or modified sequence opt5 from anti-HIV_CDR
cagcacuacaacaauuggcccuauacc

SEQ ID NO: 44044 - RNA, 27 nt, Artificial Sequence
  derived and/or modified sequence opt5 from anti-HIV_CDR
cagcaauacgacagacugcccaucacc

SEQ ID NO: 44045 - RNA, 27 nt, Artificial Sequence
  derived and/or modified sequence opt5 from anti-HIV_CDR
cagcaauacggcagcucccccaucacc

SEQ ID NO: 44046 - RNA, 27 nt, Artificial Sequence
  derived and/or modified sequence opt5 from anti-HIV_CDR
cagcaauacgacguguggccccugacc

SEQ ID NO: 44047 - RNA, 27 nt, Artificial Sequence
  derived and/or modified sequence opt5 from anti-HIV_CDR
caccaguacgccagcucccccagaacc

SEQ ID NO: 44048 - RNA, 27 nt, Artificial Sequence
  derived and/or modified sequence opt5 from anti-HIV_CDR
augcagagccugcaccuccccuacacc

SEQ ID NO: 44049 - RNA, 27 nt, Artificial Sequence
  derived and/or modified sequence opt5 from anti-HIV_CDR
cagcaauacuauuccagcccccugacc

SEQ ID NO: 44050 - RNA, 27 nt, Artificial Sequence
  derived and/or modified sequence opt5 from anti-HIV_CDR
cagcaacacgacaccuuccccuuuaca

SEQ ID NO: 44051 - RNA, 27 nt, Artificial Sequence
  derived and/or modified sequence opt5 from anti-HIV_CDR
cagcaaagcuacuccacccccuauaca

SEQ ID NO: 44052 - RNA, 27 nt, Artificial Sequence
  derived and/or modified sequence opt5 from anti-HIV_CDR
cagcaauacaagaccuaucccgugaca

SEQ ID NO: 44053 - RNA, 27 nt, Artificial Sequence
  derived and/or modified sequence opt5 from anti-HIV_CDR
cagcaauacuauagcacccccgugaca

SEQ ID NO: 44054 - RNA, 27 nt, Artificial Sequence
  derived and/or modified sequence opt5 from anti-HIV_CDR
cagcaauacaacuggcccccuuucacc

SEQ ID NO: 44055 - RNA, 27 nt, Artificial Sequence
  derived and/or modified sequence opt5 from anti-HIV_CDR
augcagggcacccacuggcccuggaca

SEQ ID NO: 44056 - RNA, 27 nt, Artificial Sequence
  derived and/or modified sequence opt5 from anti-HIV_CDR
caccagugcggcagcucccccagaacc

SEQ ID NO: 44057 - RNA, 27 nt, Artificial Sequence
  derived and/or modified sequence opt5 from anti-HIV_CDR
cagcaauacaacagcuauuucagaacc

SEQ ID NO: 44058 - RNA, 27 nt, Artificial Sequence
  derived and/or modified sequence opt5 from anti-HIV_CDR
cagcaauaccacaacuggcccccuagc

SEQ ID NO: 44059 - RNA, 27 nt, Artificial Sequence
  derived and/or modified sequence opt5 from anti-HIV_CDR
augcagggcaccuacuggcuguggaca

SEQ ID NO: 44060 - RNA, 27 nt, Artificial Sequence
  derived and/or modified sequence opt5 from anti-HIV_CDR
cagcaaggcuucagcgcccccuuuacc

SEQ ID NO: 44061 - RNA, 27 nt, Artificial Sequence
  derived and/or modified sequence opt5 from anti-HIV_CDR
cagcaauacaacaccuauccccugaca

SEQ ID NO: 44062 - RNA, 27 nt, Artificial Sequence
  derived and/or modified sequence opt5 from anti-HIV_CDR
augcagggcacccacuggcccagaaca

SEQ ID NO: 44063 - RNA, 27 nt, Artificial Sequence
  derived and/or modified sequence opt5 from anti-HIV_CDR
uucggcagaacccccugguuugacccu

SEQ ID NO: 44064 - RNA, 27 nt, Artificial Sequence
  derived and/or modified sequence opt5 from anti-HIV_CDR
cagcaauacuucaccagcgugaucaca

SEQ ID NO: 44065 - RNA, 27 nt, Artificial Sequence
  derived and/or modified sequence opt5 from anti-HIV_CDR
caccauuacaugagcgaccugcagacc

SEQ ID NO: 44066 - RNA, 27 nt, Artificial Sequence
  derived and/or modified sequence opt5 from anti-HIV_CDR
caccauuacagcuccucuagccacacc

SEQ ID NO: 44067 - RNA, 27 nt, Artificial Sequence
  derived and/or modified sequence opt5 from anti-HIV_CDR
caccauuacaagagcgacugccagacc

SEQ ID NO: 44068 - RNA, 27 nt, Artificial Sequence
  derived and/or modified sequence opt5 from anti-HIV_CDR
cagcacagaagcuccuggccccugacc

SEQ ID NO: 44069 - RNA, 27 nt, Artificial Sequence
  derived and/or modified sequence opt5 from anti-HIV_CDR
cugcagcaccauagcuaccccuggacc

SEQ ID NO: 44070 - RNA, 27 nt, Artificial Sequence
  derived and/or modified sequence opt5 from anti-HIV_CDR
cagcaauacggcaccagccccgggaca

SEQ ID NO: 44071 - RNA, 27 nt, Artificial Sequence
  derived and/or modified sequence opt5 from anti-HIV_CDR
cagcaauacggcagcucccccaccaca

SEQ ID NO: 44072 - RNA, 27 nt, Artificial Sequence
  derived and/or modified sequence opt5 from anti-HIV_CDR
cagcaauacggcaccagccccacaacg

SEQ ID NO: 44073 - RNA, 27 nt, Artificial Sequence
  derived and/or modified sequence opt5 from anti-HIV_CDR
augcaggccacccacuggcccccuggc

SEQ ID NO: 44074 - RNA, 27 nt, Artificial Sequence
  derived and/or modified sequence opt5 from anti-HIV_CDR
cagagauacaaccgggaccccuauauc

SEQ ID NO: 44075 - RNA, 27 nt, Artificial Sequence
  derived and/or modified sequence opt5 from anti-HIV_CDR
cagcaauacgacaaccugccccucgcc

SEQ ID NO: 44076 - RNA, 27 nt, Artificial Sequence
  derived and/or modified sequence opt5 from anti-HIV_CDR
agcuccuacucugccaccggcguggcu

SEQ ID NO: 44077 - RNA, 27 nt, Artificial Sequence
  derived and/or modified sequence opt5 from anti-HIV_CDR
cagcacuacggcaacagcagauggacc

SEQ ID NO: 44078 - RNA, 27 nt, Artificial Sequence
  derived and/or modified sequence opt5 from anti-HIV_CDR
cagcaauacgagaccuaucccuggaca

SEQ ID NO: 44079 - RNA, 27 nt, Artificial Sequence
  derived and/or modified sequence opt5 from anti-HIV_CDR
cagcaauacggcagcucccccucuacc

SEQ ID NO: 44080 - RNA, 27 nt, Artificial Sequence
  derived and/or modified sequence opt5 from anti-HIV_CDR
cagcaaagccagagaacaccccacacc

SEQ ID NO: 44081 - RNA, 27 nt, Artificial Sequence
  derived and/or modified sequence opt5 from anti-HIV_CDR
cagcaauacgacauccugccccucacc

SEQ ID NO: 44082 - RNA, 27 nt, Artificial Sequence
  derived and/or modified sequence opt5 from anti-HIV_CDR
cagcaaagcaacuccucucccuggacc

SEQ ID NO: 44083 - RNA, 27 nt, Artificial Sequence
  derived and/or modified sequence opt5 from anti-HIV_CDR
cagcaaagcuacgacacccccagaaca

SEQ ID NO: 44084 - RNA, 27 nt, Artificial Sequence
  derived and/or modified sequence opt5 from anti-HIV_CDR
cagcaauucggcagcucccccgggacc

SEQ ID NO: 44085 - RNA, 27 nt, Artificial Sequence
  derived and/or modified sequence opt5 from anti-HIV_CDR
caccaguacggcuccagcccccaaacc

SEQ ID NO: 44086 - RNA, 27 nt, Artificial Sequence
  derived and/or modified sequence opt5 from anti-HIV_CDR
caccaguacggcagcucuccccaaucc

SEQ ID NO: 44087 - RNA, 27 nt, Artificial Sequence
  derived and/or modified sequence opt5 from anti-HIV_CDR
cugcagcacaacagcuacccccucacc

SEQ ID NO: 44088 - RNA, 27 nt, Artificial Sequence
  derived and/or modified sequence opt5 from anti-HIV_CDR
cagcaauacaacgacuggcccaucacc

SEQ ID NO: 44089 - RNA, 27 nt, Artificial Sequence
  derived and/or modified sequence opt5 from anti-HIV_CDR
cagcaaaccuucacauuucccuacacg

SEQ ID NO: 44090 - RNA, 27 nt, Artificial Sequence
  derived and/or modified sequence opt5 from anti-HIV_CDR
cagcaaagcuacaccuuccccuauauc

SEQ ID NO: 44091 - RNA, 27 nt, Artificial Sequence
  derived and/or modified sequence opt5 from anti-HIV_CDR
caguacuauggcagcucccccuacacc

SEQ ID NO: 44092 - RNA, 27 nt, Artificial Sequence
  derived and/or modified sequence opt5 from anti-HIV_CDR
caacagagcuucggcacccccagaaca

SEQ ID NO: 44093 - RNA, 27 nt, Artificial Sequence
  derived and/or modified sequence opt5 from anti-HIV_CDR
cagcaauacaacgacuggcccagaacc

SEQ ID NO: 44094 - RNA, 27 nt, Artificial Sequence
  derived and/or modified sequence opt5 from anti-HIV_CDR
cagcaauacggcagcucccccagaacc

SEQ ID NO: 44095 - RNA, 27 nt, Artificial Sequence
  derived and/or modified sequence opt5 from anti-HIV_CDR
cugcagcacaacagauaccccuggacc

SEQ ID NO: 44096 - RNA, 27 nt, Artificial Sequence
  derived and/or modified sequence opt5 from anti-HIV_CDR
cugcagcacaacaauuaccccuggacc

SEQ ID NO: 44097 - RNA, 27 nt, Artificial Sequence
  derived and/or modified sequence opt5 from anti-HIV_CDR
cugcaguacagcaccuauccccucaca

SEQ ID NO: 44098 - RNA, 27 nt, Artificial Sequence
  derived and/or modified sequence opt5 from anti-HIV_CDR
cugcaguacaacgccuauccccucacc

SEQ ID NO: 44099 - RNA, 27 nt, Artificial Sequence
  derived and/or modified sequence opt5 from anti-HIV_CDR
cagcaauacgacagcgcccccgugacc

SEQ ID NO: 44100 - RNA, 27 nt, Artificial Sequence
  derived and/or modified sequence opt5 from anti-HIV_CDR
cagcaaaccuacacauuccccuauagc

SEQ ID NO: 44101 - RNA, 27 nt, Artificial Sequence
  derived and/or modified sequence opt5 from anti-HIV_CDR
ggcuacgacaacagcgggcccgauuau

SEQ ID NO: 44102 - RNA, 27 nt, Artificial Sequence
  derived and/or modified sequence opt5 from anti-HIV_CDR
cagcaauacaacaauuggcccccugcc

SEQ ID NO: 44103 - RNA, 27 nt, Artificial Sequence
  derived and/or modified sequence opt5 from anti-HIV_CDR
caccaguacgcccugagccccuggacc

SEQ ID NO: 44104 - RNA, 27 nt, Artificial Sequence
  derived and/or modified sequence opt5 from anti-HIV_CDR
cagaaguacgacaccgaucccaugaca

SEQ ID NO: 44105 - RNA, 27 nt, Artificial Sequence
  derived and/or modified sequence opt5 from anti-HIV_CDR
cagcaauacaacuauuaccccaucacc

SEQ ID NO: 44106 - RNA, 27 nt, Artificial Sequence
  derived and/or modified sequence opt5 from anti-HIV_CDR
cagcaaaccuucacagaccccgugacg

SEQ ID NO: 44107 - RNA, 27 nt, Artificial Sequence
  derived and/or modified sequence opt5 from anti-HIV_CDR
gccgcuugggacgauagccugcacgug

SEQ ID NO: 44108 - RNA, 27 nt, Artificial Sequence
  derived and/or modified sequence opt5 from anti-HIV_CDR
cagcaauacgccagcucccccuucacc

SEQ ID NO: 44109 - RNA, 27 nt, Artificial Sequence
  derived and/or modified sequence opt5 from anti-HIV_CDR
cagcaaagcuccucuacccccuucaca

SEQ ID NO: 44110 - RNA, 27 nt, Artificial Sequence
  derived and/or modified sequence opt5 from anti-HIV_CDR
cagcaaagaagcaacugggccaucacc

SEQ ID NO: 44111 - RNA, 27 nt, Artificial Sequence
  derived and/or modified sequence opt5 from anti-HIV_CDR
cagcaauacggcagcucccccuucacc

SEQ ID NO: 44112 - RNA, 27 nt, Artificial Sequence
  derived and/or modified sequence opt5 from anti-HIV_CDR
cagaaguacaacggcgcccccuggacc

SEQ ID NO: 44113 - RNA, 27 nt, Artificial Sequence
  derived and/or modified sequence opt5 from anti-HIV_CDR
cagaaguacaacaaugcccccuggacc

SEQ ID NO: 44114 - RNA, 27 nt, Artificial Sequence
  derived and/or modified sequence opt5 from anti-HIV_CDR
cagcaaagagugaacuggcccccuaau

SEQ ID NO: 44115 - RNA, 27 nt, Artificial Sequence
  derived and/or modified sequence opt5 from anti-HIV_CDR
cagcaaagaggccacuggccccugacc

SEQ ID NO: 44116 - RNA, 27 nt, Artificial Sequence
  derived and/or modified sequence opt5 from anti-HIV_CDR
cagcaauacagauauagcgugaucauu

SEQ ID NO: 44117 - RNA, 27 nt, Artificial Sequence
  derived and/or modified sequence opt5 from anti-HIV_CDR
cagcaaagcggcaccucccugcucaca

SEQ ID NO: 44118 - RNA, 27 nt, Artificial Sequence
  derived and/or modified sequence opt5 from anti-HIV_CDR
augaagucccagcacagccccagaacc

SEQ ID NO: 44119 - RNA, 27 nt, Artificial Sequence
  derived and/or modified sequence opt5 from anti-HIV_CDR
augcagccccugcaaaccccuuacaca

SEQ ID NO: 44120 - RNA, 27 nt, Artificial Sequence
  derived and/or modified sequence opt5 from anti-HIV_CDR
cagcaauacaccgccuaucccuggaca

SEQ ID NO: 44121 - RNA, 27 nt, Artificial Sequence
  derived and/or modified sequence opt5 from anti-HIV_CDR
cugcagaaccacaauuaccccagaacc

SEQ ID NO: 44122 - RNA, 27 nt, Artificial Sequence
  derived and/or modified sequence opt5 from anti-HIV_CDR
cugcagacccacagcuaccccagaaca

SEQ ID NO: 44123 - RNA, 30 nt, Artificial Sequence; identical to SEQ ID NO: 28839
  derived and/or modified sequence opt5 from anti-HIV_CDR

SEQ ID NO: 44124 - RNA, 30 nt, Artificial Sequence; identical to SEQ ID NO: 28840
  derived and/or modified sequence opt5 from anti-HIV_CDR

SEQ ID NO: 44125 - RNA, 30 nt, Artificial Sequence
  derived and/or modified sequence opt5 from anti-HIV_CDR
agcuccuucacccccacaaacacgcuggug

SEQ ID NO: 44126 - RNA, 30 nt, Artificial Sequence; identical to SEQ ID NO: 28842
  derived and/or modified sequence opt5 from anti-HIV_CDR

SEQ ID NO: 44127 - RNA, 30 nt, Artificial Sequence; identical to SEQ ID NO: 28843
  derived and/or modified sequence opt5 from anti-HIV_CDR

SEQ ID NO: 44128 - RNA, 30 nt, Artificial Sequence; identical to SEQ ID NO: 28844
  derived and/or modified sequence opt5 from anti-HIV_CDR

SEQ ID NO: 44129 - RNA, 30 nt, Artificial Sequence
  derived and/or modified sequence opt5 from anti-HIV_CDR
cagcaaagagccaacuggcggcugcucacc

SEQ ID NO: 44130 - RNA, 30 nt, Artificial Sequence; identical to SEQ ID NO: 28846
  derived and/or modified sequence opt5 from anti-HIV_CDR

SEQ ID NO: 44131 - RNA, 30 nt, Artificial Sequence
  derived and/or modified sequence opt5 from anti-HIV_CDR
agacggagcgacuacugcgauuucgacgug

SEQ ID NO: 44132 - RNA, 30 nt, Artificial Sequence; identical to SEQ ID NO: 28848
  derived and/or modified sequence opt5 from anti-HIV_CDR

SEQ ID NO: 44133 - RNA, 30 nt, Artificial Sequence; identical to SEQ ID NO: 28849
  derived and/or modified sequence opt5 from anti-HIV_CDR

SEQ ID NO: 44134 - RNA, 30 nt, Artificial Sequence; identical to SEQ ID NO: 28850
  derived and/or modified sequence opt5 from anti-HIV_CDR

SEQ ID NO: 44135 - RNA, 30 nt, Artificial Sequence; identical to SEQ ID NO: 28851
  derived and/or modified sequence opt5 from anti-HIV_CDR

SEQ ID NO: 44136 - RNA, 30 nt, Artificial Sequence; identical to SEQ ID NO: 28852
  derived and/or modified sequence opt5 from anti-HIV_CDR

SEQ ID NO: 44137 - RNA, 30 nt, Artificial Sequence; identical to SEQ ID NO: 28853
  derived and/or modified sequence opt5 from anti-HIV_CDR

SEQ ID NO: 44138 - RNA, 30 nt, Artificial Sequence; identical to SEQ ID NO: 28854
  derived and/or modified sequence opt5 from anti-HIV_CDR

SEQ ID NO: 44139 - RNA, 30 nt, Artificial Sequence; identical to SEQ ID NO: 28855
  derived and/or modified sequence opt5 from anti-HIV_CDR

SEQ ID NO: 44140 - RNA, 30 nt, Artificial Sequence; identical to SEQ ID NO: 28856
  derived and/or modified sequence opt5 from anti-HIV_CDR

SEQ ID NO: 44141 - RNA, 30 nt, Artificial Sequence
  derived and/or modified sequence opt5 from anti-HIV_CDR
cagcaaagaagcaacuggccccggcugacc

SEQ ID NO: 44142 - RNA, 30 nt, Artificial Sequence; identical to SEQ ID NO: 28858
  derived and/or modified sequence opt5 from anti-HIV_CDR

SEQ ID NO: 44143 - RNA, 30 nt, Artificial Sequence; identical to SEQ ID NO: 28859
  derived and/or modified sequence opt5 from anti-HIV_CDR

SEQ ID NO: 44144 - RNA, 30 nt, Artificial Sequence; identical to SEQ ID NO: 28860
  derived and/or modified sequence opt5 from anti-HIV_CDR

SEQ ID NO: 44145 - RNA, 30 nt, Artificial Sequence; identical to SEQ ID NO: 28861
  derived and/or modified sequence opt5 from anti-HIV_CDR

SEQ ID NO: 44146 - RNA, 30 nt, Artificial Sequence; identical to SEQ ID NO: 28862
  derived and/or modified sequence opt5 from anti-HIV_CDR

SEQ ID NO: 44147 - RNA, 30 nt, Artificial Sequence; identical to SEQ ID NO: 28863
  derived and/or modified sequence opt5 from anti-HIV_CDR

SEQ ID NO: 44148 - RNA, 30 nt, Artificial Sequence
  derived and/or modified sequence opt5 from anti-HIV_CDR
agcuccuacaccaucucuagccccagagug

SEQ ID NO: 44149 - RNA, 30 nt, Artificial Sequence; identical to SEQ ID NO: 28865
  derived and/or modified sequence opt5 from anti-HIV_CDR

SEQ ID NO: 44150 - RNA, 30 nt, Artificial Sequence; identical to SEQ ID NO: 13582
  derived and/or modified sequence opt5 from anti-HIV_CDR

SEQ ID NO: 44151 - RNA, 30 nt, Artificial Sequence; identical to SEQ ID NO: 28867
  derived and/or modified sequence opt5 from anti-HIV_CDR

SEQ ID NO: 44152 - RNA, 30 nt, Artificial Sequence
  derived and/or modified sequence opt5 from anti-HIV_CDR
caggaguacggcagaagcccucccuucccg

SEQ ID NO: 44153 - RNA, 30 nt, Artificial Sequence; identical to SEQ ID NO: 28869
  derived and/or modified sequence opt5 from anti-HIV_CDR

SEQ ID NO: 44154 - RNA, 30 nt, Artificial Sequence; identical to SEQ ID NO: 28870
  derived and/or modified sequence opt5 from anti-HIV_CDR

SEQ ID NO: 44155 - RNA, 30 nt, Artificial Sequence; identical to SEQ ID NO: 28871
  derived and/or modified sequence opt5 from anti-HIV_CDR

SEQ ID NO: 44156 - RNA, 30 nt, Artificial Sequence; identical to SEQ ID NO: 28872
  derived and/or modified sequence opt5 from anti-HIV_CDR

SEQ ID NO: 44157 - RNA, 30 nt, Artificial Sequence; identical to SEQ ID NO: 28873
  derived and/or modified sequence opt5 from anti-HIV_CDR

SEQ ID NO: 44158 - RNA, 30 nt, Artificial Sequence; identical to SEQ ID NO: 28874
  derived and/or modified sequence opt5 from anti-HIV_CDR

SEQ ID NO: 44159 - RNA, 30 nt, Artificial Sequence; identical to SEQ ID NO: 28875
  derived and/or modified sequence opt5 from anti-HIV_CDR

SEQ ID NO: 44160 - RNA, 30 nt, Artificial Sequence; identical to SEQ ID NO: 28876
  derived and/or modified sequence opt5 from anti-HIV_CDR

SEQ ID NO: 44161 - RNA, 30 nt, Artificial Sequence; identical to SEQ ID NO: 28877
  derived and/or modified sequence opt5 from anti-HIV_CDR

SEQ ID NO: 44162 - RNA, 30 nt, Artificial Sequence
  derived and/or modified sequence opt5 from anti-HIV_CDR
cagcaauacggcagcuccagacgguggacc

SEQ ID NO: 44163 - RNA, 30 nt, Artificial Sequence; identical to SEQ ID NO: 28879
  derived and/or modified sequence opt5 from anti-HIV_CDR

SEQ ID NO: 44164 - RNA, 30 nt, Artificial Sequence; identical to SEQ ID NO: 28880
  derived and/or modified sequence opt5 from anti-HIV_CDR

SEQ ID NO: 44165 - RNA, 30 nt, Artificial Sequence; identical to SEQ ID NO: 28881
  derived and/or modified sequence opt5 from anti-HIV_CDR

SEQ ID NO: 44166 - RNA, 30 nt, Artificial Sequence
  derived and/or modified sequence opt5 from anti-HIV_CDR
gugagacggggcagcuccuaccccgacuau

SEQ ID NO: 44167 - RNA, 30 nt, Artificial Sequence; identical to SEQ ID NO: 28883
  derived and/or modified sequence opt5 from anti-HIV_CDR

SEQ ID NO: 44168 - RNA, 30 nt, Artificial Sequence
  derived and/or modified sequence opt5 from anti-HIV_CDR
cagagcuacgacuccucugugagcgucguu

SEQ ID NO: 44169 - RNA, 30 nt, Artificial Sequence
  derived and/or modified sequence opt5 from anti-HIV_CDR
agcuccuacaccucuagccugacacucgug

SEQ ID NO: 44170 - RNA, 30 nt, Artificial Sequence; identical to SEQ ID NO: 28886
  derived and/or modified sequence opt5 from anti-HIV_CDR

SEQ ID NO: 44171 - RNA, 30 nt, Artificial Sequence; identical to SEQ ID NO: 28887
  derived and/or modified sequence opt5 from anti-HIV_CDR

SEQ ID NO: 44172 - RNA, 30 nt, Artificial Sequence; identical to SEQ ID NO: 28888
  derived and/or modified sequence opt5 from anti-HIV_CDR

SEQ ID NO: 44173 - RNA, 30 nt, Artificial Sequence; identical to SEQ ID NO: 28889
  derived and/or modified sequence opt5 from anti-HIV_CDR

SEQ ID NO: 44174 - RNA, 30 nt, Artificial Sequence
  derived and/or modified sequence opt5 from anti-HIV_CDR
ggcgccuacaccacaacgagcacccuggug

SEQ ID NO: 44175 - RNA, 30 nt, Artificial Sequence; identical to SEQ ID NO: 28891
  derived and/or modified sequence opt5 from anti-HIV_CDR

SEQ ID NO: 44176 - RNA, 30 nt, Artificial Sequence; identical to SEQ ID NO: 28892
  derived and/or modified sequence opt5 from anti-HIV_CDR

SEQ ID NO: 44177 - RNA, 30 nt, Artificial Sequence; identical to SEQ ID NO: 28893
  derived and/or modified sequence opt5 from anti-HIV_CDR

SEQ ID NO: 44178 - RNA, 30 nt, Artificial Sequence; identical to SEQ ID NO: 28894
  derived and/or modified sequence opt5 from anti-HIV_CDR

SEQ ID NO: 44179 - RNA, 30 nt, Artificial Sequence; identical to SEQ ID NO: 28895
  derived and/or modified sequence opt5 from anti-HIV_CDR

SEQ ID NO: 44180 - RNA, 30 nt, Artificial Sequence; identical to SEQ ID NO: 28896
  derived and/or modified sequence opt5 from anti-HIV_CDR

SEQ ID NO: 44181 - RNA, 30 nt, Artificial Sequence; identical to SEQ ID NO: 28897
  derived and/or modified sequence opt5 from anti-HIV_CDR

SEQ ID NO: 44182 - RNA, 30 nt, Artificial Sequence; identical to SEQ ID NO: 28898
  derived and/or modified sequence opt5 from anti-HIV_CDR

SEQ ID NO: 44183 - RNA, 30 nt, Artificial Sequence; identical to SEQ ID NO: 28899
  derived and/or modified sequence opt5 from anti-HIV_CDR

SEQ ID NO: 44184 - RNA, 30 nt, Artificial Sequence; identical to SEQ ID NO: 28900
  derived and/or modified sequence opt5 from anti-HIV_CDR

SEQ ID NO: 44185 - RNA, 30 nt, Artificial Sequence; identical to SEQ ID NO: 28901
  derived and/or modified sequence opt5 from anti-HIV_CDR

SEQ ID NO: 44186 - RNA, 30 nt, Artificial Sequence; identical to SEQ ID NO: 28902
  derived and/or modified sequence opt5 from anti-HIV_CDR

SEQ ID NO: 44187 - RNA, 30 nt, Artificial Sequence; identical to SEQ ID NO: 28903
  derived and/or modified sequence opt5 from anti-HIV_CDR

SEQ ID NO: 44188 - RNA, 30 nt, Artificial Sequence
  derived and/or modified sequence opt5 from anti-HIV_CDR
ggcagcuucaccacaucccugacgcucgug

SEQ ID NO: 44189 - RNA, 30 nt, Artificial Sequence; identical to SEQ ID NO: 28905
  derived and/or modified sequence opt5 from anti-HIV_CDR

SEQ ID NO: 44190 - RNA, 30 nt, Artificial Sequence; identical to SEQ ID NO: 28906
  derived and/or modified sequence opt5 from anti-HIV_CDR

SEQ ID NO: 44191 - RNA, 30 nt, Artificial Sequence
  derived and/or modified sequence opt5 from anti-HIV_CDR
agcuccuacucuagcaccaacacauaugug

SEQ ID NO: 44192 - RNA, 30 nt, Artificial Sequence; identical to SEQ ID NO: 28908
  derived and/or modified sequence opt5 from anti-HIV_CDR

SEQ ID NO: 44193 - RNA, 30 nt, Artificial Sequence; identical to SEQ ID NO: 28909
  derived and/or modified sequence opt5 from anti-HIV_CDR

SEQ ID NO: 44194 - RNA, 30 nt, Artificial Sequence; identical to SEQ ID NO: 28910
  derived and/or modified sequence opt5 from anti-HIV_CDR

SEQ ID NO: 44195 - RNA, 30 nt, Artificial Sequence; identical to SEQ ID NO: 28911
  derived and/or modified sequence opt5 from anti-HIV_CDR

SEQ ID NO: 44196 - RNA, 30 nt, Artificial Sequence; identical to SEQ ID NO: 28912
  derived and/or modified sequence opt5 from anti-HIV_CDR

SEQ ID NO: 44197 - RNA, 30 nt, Artificial Sequence; identical to SEQ ID NO: 13629
  derived and/or modified sequence opt5 from anti-HIV_CDR

SEQ ID NO: 44198 - RNA, 30 nt, Artificial Sequence; identical to SEQ ID NO: 28914
  derived and/or modified sequence opt5 from anti-HIV_CDR

SEQ ID NO: 44199 - RNA, 30 nt, Artificial Sequence; identical to SEQ ID NO: 28915
  derived and/or modified sequence opt5 from anti-HIV_CDR

SEQ ID NO: 44200 - RNA, 30 nt, Artificial Sequence; identical to SEQ ID NO: 28916
  derived and/or modified sequence opt5 from anti-HIV_CDR

SEQ ID NO: 44201 - RNA, 30 nt, Artificial Sequence
  derived and/or modified sequence opt5 from anti-HIV_CDR
caggaguucggcagagccccucccuacccg

SEQ ID NO: 44202 - RNA, 30 nt, Artificial Sequence
  derived and/or modified sequence opt5 from anti-HIV_CDR
caggaguacggcagaagcccucccuauccg

SEQ ID NO: 44203 - RNA, 30 nt, Artificial Sequence
  derived and/or modified sequence opt5 from anti-HIV_CDR
caggaguacggcagagccccucccuauccg

SEQ ID NO: 44204 - RNA, 30 nt, Artificial Sequence; identical to SEQ ID NO: 28920
  derived and/or modified sequence opt5 from anti-HIV_CDR

SEQ ID NO: 44205 - RNA, 30 nt, Artificial Sequence; identical to SEQ ID NO: 28921
  derived and/or modified sequence opt5 from anti-HIV_CDR

SEQ ID NO: 44206 - RNA, 30 nt, Artificial Sequence; identical to SEQ ID NO: 28922
  derived and/or modified sequence opt5 from anti-HIV_CDR

SEQ ID NO: 44207 - RNA, 33 nt, Artificial Sequence
  derived and/or modified sequence opt5 from anti-HIV_CDR
ggcgagaaguccagagggagccgggccgugcag

SEQ ID NO: 44208 - RNA, 33 nt, Artificial Sequence; identical to SEQ ID NO: 28924
  derived and/or modified sequence opt5 from anti-HIV_CDR

SEQ ID NO: 44209 - RNA, 33 nt, Artificial Sequence
  derived and/or modified sequence opt5 from anti-HIV_CDR
ggcagacaggcccuggggagccgggcugugcaa

SEQ ID NO: 44210 - RNA, 33 nt, Artificial Sequence; identical to SEQ ID NO: 28926
  derived and/or modified sequence opt5 from anti-HIV_CDR

SEQ ID NO: 44211 - RNA, 33 nt, Artificial Sequence; identical to SEQ ID NO: 28927
  derived and/or modified sequence opt5 from anti-HIV_CDR

SEQ ID NO: 44212 - RNA, 33 nt, Artificial Sequence; identical to SEQ ID NO: 28928
  derived and/or modified sequence opt5 from anti-HIV_CDR

SEQ ID NO: 44213 - RNA, 33 nt, Artificial Sequence; identical to SEQ ID NO: 28929
  derived and/or modified sequence opt5 from anti-HIV_CDR

SEQ ID NO: 44214 - RNA, 33 nt, Artificial Sequence; identical to SEQ ID NO: 28930
  derived and/or modified sequence opt5 from anti-HIV_CDR

SEQ ID NO: 44215 - RNA, 33 nt, Artificial Sequence
  derived and/or modified sequence opt5 from anti-HIV_CDR
aaggccagccaggacguguccaccgcugucgcc

SEQ ID NO: 44216 - RNA, 33 nt, Artificial Sequence
  derived and/or modified sequence opt5 from anti-HIV_CDR
ggcagcagaaaccugucccaccggcuccugucu

SEQ ID NO: 44217 - RNA, 33 nt, Artificial Sequence; identical to SEQ ID NO: 28933
  derived and/or modified sequence opt5 from anti-HIV_CDR

SEQ ID NO: 44218 - RNA, 33 nt, Artificial Sequence; identical to SEQ ID NO: 28934
  derived and/or modified sequence opt5 from anti-HIV_CDR

SEQ ID NO: 44219 - RNA, 33 nt, Artificial Sequence; identical to SEQ ID NO: 28935
  derived and/or modified sequence opt5 from anti-HIV_CDR

SEQ ID NO: 44220 - RNA, 33 nt, Artificial Sequence; identical to SEQ ID NO: 28936
  derived and/or modified sequence opt5 from anti-HIV_CDR

SEQ ID NO: 44221 - RNA, 33 nt, Artificial Sequence; identical to SEQ ID NO: 28937
  derived and/or modified sequence opt5 from anti-HIV_CDR

SEQ ID NO: 44222 - RNA, 33 nt, Artificial Sequence
  derived and/or modified sequence opt5 from anti-HIV_CDR
cugcuccugcccuacuauggcgggccuuggauc

SEQ ID NO: 44223 - RNA, 33 nt, Artificial Sequence; identical to SEQ ID NO: 28939
  derived and/or modified sequence opt5 from anti-HIV_CDR

SEQ ID NO: 44224 - RNA, 33 nt, Artificial Sequence
  derived and/or modified sequence opt5 from anti-HIV_CDR
cagagcuacgacagaucccugcggggcucugug

SEQ ID NO: 44225 - RNA, 33 nt, Artificial Sequence; identical to SEQ ID NO: 28941
  derived and/or modified sequence opt5 from anti-HIV_CDR

SEQ ID NO: 44226 - RNA, 33 nt, Artificial Sequence; identical to SEQ ID NO: 28942
  derived and/or modified sequence opt5 from anti-HIV_CDR

SEQ ID NO: 44227 - RNA, 33 nt, Artificial Sequence; identical to SEQ ID NO: 28943
  derived and/or modified sequence opt5 from anti-HIV_CDR

SEQ ID NO: 44228 - RNA, 33 nt, Artificial Sequence; identical to SEQ ID NO: 28944
  derived and/or modified sequence opt5 from anti-HIV_CDR

SEQ ID NO: 44229 - RNA, 33 nt, Artificial Sequence
  derived and/or modified sequence opt5 from anti-HIV_CDR
ggcaccuacgacacaagccugucccucagacug

SEQ ID NO: 44230 - RNA, 33 nt, Artificial Sequence
  derived and/or modified sequence opt5 from anti-HIV_CDR
gccgcuuucgacagcgcccugucccucccccug

SEQ ID NO: 44231 - RNA, 33 nt, Artificial Sequence; identical to SEQ ID NO: 28947
  derived and/or modified sequence opt5 from anti-HIV_CDR

SEQ ID NO: 44232 - RNA, 33 nt, Artificial Sequence; identical to SEQ ID NO: 28948
  derived and/or modified sequence opt5 from anti-HIV_CDR

SEQ ID NO: 44233 - RNA, 33 nt, Artificial Sequence
  derived and/or modified sequence opt5 from anti-HIV_CDR
gccaccuacgacacaggccugagccucagacug

SEQ ID NO: 44234 - RNA, 33 nt, Artificial Sequence
  derived and/or modified sequence opt5 from anti-HIV_CDR
gccgcuuacgacagcacccugucccucagacug

SEQ ID NO: 44235 - RNA, 33 nt, Artificial Sequence
  derived and/or modified sequence opt5 from anti-HIV_CDR
gccgcuuacgacagcgccgugucccugcccguc

SEQ ID NO: 44236 - RNA, 33 nt, Artificial Sequence
  derived and/or modified sequence opt5 from anti-HIV_CDR
gccaccuacgacacagaucugagccucagacug

SEQ ID NO: 44237 - RNA, 33 nt, Artificial Sequence
  derived and/or modified sequence opt5 from anti-HIV_CDR
gccgcuuacgacagcucccugucucucagacug

SEQ ID NO: 44238 - RNA, 33 nt, Artificial Sequence; identical to SEQ ID NO: 28954
  derived and/or modified sequence opt5 from anti-HIV_CDR

SEQ ID NO: 44239 - RNA, 33 nt, Artificial Sequence; identical to SEQ ID NO: 28955
  derived and/or modified sequence opt5 from anti-HIV_CDR

SEQ ID NO: 44240 - RNA, 33 nt, Artificial Sequence
  derived and/or modified sequence opt5 from anti-HIV_CDR
gccaccuacgacagccagagauccauccggcug

SEQ ID NO: 44241 - RNA, 33 nt, Artificial Sequence
  derived and/or modified sequence opt5 from anti-HIV_CDR
gccguguacgacagcucccugucucucggccug

SEQ ID NO: 44242 - RNA, 33 nt, Artificial Sequence; identical to SEQ ID NO: 28958
  derived and/or modified sequence opt5 from anti-HIV_CDR

SEQ ID NO: 44243 - RNA, 33 nt, Artificial Sequence; identical to SEQ ID NO: 28959
  derived and/or modified sequence opt5 from anti-HIV_CDR

SEQ ID NO: 44244 - RNA, 33 nt, Artificial Sequence; identical to SEQ ID NO: 28960
  derived and/or modified sequence opt5 from anti-HIV_CDR

SEQ ID NO: 44245 - RNA, 33 nt, Artificial Sequence; identical to SEQ ID NO: 28961
  derived and/or modified sequence opt5 from anti-HIV_CDR

SEQ ID NO: 44246 - RNA, 33 nt, Artificial Sequence; identical to SEQ ID NO: 28962
  derived and/or modified sequence opt5 from anti-HIV_CDR

SEQ ID NO: 44247 - RNA, 33 nt, Artificial Sequence; identical to SEQ ID NO: 28963
  derived and/or modified sequence opt5 from anti-HIV_CDR

SEQ ID NO: 44248 - RNA, 33 nt, Artificial Sequence
  derived and/or modified sequence opt5 from anti-HIV_CDR
ggcaccugggacgggagccugacaacgggagug

SEQ ID NO: 44249 - RNA, 33 nt, Artificial Sequence; identical to SEQ ID NO: 28965
  derived and/or modified sequence opt5 from anti-HIV_CDR

SEQ ID NO: 44250 - RNA, 33 nt, Artificial Sequence; identical to SEQ ID NO: 28966
  derived and/or modified sequence opt5 from anti-HIV_CDR

SEQ ID NO: 44251 - RNA, 33 nt, Artificial Sequence; identical to SEQ ID NO: 28967
  derived and/or modified sequence opt5 from anti-HIV_CDR

SEQ ID NO: 44252 - RNA, 33 nt, Artificial Sequence; identical to SEQ ID NO: 28968
  derived and/or modified sequence opt5 from anti-HIV_CDR

SEQ ID NO: 44253 - RNA, 33 nt, Artificial Sequence; identical to SEQ ID NO: 28969
  derived and/or modified sequence opt5 from anti-HIV_CDR

SEQ ID NO: 44254 - RNA, 33 nt, Artificial Sequence
  derived and/or modified sequence opt5 from anti-HIV_CDR
cagagcuacgacuccucucugagcggcugggug

SEQ ID NO: 44255 - RNA, 33 nt, Artificial Sequence; identical to SEQ ID NO: 28971
  derived and/or modified sequence opt5 from anti-HIV_CDR

SEQ ID NO: 44256 - RNA, 33 nt, Artificial Sequence
  derived and/or modified sequence opt5 from anti-HIV_CDR
cugagcgccgacuccucuagcaccuaccaggug

SEQ ID NO: 44257 - RNA, 33 nt, Artificial Sequence; identical to SEQ ID NO: 28973
  derived and/or modified sequence opt5 from anti-HIV_CDR

SEQ ID NO: 44258 - RNA, 33 nt, Artificial Sequence; identical to SEQ ID NO: 28974
  derived and/or modified sequence opt5 from anti-HIV_CDR

SEQ ID NO: 44259 - RNA, 33 nt, Artificial Sequence; identical to SEQ ID NO: 28975
  derived and/or modified sequence opt5 from anti-HIV_CDR

SEQ ID NO: 44260 - RNA, 33 nt, Artificial Sequence
  derived and/or modified sequence opt5 from anti-HIV_CDR
gagauggccgcuaccagcgacgccuucgauauc

SEQ ID NO: 44261 - RNA, 33 nt, Artificial Sequence; identical to SEQ ID NO: 28977
  derived and/or modified sequence opt5 from anti-HIV_CDR

SEQ ID NO: 44262 - RNA, 33 nt, Artificial Sequence; identical to SEQ ID NO: 28978
  derived and/or modified sequence opt5 from anti-HIV_CDR

SEQ ID NO: 44263 - RNA, 33 nt, Artificial Sequence; identical to SEQ ID NO: 28979
  derived and/or modified sequence opt5 from anti-HIV_CDR

SEQ ID NO: 44264 - RNA, 33 nt, Artificial Sequence; identical to SEQ ID NO: 28980
  derived and/or modified sequence opt5 from anti-HIV_CDR

SEQ ID NO: 44265 - RNA, 33 nt, Artificial Sequence
  derived and/or modified sequence opt5 from anti-HIV_CDR
cagcaaagaaccacauggcccccugaguacacg

SEQ ID NO: 44266 - RNA, 33 nt, Artificial Sequence; identical to SEQ ID NO: 28982
  derived and/or modified sequence opt5 from anti-HIV_CDR

SEQ ID NO: 44267 - RNA, 33 nt, Artificial Sequence
  derived and/or modified sequence opt5 from anti-HIV_CDR
agacggcgcagcgccuggucccccuucgacucu

SEQ ID NO: 44268 - RNA, 33 nt, Artificial Sequence; identical to SEQ ID NO: 28984
  derived and/or modified sequence opt5 from anti-HIV_CDR

SEQ ID NO: 44269 - RNA, 33 nt, Artificial Sequence; identical to SEQ ID NO: 28985
  derived and/or modified sequence opt5 from anti-HIV_CDR

SEQ ID NO: 44270 - RNA, 33 nt, Artificial Sequence; identical to SEQ ID NO: 28986
  derived and/or modified sequence opt5 from anti-HIV_CDR

SEQ ID NO: 44271 - RNA, 33 nt, Artificial Sequence; identical to SEQ ID NO: 28987
  derived and/or modified sequence opt5 from anti-HIV_CDR

SEQ ID NO: 44272 - RNA, 33 nt, Artificial Sequence; identical to SEQ ID NO: 28988
  derived and/or modified sequence opt5 from anti-HIV_CDR

SEQ ID NO: 44273 - RNA, 33 nt, Artificial Sequence; identical to SEQ ID NO: 28989
  derived and/or modified sequence opt5 from anti-HIV_CDR

SEQ ID NO: 44274 - RNA, 33 nt, Artificial Sequence; identical to SEQ ID NO: 28990
  derived and/or modified sequence opt5 from anti-HIV_CDR

SEQ ID NO: 44275 - RNA, 33 nt, Artificial Sequence; identical to SEQ ID NO: 28991
  derived and/or modified sequence opt5 from anti-HIV_CDR

SEQ ID NO: 44276 - RNA, 33 nt, Artificial Sequence; identical to SEQ ID NO: 28992
  derived and/or modified sequence opt5 from anti-HIV_CDR

SEQ ID NO: 44277 - RNA, 33 nt, Artificial Sequence; identical to SEQ ID NO: 28993
  derived and/or modified sequence opt5 from anti-HIV_CDR

SEQ ID NO: 44278 - RNA, 33 nt, Artificial Sequence; identical to SEQ ID NO: 28994
  derived and/or modified sequence opt5 from anti-HIV_CDR

SEQ ID NO: 44279 - RNA, 33 nt, Artificial Sequence
  derived and/or modified sequence opt5 from anti-HIV_CDR
ggcgggggauaccccagaggcaacauggacgug

SEQ ID NO: 44280 - RNA, 33 nt, Artificial Sequence
  derived and/or modified sequence opt5 from anti-HIV_CDR
cugcuccugcuuuacuauggcgggcccuggauc

SEQ ID NO: 44281 - RNA, 33 nt, Artificial Sequence; identical to SEQ ID NO: 28997
  derived and/or modified sequence opt5 from anti-HIV_CDR

SEQ ID NO: 44282 - RNA, 33 nt, Artificial Sequence; identical to SEQ ID NO: 28998
  derived and/or modified sequence opt5 from anti-HIV_CDR

SEQ ID NO: 44283 - RNA, 33 nt, Artificial Sequence; identical to SEQ ID NO: 28999
  derived and/or modified sequence opt5 from anti-HIV_CDR

SEQ ID NO: 44284 - RNA, 33 nt, Artificial Sequence
  derived and/or modified sequence opt5 from anti-HIV_CDR
cagcaaagaaccacacggcccccugaguacacg

SEQ ID NO: 44285 - RNA, 33 nt, Artificial Sequence
  derived and/or modified sequence opt5 from anti-HIV_CDR
cagcaaagaaccacacggcccccugacuacacg

SEQ ID NO: 44286 - RNA, 33 nt, Artificial Sequence
  derived and/or modified sequence opt5 from anti-HIV_CDR
cagggcagaaccacacggcccccugacuacacg

SEQ ID NO: 44287 - RNA, 33 nt, Artificial Sequence
  derived and/or modified sequence opt5 from anti-HIV_CDR
cagcaaagaagcaccacacccccugaguacacg

SEQ ID NO: 44288 - RNA, 33 nt, Artificial Sequence; identical to SEQ ID NO: 29004
  derived and/or modified sequence opt5 from anti-HIV_CDR

SEQ ID NO: 44289 - RNA, 33 nt, Artificial Sequence; identical to SEQ ID NO: 29005
  derived and/or modified sequence opt5 from anti-HIV_CDR

SEQ ID NO: 44290 - RNA, 36 nt, Artificial Sequence; identical to SEQ ID NO: 29006
  derived and/or modified sequence opt5 from anti-HIV_CDR

SEQ ID NO: 44291 - RNA, 36 nt, Artificial Sequence; identical to SEQ ID NO: 29007
  derived and/or modified sequence opt5 from anti-HIV_CDR

SEQ ID NO: 44292 - RNA, 36 nt, Artificial Sequence
  derived and/or modified sequence opt5 from anti-HIV_CDR
cacaugugggacagcagauccggcuucucuuggagc

SEQ ID NO: 44293 - RNA, 36 nt, Artificial Sequence; identical to SEQ ID NO: 29009
  derived and/or modified sequence opt5 from anti-HIV_CDR

SEQ ID NO: 44294 - RNA, 36 nt, Artificial Sequence; identical to SEQ ID NO: 29010
  derived and/or modified sequence opt5 from anti-HIV_CDR

SEQ ID NO: 44295 - RNA, 36 nt, Artificial Sequence
  derived and/or modified sequence opt5 from anti-HIV_CDR
cacaucuacgacgccagacggcccaccaacugggug

SEQ ID NO: 44296 - RNA, 36 nt, Artificial Sequence
  derived and/or modified sequence opt5 from anti-HIV_CDR
cuggacggcgaggccuucagauacuaucucgaucug

SEQ ID NO: 44297 - RNA, 36 nt, Artificial Sequence; identical to SEQ ID NO: 29013
  derived and/or modified sequence opt5 from anti-HIV_CDR

SEQ ID NO: 44298 - RNA, 36 nt, Artificial Sequence
  derived and/or modified sequence opt5 from anti-HIV_CDR
cccgagccuagcuccaucguggccccgcuguacuau

SEQ ID NO: 44299 - RNA, 36 nt, Artificial Sequence
  derived and/or modified sequence opt5 from anti-HIV_CDR
ggcgggggagacggcagaaacuggcaucugcacccc

SEQ ID NO: 44300 - RNA, 36 nt, Artificial Sequence; identical to SEQ ID NO: 29016
  derived and/or modified sequence opt5 from anti-HIV_CDR

SEQ ID NO: 44301 - RNA, 36 nt, Artificial Sequence
  derived and/or modified sequence opt5 from anti-HIV_CDR
cccagaggcgggcgggacaacuggagcuuccacgug

SEQ ID NO: 44302 - RNA, 36 nt, Artificial Sequence; identical to SEQ ID NO: 29018
  derived and/or modified sequence opt5 from anti-HIV_CDR

SEQ ID NO: 44303 - RNA, 36 nt, Artificial Sequence; identical to SEQ ID NO: 29019
  derived and/or modified sequence opt5 from anti-HIV_CDR

SEQ ID NO: 44304 - RNA, 36 nt, Artificial Sequence; identical to SEQ ID NO: 29020
  derived and/or modified sequence opt5 from anti-HIV_CDR

SEQ ID NO: 44305 - RNA, 36 nt, Artificial Sequence; identical to SEQ ID NO: 29021
  derived and/or modified sequence opt5 from anti-HIV_CDR

SEQ ID NO: 44306 - RNA, 36 nt, Artificial Sequence; identical to SEQ ID NO: 29022
  derived and/or modified sequence opt5 from anti-HIV_CDR

SEQ ID NO: 44307 - RNA, 36 nt, Artificial Sequence; identical to SEQ ID NO: 29023
  derived and/or modified sequence opt5 from anti-HIV_CDR

SEQ ID NO: 44308 - RNA, 36 nt, Artificial Sequence; identical to SEQ ID NO: 29024
  derived and/or modified sequence opt5 from anti-HIV_CDR

SEQ ID NO: 44309 - RNA, 36 nt, Artificial Sequence; identical to SEQ ID NO: 29025
  derived and/or modified sequence opt5 from anti-HIV_CDR

SEQ ID NO: 44310 - RNA, 36 nt, Artificial Sequence; identical to SEQ ID NO: 29026
  derived and/or modified sequence opt5 from anti-HIV_CDR

SEQ ID NO: 44311 - RNA, 36 nt, Artificial Sequence; identical to SEQ ID NO: 13743
  derived and/or modified sequence opt5 from anti-HIV_CDR

SEQ ID NO: 44312 - RNA, 36 nt, Artificial Sequence; identical to SEQ ID NO: 13744
  derived and/or modified sequence opt5 from anti-HIV_CDR

SEQ ID NO: 44313 - RNA, 36 nt, Artificial Sequence
  derived and/or modified sequence opt5 from anti-HIV_CDR
gugaagcaguuccuggaguggcucuaccuggacuau

SEQ ID NO: 44314 - RNA, 36 nt, Artificial Sequence; identical to SEQ ID NO: 29030
  derived and/or modified sequence opt5 from anti-HIV_CDR

SEQ ID NO: 44315 - RNA, 36 nt, Artificial Sequence; identical to SEQ ID NO: 29031
  derived and/or modified sequence opt5 from anti-HIV_CDR

SEQ ID NO: 44316 - RNA, 36 nt, Artificial Sequence; identical to SEQ ID NO: 29032
  derived and/or modified sequence opt5 from anti-HIV_CDR

SEQ ID NO: 44317 - RNA, 36 nt, Artificial Sequence
  derived and/or modified sequence opt5 from anti-HIV_CDR
agaggcaucgccgcugccggguucuacuuucagcac

SEQ ID NO: 44318 - RNA, 36 nt, Artificial Sequence
  derived and/or modified sequence opt5 from anti-HIV_CDR
agaggcaucgccgcugccgcguucuacuuucagacc

SEQ ID NO: 44319 - RNA, 36 nt, Artificial Sequence
  derived and/or modified sequence opt5 from anti-HIV_CDR
agaggcaucgccgcugccggguucuacuuucagaac

SEQ ID NO: 44320 - RNA, 36 nt, Artificial Sequence
  derived and/or modified sequence opt5 from anti-HIV_CDR
cagagcuacgacaccucccugacagauacgggcgug

SEQ ID NO: 44321 - RNA, 36 nt, Artificial Sequence; identical to SEQ ID NO: 29037
  derived and/or modified sequence opt5 from anti-HIV_CDR

SEQ ID NO: 44322 - RNA, 36 nt, Artificial Sequence; identical to SEQ ID NO: 29038
  derived and/or modified sequence opt5 from anti-HIV_CDR

SEQ ID NO: 44323 - RNA, 36 nt, Artificial Sequence; identical to SEQ ID NO: 29039
  derived and/or modified sequence opt5 from anti-HIV_CDR

SEQ ID NO: 44324 - RNA, 36 nt, Artificial Sequence
  derived and/or modified sequence opt5 from anti-HIV_CDR
ugcuacagcggcagaucccgguauuucuuugacucu

SEQ ID NO: 44325 - RNA, 36 nt, Artificial Sequence; identical to SEQ ID NO: 29041
  derived and/or modified sequence opt5 from anti-HIV_CDR

SEQ ID NO: 44326 - RNA, 36 nt, Artificial Sequence
  derived and/or modified sequence opt5 from anti-HIV_CDR
cugagacggggcuacuaugacagcggggaggauuac

SEQ ID NO: 44327 - RNA, 36 nt, Artificial Sequence
  derived and/or modified sequence opt5 from anti-HIV_CDR
cugagacggggcuacuucgacagcgggggagaucac

SEQ ID NO: 44328 - RNA, 36 nt, Artificial Sequence
  derived and/or modified sequence opt5 from anti-HIV_CDR
agcuccuacaccucuagcuccacacugggcgugguc

SEQ ID NO: 44329 - RNA, 36 nt, Artificial Sequence; identical to SEQ ID NO: 29045
  derived and/or modified sequence opt5 from anti-HIV_CDR

SEQ ID NO: 44330 - RNA, 36 nt, Artificial Sequence
  derived and/or modified sequence opt5 from anti-HIV_CDR
agacggggccagcgccugcucgccuacuucgacuau

SEQ ID NO: 44331 - RNA, 36 nt, Artificial Sequence; identical to SEQ ID NO: 29047
  derived and/or modified sequence opt5 from anti-HIV_CDR

SEQ ID NO: 44332 - RNA, 36 nt, Artificial Sequence; identical to SEQ ID NO: 29048
  derived and/or modified sequence opt5 from anti-HIV_CDR

SEQ ID NO: 44333 - RNA, 36 nt, Artificial Sequence
  derived and/or modified sequence opt5 from anti-HIV_CDR
ggcagacgggaggggcugaacuuccuccuggacuac

SEQ ID NO: 44334 - RNA, 36 nt, Artificial Sequence; identical to SEQ ID NO: 29050
  derived and/or modified sequence opt5 from anti-HIV_CDR

SEQ ID NO: 44335 - RNA, 36 nt, Artificial Sequence; identical to SEQ ID NO: 29051
  derived and/or modified sequence opt5 from anti-HIV_CDR

SEQ ID NO: 44336 - RNA, 36 nt, Artificial Sequence; identical to SEQ ID NO: 29052
  derived and/or modified sequence opt5 from anti-HIV_CDR

SEQ ID NO: 44337 - RNA, 36 nt, Artificial Sequence
  derived and/or modified sequence opt5 from anti-HIV_CDR
gacuacaccgccagaggccggcacuucuuugauuau

SEQ ID NO: 44338 - RNA, 36 nt, Artificial Sequence; identical to SEQ ID NO: 29054
  derived and/or modified sequence opt5 from anti-HIV_CDR

SEQ ID NO: 44339 - RNA, 36 nt, Artificial Sequence
  derived and/or modified sequence opt5 from anti-HIV_CDR
cagagcuacgacuccucucugagcggcuccugggug

SEQ ID NO: 44340 - RNA, 36 nt, Artificial Sequence; identical to SEQ ID NO: 29056
  derived and/or modified sequence opt5 from anti-HIV_CDR

SEQ ID NO: 44341 - RNA, 36 nt, Artificial Sequence; identical to SEQ ID NO: 29057
  derived and/or modified sequence opt5 from anti-HIV_CDR

SEQ ID NO: 44342 - RNA, 36 nt, Artificial Sequence; identical to SEQ ID NO: 29058
  derived and/or modified sequence opt5 from anti-HIV_CDR

SEQ ID NO: 44343 - RNA, 36 nt, Artificial Sequence
  derived and/or modified sequence opt5 from anti-HIV_CDR
ggcgccaucaacagcucccccucuuacuucgacagc

SEQ ID NO: 44344 - RNA, 36 nt, Artificial Sequence; identical to SEQ ID NO: 29060
  derived and/or modified sequence opt5 from anti-HIV_CDR

SEQ ID NO: 44345 - RNA, 39 nt, Artificial Sequence; identical to SEQ ID NO: 29061
  derived and/or modified sequence opt5 from anti-HIV_CDR

SEQ ID NO: 44346 - RNA, 39 nt, Artificial Sequence; identical to SEQ ID NO: 29062
  derived and/or modified sequence opt5 from anti-HIV_CDR

SEQ ID NO: 44347 - RNA, 39 nt, Artificial Sequence; identical to SEQ ID NO: 29063
  derived and/or modified sequence opt5 from anti-HIV_CDR

SEQ ID NO: 44348 - RNA, 39 nt, Artificial Sequence; identical to SEQ ID NO: 29064
  derived and/or modified sequence opt5 from anti-HIV_CDR

SEQ ID NO: 44349 - RNA, 39 nt, Artificial Sequence
  derived and/or modified sequence opt5 from anti-HIV_CDR
gacagacgggaugacggccuggauuggcuccuggacccc

SEQ ID NO: 44350 - RNA, 39 nt, Artificial Sequence; identical to SEQ ID NO: 29066
  derived and/or modified sequence opt5 from anti-HIV_CDR

SEQ ID NO: 44351 - RNA, 39 nt, Artificial Sequence; identical to SEQ ID NO: 29067
  derived and/or modified sequence opt5 from anti-HIV_CDR

SEQ ID NO: 44352 - RNA, 39 nt, Artificial Sequence; identical to SEQ ID NO: 29068
  derived and/or modified sequence opt5 from anti-HIV_CDR

SEQ ID NO: 44353 - RNA, 39 nt, Artificial Sequence; identical to SEQ ID NO: 29069
  derived and/or modified sequence opt5 from anti-HIV_CDR

SEQ ID NO: 44354 - RNA, 39 nt, Artificial Sequence
  derived and/or modified sequence opt5 from anti-HIV_CDR
gacagacgggaugacgaucgcgccuggcugcucgacccc

SEQ ID NO: 44355 - RNA, 39 nt, Artificial Sequence; identical to SEQ ID NO: 29071
  derived and/or modified sequence opt5 from anti-HIV_CDR

SEQ ID NO: 44356 - RNA, 39 nt, Artificial Sequence; identical to SEQ ID NO: 29072
  derived and/or modified sequence opt5 from anti-HIV_CDR

SEQ ID NO: 44357 - RNA, 39 nt, Artificial Sequence; identical to SEQ ID NO: 29073
  derived and/or modified sequence opt5 from anti-HIV_CDR

SEQ ID NO: 44358 - RNA, 39 nt, Artificial Sequence; identical to SEQ ID NO: 29074
  derived and/or modified sequence opt5 from anti-HIV_CDR

SEQ ID NO: 44359 - RNA, 39 nt, Artificial Sequence; identical to SEQ ID NO: 29075
  derived and/or modified sequence opt5 from anti-HIV_CDR

SEQ ID NO: 44360 - RNA, 39 nt, Artificial Sequence; identical to SEQ ID NO: 29076
  derived and/or modified sequence opt5 from anti-HIV_CDR

SEQ ID NO: 44361 - RNA, 39 nt, Artificial Sequence; identical to SEQ ID NO: 29077
  derived and/or modified sequence opt5 from anti-HIV_CDR

SEQ ID NO: 44362 - RNA, 39 nt, Artificial Sequence; identical to SEQ ID NO: 29078
  derived and/or modified sequence opt5 from anti-HIV_CDR

SEQ ID NO: 44363 - RNA, 39 nt, Artificial Sequence; identical to SEQ ID NO: 29079
  derived and/or modified sequence opt5 from anti-HIV_CDR

SEQ ID NO: 44364 - RNA, 39 nt, Artificial Sequence; identical to SEQ ID NO: 29080
  derived and/or modified sequence opt5 from anti-HIV_CDR

SEQ ID NO: 44365 - RNA, 39 nt, Artificial Sequence; identical to SEQ ID NO: 29081
  derived and/or modified sequence opt5 from anti-HIV_CDR

SEQ ID NO: 44366 - RNA, 39 nt, Artificial Sequence; identical to SEQ ID NO: 29082
  derived and/or modified sequence opt5 from anti-HIV_CDR

SEQ ID NO: 44367 - RNA, 39 nt, Artificial Sequence
  derived and/or modified sequence opt5 from anti-HIV_CDR
aacggccacagcucccugggagggggcuacuucccccau

SEQ ID NO: 44368 - RNA, 39 nt, Artificial Sequence; identical to SEQ ID NO: 29084
  derived and/or modified sequence opt5 from anti-HIV_CDR

SEQ ID NO: 44369 - RNA, 39 nt, Artificial Sequence
  derived and/or modified sequence opt5 from anti-HIV_CDR
gccgcuagacgggccuucuacuauuacuauauggacgug

SEQ ID NO: 44370 - RNA, 39 nt, Artificial Sequence; identical to SEQ ID NO: 29086
  derived and/or modified sequence opt5 from anti-HIV_CDR

SEQ ID NO: 44371 - RNA, 39 nt, Artificial Sequence
  derived and/or modified sequence opt5 from anti-HIV_CDR
cacagcagacccggcgccccuccgcauuacuucgacuau

SEQ ID NO: 44372 - RNA, 39 nt, Artificial Sequence; identical to SEQ ID NO: 29088
  derived and/or modified sequence opt5 from anti-HIV_CDR

SEQ ID NO: 44373 - RNA, 39 nt, Artificial Sequence
  derived and/or modified sequence opt5 from anti-HIV_CDR
agagaccgguacaacuggaaguauuacuaucuggaugug

SEQ ID NO: 44374 - RNA, 39 nt, Artificial Sequence; identical to SEQ ID NO: 29090
  derived and/or modified sequence opt5 from anti-HIV_CDR

SEQ ID NO: 44375 - RNA, 39 nt, Artificial Sequence; identical to SEQ ID NO: 29091
  derived and/or modified sequence opt5 from anti-HIV_CDR

SEQ ID NO: 44376 - RNA, 39 nt, Artificial Sequence; identical to SEQ ID NO: 29092
  derived and/or modified sequence opt5 from anti-HIV_CDR

SEQ ID NO: 44377 - RNA, 39 nt, Artificial Sequence; identical to SEQ ID NO: 29093
  derived and/or modified sequence opt5 from anti-HIV_CDR

SEQ ID NO: 44378 - RNA, 39 nt, Artificial Sequence
  derived and/or modified sequence opt5 from anti-HIV_CDR
gacagcagaccccaggcccugguggcugcccucgauguc

SEQ ID NO: 44379 - RNA, 39 nt, Artificial Sequence; identical to SEQ ID NO: 29095
  derived and/or modified sequence opt5 from anti-HIV_CDR

SEQ ID NO: 44380 - RNA, 39 nt, Artificial Sequence
  derived and/or modified sequence opt5 from anti-HIV_CDR
agcgaccccgccaucgcugccgcgggcucccuggaucuc

SEQ ID NO: 44381 - RNA, 39 nt, Artificial Sequence
  derived and/or modified sequence opt5 from anti-HIV_CDR
cccuacgugcagaccgucgccacaacgaccuucgacuuu

SEQ ID NO: 44382 - RNA, 39 nt, Artificial Sequence; identical to SEQ ID NO: 29098
  derived and/or modified sequence opt5 from anti-HIV_CDR

SEQ ID NO: 44383 - RNA, 39 nt, Artificial Sequence
  derived and/or modified sequence opt5 from anti-HIV_CDR
ggcgcccugugguucgggcagcucagaggacuggacccc

SEQ ID NO: 44384 - RNA, 39 nt, Artificial Sequence
  derived and/or modified sequence opt5 from anti-HIV_CDR
gaccugagacccaugcggggcaacugggccaugcacgug

SEQ ID NO: 44385 - RNA, 39 nt, Artificial Sequence
  derived and/or modified sequence opt5 from anti-HIV_CDR
gacccccaggugaacagacggggcaauugcuucgaucac

SEQ ID NO: 44386 - RNA, 39 nt, Artificial Sequence
  derived and/or modified sequence opt5 from anti-HIV_CDR
gacccccagaucgagauuagaggcaacgccuucgauauc

SEQ ID NO: 44387 - RNA, 39 nt, Artificial Sequence
  derived and/or modified sequence opt5 from anti-HIV_CDR
gugcccagaaccacagccacgcggaacgcuuucgacauc

SEQ ID NO: 44388 - RNA, 39 nt, Artificial Sequence
  derived and/or modified sequence opt5 from anti-HIV_CDR
cacaagagcgugcugcucugguucagagagcuggacuac

SEQ ID NO: 44389 - RNA, 39 nt, Artificial Sequence; identical to SEQ ID NO: 29105
  derived and/or modified sequence opt5 from anti-HIV_CDR

SEQ ID NO: 44390 - RNA, 39 nt, Artificial Sequence
  derived and/or modified sequence opt5 from anti-HIV_CDR
cugcccagaaccacaggcauccggaacgccuucgacauu

SEQ ID NO: 44391 - RNA, 39 nt, Artificial Sequence
  derived and/or modified sequence opt5 from anti-HIV_CDR
cugcccagaaccacaggcauccggaacgccuucgacuuu

SEQ ID NO: 44392 - RNA, 42 nt, Artificial Sequence
  derived and/or modified sequence opt5 from anti-HIV_CDR
ggcacccugugguucggggagagcggacucagacuggaccac

SEQ ID NO: 44393 - RNA, 42 nt, Artificial Sequence; identical to SEQ ID NO: 29109
  derived and/or modified sequence opt5 from anti-HIV_CDR

SEQ ID NO: 44394 - RNA, 42 nt, Artificial Sequence; identical to SEQ ID NO: 29110
  derived and/or modified sequence opt5 from anti-HIV_CDR

SEQ ID NO: 44395 - RNA, 42 nt, Artificial Sequence; identical to SEQ ID NO: 29111
  derived and/or modified sequence opt5 from anti-HIV_CDR

SEQ ID NO: 44396 - RNA, 42 nt, Artificial Sequence; identical to SEQ ID NO: 29112
  derived and/or modified sequence opt5 from anti-HIV_CDR

SEQ ID NO: 44397 - RNA, 42 nt, Artificial Sequence; identical to SEQ ID NO: 29113
  derived and/or modified sequence opt5 from anti-HIV_CDR

SEQ ID NO: 44398 - RNA, 42 nt, Artificial Sequence; identical to SEQ ID NO: 29114
  derived and/or modified sequence opt5 from anti-HIV_CDR

SEQ ID NO: 44399 - RNA, 42 nt, Artificial Sequence; identical to SEQ ID NO: 29115
  derived and/or modified sequence opt5 from anti-HIV_CDR

SEQ ID NO: 44400 - RNA, 42 nt, Artificial Sequence
  derived and/or modified sequence opt5 from anti-HIV_CDR
ggcagccugugguucggggaguccggacucagacuggaccac

SEQ ID NO: 44401 - RNA, 42 nt, Artificial Sequence; identical to SEQ ID NO: 29117
  derived and/or modified sequence opt5 from anti-HIV_CDR

SEQ ID NO: 44402 - RNA, 42 nt, Artificial Sequence; identical to SEQ ID NO: 29118
  derived and/or modified sequence opt5 from anti-HIV_CDR

SEQ ID NO: 44403 - RNA, 42 nt, Artificial Sequence; identical to SEQ ID NO: 29119
  derived and/or modified sequence opt5 from anti-HIV_CDR

SEQ ID NO: 44404 - RNA, 42 nt, Artificial Sequence; identical to SEQ ID NO: 29120
  derived and/or modified sequence opt5 from anti-HIV_CDR

SEQ ID NO: 44405 - RNA, 42 nt, Artificial Sequence; identical to SEQ ID NO: 29121
  derived and/or modified sequence opt5 from anti-HIV_CDR

SEQ ID NO: 44406 - RNA, 42 nt, Artificial Sequence; identical to SEQ ID NO: 29122
  derived and/or modified sequence opt5 from anti-HIV_CDR

SEQ ID NO: 44407 - RNA, 42 nt, Artificial Sequence; identical to SEQ ID NO: 29123
  derived and/or modified sequence opt5 from anti-HIV_CDR

SEQ ID NO: 44408 - RNA, 42 nt, Artificial Sequence; identical to SEQ ID NO: 29124
  derived and/or modified sequence opt5 from anti-HIV_CDR

SEQ ID NO: 44409 - RNA, 42 nt, Artificial Sequence; identical to SEQ ID NO: 29125
  derived and/or modified sequence opt5 from anti-HIV_CDR

SEQ ID NO: 44410 - RNA, 42 nt, Artificial Sequence
  derived and/or modified sequence opt5 from anti-HIV_CDR
agagagauccgguucggcgaacugagcuuuuacuucgacuau

SEQ ID NO: 44411 - RNA, 42 nt, Artificial Sequence
  derived and/or modified sequence opt5 from anti-HIV_CDR
ccccacagcccuaccaacaucccguccagaccccuggacuac

SEQ ID NO: 44412 - RNA, 42 nt, Artificial Sequence; identical to SEQ ID NO: 29128
  derived and/or modified sequence opt5 from anti-HIV_CDR

SEQ ID NO: 44413 - RNA, 42 nt, Artificial Sequence
  derived and/or modified sequence opt5 from anti-HIV_CDR
agcaccccucugguguggcccccggccaacggccucgacguc

SEQ ID NO: 44414 - RNA, 42 nt, Artificial Sequence; identical to SEQ ID NO: 29130
  derived and/or modified sequence opt5 from anti-HIV_CDR

SEQ ID NO: 44415 - RNA, 45 nt, Artificial Sequence; identical to SEQ ID NO: 29131
  derived and/or modified sequence opt5 from anti-HIV_CDR

SEQ ID NO: 44416 - RNA, 45 nt, Artificial Sequence
  derived and/or modified sequence opt5 from anti-HIV_CDR
ggcagcgggagauggaccaucggagcccggauuuacuucgacaac

SEQ ID NO: 44417 - RNA, 45 nt, Artificial Sequence; identical to SEQ ID NO: 29133
  derived and/or modified sequence opt5 from anti-HIV_CDR

SEQ ID NO: 44418 - RNA, 45 nt, Artificial Sequence; identical to SEQ ID NO: 29134
  derived and/or modified sequence opt5 from anti-HIV_CDR

SEQ ID NO: 44419 - RNA, 45 nt, Artificial Sequence; identical to SEQ ID NO: 29135
  derived and/or modified sequence opt5 from anti-HIV_CDR

SEQ ID NO: 44420 - RNA, 45 nt, Artificial Sequence; identical to SEQ ID NO: 29136
  derived and/or modified sequence opt5 from anti-HIV_CDR

SEQ ID NO: 44421 - RNA, 45 nt, Artificial Sequence; identical to SEQ ID NO: 29137
  derived and/or modified sequence opt5 from anti-HIV_CDR

SEQ ID NO: 44422 - RNA, 45 nt, Artificial Sequence; identical to SEQ ID NO: 29138
  derived and/or modified sequence opt5 from anti-HIV_CDR

SEQ ID NO: 44423 - RNA, 45 nt, Artificial Sequence; identical to SEQ ID NO: 29139
  derived and/or modified sequence opt5 from anti-HIV_CDR

SEQ ID NO: 44424 - RNA, 45 nt, Artificial Sequence
  derived and/or modified sequence opt5 from anti-HIV_CDR
gcccccagacuggaccucggcgagcugagcuccggguuccacuuu

SEQ ID NO: 44425 - RNA, 45 nt, Artificial Sequence
  derived and/or modified sequence opt5 from anti-HIV_CDR
gcccccagacuggagcucggcgaacugagcuccggguuccacuac

SEQ ID NO: 44426 - RNA, 45 nt, Artificial Sequence
  derived and/or modified sequence opt5 from anti-HIV_CDR
ggccggcugcucaugcaguggcccccuagagggggauucgacccg

SEQ ID NO: 44427 - RNA, 45 nt, Artificial Sequence
  derived and/or modified sequence opt5 from anti-HIV_CDR
ggccggcuguucaugcaguggcccccuagagggggauuugacccg

SEQ ID NO: 44428 - RNA, 45 nt, Artificial Sequence
  derived and/or modified sequence opt5 from anti-HIV_CDR
ggcagacuguucgugcaguggcccccucaagggggauuugacccg

SEQ ID NO: 44429 - RNA, 45 nt, Artificial Sequence
  derived and/or modified sequence opt5 from anti-HIV_CDR
ggcagacuguucaugcaguggcccccucaagggggauuugacccg

SEQ ID NO: 44430 - RNA, 45 nt, Artificial Sequence; identical to SEQ ID NO: 29146
  derived and/or modified sequence opt5 from anti-HIV_CDR

SEQ ID NO: 44431 - RNA, 45 nt, Artificial Sequence
  derived and/or modified sequence opt5 from anti-HIV_CDR
aacaauaacaccagaaagagcaucaauauuggccccgggcgggcc

SEQ ID NO: 44432 - RNA, 45 nt, Artificial Sequence; identical to SEQ ID NO: 29148
  derived and/or modified sequence opt5 from anti-HIV_CDR

SEQ ID NO: 44433 - RNA, 45 nt, Artificial Sequence
  derived and/or modified sequence opt5 from anti-HIV_CDR
gaccugcuccccgauuacccugugagcuccgccccggaggacuuc

SEQ ID NO: 44434 - RNA, 45 nt, Artificial Sequence; identical to SEQ ID NO: 29150
  derived and/or modified sequence opt5 from anti-HIV_CDR

SEQ ID NO: 44435 - RNA, 45 nt, Artificial Sequence
  derived and/or modified sequence opt5 from anti-HIV_CDR
agauacugcagcuccaccacauguuaucggggccacuucgacuac

SEQ ID NO: 44436 - RNA, 45 nt, Artificial Sequence; identical to SEQ ID NO: 29152
  derived and/or modified sequence opt5 from anti-HIV_CDR

SEQ ID NO: 44437 - RNA, 45 nt, Artificial Sequence; identical to SEQ ID NO: 29153
  derived and/or modified sequence opt5 from anti-HIV_CDR

SEQ ID NO: 44438 - RNA, 45 nt, Artificial Sequence; identical to SEQ ID NO: 29154
  derived and/or modified sequence opt5 from anti-HIV_CDR

SEQ ID NO: 44439 - RNA, 45 nt, Artificial Sequence
  derived and/or modified sequence opt5 from anti-HIV_CDR
gcucccccuccgggcagcaccgagugggccuacuauuucgacuac

SEQ ID NO: 44440 - RNA, 45 nt, Artificial Sequence; identical to SEQ ID NO: 29156
  derived and/or modified sequence opt5 from anti-HIV_CDR

SEQ ID NO: 44441 - RNA, 45 nt, Artificial Sequence; identical to SEQ ID NO: 29157
  derived and/or modified sequence opt5 from anti-HIV_CDR

SEQ ID NO: 44442 - RNA, 45 nt, Artificial Sequence; identical to SEQ ID NO: 29158
  derived and/or modified sequence opt5 from anti-HIV_CDR

SEQ ID NO: 44443 - RNA, 45 nt, Artificial Sequence; identical to SEQ ID NO: 29159
  derived and/or modified sequence opt5 from anti-HIV_CDR

SEQ ID NO: 44444 - RNA, 45 nt, Artificial Sequence; identical to SEQ ID NO: 29160
  derived and/or modified sequence opt5 from anti-HIV_CDR

SEQ ID NO: 44445 - RNA, 45 nt, Artificial Sequence; identical to SEQ ID NO: 29161
  derived and/or modified sequence opt5 from anti-HIV_CDR

SEQ ID NO: 44446 - RNA, 45 nt, Artificial Sequence; identical to SEQ ID NO: 29162
  derived and/or modified sequence opt5 from anti-HIV_CDR

SEQ ID NO: 44447 - RNA, 45 nt, Artificial Sequence
  derived and/or modified sequence opt5 from anti-HIV_CDR
ggcgggggauacgccguggucggccccaaguaugggcuggacguu

SEQ ID NO: 44448 - RNA, 45 nt, Artificial Sequence; identical to SEQ ID NO: 29164
  derived and/or modified sequence opt5 from anti-HIV_CDR

SEQ ID NO: 44449 - RNA, 45 nt, Artificial Sequence; identical to SEQ ID NO: 29165
  derived and/or modified sequence opt5 from anti-HIV_CDR

SEQ ID NO: 44450 - RNA, 45 nt, Artificial Sequence; identical to SEQ ID NO: 29166
  derived and/or modified sequence opt5 from anti-HIV_CDR

SEQ ID NO: 44451 - RNA, 45 nt, Artificial Sequence; identical to SEQ ID NO: 29167
  derived and/or modified sequence opt5 from anti-HIV_CDR

SEQ ID NO: 44452 - RNA, 45 nt, Artificial Sequence; identical to SEQ ID NO: 29168
  derived and/or modified sequence opt5 from anti-HIV_CDR

SEQ ID NO: 44453 - RNA, 45 nt, Artificial Sequence
  derived and/or modified sequence opt5 from anti-HIV_CDR
gacagacggcgcuuccuggaguggagccucuacggcauggaugug

SEQ ID NO: 44454 - RNA, 45 nt, Artificial Sequence
  derived and/or modified sequence opt5 from anti-HIV_CDR
ggccccagaguguucuuugagagcuccggguacuauuuccgggac

SEQ ID NO: 44455 - RNA, 45 nt, Artificial Sequence
  derived and/or modified sequence opt5 from anti-HIV_CDR
ggccccagagugcuguucgagagcuccgggcacuaccuccgggac

SEQ ID NO: 44456 - RNA, 45 nt, Artificial Sequence
  derived and/or modified sequence opt5 from anti-HIV_CDR
ggccccagaguguucuuugagagcuccggguacuauuuccggaac

SEQ ID NO: 44457 - RNA, 45 nt, Artificial Sequence
  derived and/or modified sequence opt5 from anti-HIV_CDR
gagggcgggagccugugguucggaggcgccaacuggcucgacccc

SEQ ID NO: 44458 - RNA, 45 nt, Artificial Sequence; identical to SEQ ID NO: 29174
  derived and/or modified sequence opt5 from anti-HIV_CDR

SEQ ID NO: 44459 - RNA, 45 nt, Artificial Sequence; identical to SEQ ID NO: 29175
  derived and/or modified sequence opt5 from anti-HIV_CDR

SEQ ID NO: 44460 - RNA, 45 nt, Artificial Sequence
  derived and/or modified sequence opt5 from anti-HIV_CDR
gacaacagagaucaguggcuggugcuccggagcugguucgacccc

SEQ ID NO: 44461 - RNA, 45 nt, Artificial Sequence; identical to SEQ ID NO: 29177
  derived and/or modified sequence opt5 from anti-HIV_CDR

SEQ ID NO: 44462 - RNA, 48 nt, Artificial Sequence
  derived and/or modified sequence opt5 from anti-HIV_CDR
uacuucagcgacaccgauagauccgaguauucucccagccugcggucc

SEQ ID NO: 44463 - RNA, 48 nt, Artificial Sequence
  derived and/or modified sequence opt5 from anti-HIV_CDR
uacaucagcgacagagaguccgccaccuauaaccccucucugaauagc

SEQ ID NO: 44464 - RNA, 48 nt, Artificial Sequence
  derived and/or modified sequence opt5 from anti-HIV_CDR
uacuucagcgacaccgagaaguccaacuauaaucccucucugagaagc

SEQ ID NO: 44465 - RNA, 48 nt, Artificial Sequence
  derived and/or modified sequence opt5 from anti-HIV_CDR
uacaucagcgacagagccuccgcuaccuauaaccccucucugaauagc

SEQ ID NO: 44466 - RNA, 48 nt, Artificial Sequence; identical to SEQ ID NO: 29182
  derived and/or modified sequence opt5 from anti-HIV_CDR

SEQ ID NO: 44467 - RNA, 48 nt, Artificial Sequence
  derived and/or modified sequence opt5 from anti-HIV_CDR
uacgugcacaagagcggcgacaccaacuauucccccucucugaaaagc

SEQ ID NO: 44468 - RNA, 48 nt, Artificial Sequence; identical to SEQ ID NO: 29184
  derived and/or modified sequence opt5 from anti-HIV_CDR

SEQ ID NO: 44469 - RNA, 48 nt, Artificial Sequence
  derived and/or modified sequence opt5 from anti-HIV_CDR
uacaucagcaaguccgagucugccaacuauaaucccagccugaacucc

SEQ ID NO: 44470 - RNA, 48 nt, Artificial Sequence
  derived and/or modified sequence opt5 from anti-HIV_CDR
uacaucuauuacagcggcagcaccaacuauaaucccucucugaagucc

SEQ ID NO: 44471 - RNA, 48 nt, Artificial Sequence; identical to SEQ ID NO: 29187
  derived and/or modified sequence opt5 from anti-HIV_CDR

SEQ ID NO: 44472 - RNA, 48 nt, Artificial Sequence; identical to SEQ ID NO: 29188
  derived and/or modified sequence opt5 from anti-HIV_CDR

SEQ ID NO: 44473 - RNA, 48 nt, Artificial Sequence
  derived and/or modified sequence opt5 from anti-HIV_CDR
ggcuucagagggagccccuuuuccucuggaagccuguacuucgacucc

SEQ ID NO: 44474 - RNA, 48 nt, Artificial Sequence
  derived and/or modified sequence opt5 from anti-HIV_CDR
gugaucagcggcagaauuaccaucuucuacuauaacuacauugacguc

SEQ ID NO: 44475 - RNA, 48 nt, Artificial Sequence; identical to SEQ ID NO: 29191
  derived and/or modified sequence opt5 from anti-HIV_CDR

SEQ ID NO: 44476 - RNA, 48 nt, Artificial Sequence; identical to SEQ ID NO: 29192
  derived and/or modified sequence opt5 from anti-HIV_CDR

SEQ ID NO: 44477 - RNA, 48 nt, Artificial Sequence; identical to SEQ ID NO: 29193
  derived and/or modified sequence opt5 from anti-HIV_CDR

SEQ ID NO: 44478 - RNA, 48 nt, Artificial Sequence
  derived and/or modified sequence opt5 from anti-HIV_CDR
gacggccugggggagguggcccccgcuuaccucuauggaaucgaugcc

SEQ ID NO: 44479 - RNA, 48 nt, Artificial Sequence; identical to SEQ ID NO: 29195
  derived and/or modified sequence opt5 from anti-HIV_CDR

SEQ ID NO: 44480 - RNA, 48 nt, Artificial Sequence; identical to SEQ ID NO: 29196
  derived and/or modified sequence opt5 from anti-HIV_CDR

SEQ ID NO: 44481 - RNA, 48 nt, Artificial Sequence; identical to SEQ ID NO: 29197
  derived and/or modified sequence opt5 from anti-HIV_CDR

SEQ ID NO: 44482 - RNA, 48 nt, Artificial Sequence; identical to SEQ ID NO: 29198
  derived and/or modified sequence opt5 from anti-HIV_CDR

SEQ ID NO: 44483 - RNA, 48 nt, Artificial Sequence
  derived and/or modified sequence opt5 from anti-HIV_CDR
gccguggcuggccugugguucgaggacgccuacaacugguuugggccc

SEQ ID NO: 44484 - RNA, 48 nt, Artificial Sequence; identical to SEQ ID NO: 29200
  derived and/or modified sequence opt5 from anti-HIV_CDR

SEQ ID NO: 44485 - RNA, 48 nt, Artificial Sequence
  derived and/or modified sequence opt5 from anti-HIV_CDR
gccgaggcugccagcgacucccacucuagacccaucauguucgaucau

SEQ ID NO: 44486 - RNA, 48 nt, Artificial Sequence; identical to SEQ ID NO: 29202
  derived and/or modified sequence opt5 from anti-HIV_CDR

SEQ ID NO: 44487 - RNA, 48 nt, Artificial Sequence
  derived and/or modified sequence opt5 from anti-HIV_CDR
gccgaggcugaaagccagucccacucuagacccaucauguucgacagc

SEQ ID NO: 44488 - RNA, 48 nt, Artificial Sequence; identical to SEQ ID NO: 29204
  derived and/or modified sequence opt5 from anti-HIV_CDR

SEQ ID NO: 44489 - RNA, 48 nt, Artificial Sequence
  derived and/or modified sequence opt5 from anti-HIV_CDR
gacaacccccugcuccagagcggcgaguucuccucuagccuggaaaau

SEQ ID NO: 44490 - RNA, 48 nt, Artificial Sequence
  derived and/or modified sequence opt5 from anti-HIV_CDR
gacaacccccugcuccagagcggcgaguucuccucuagccuggauaau

SEQ ID NO: 44491 - RNA, 48 nt, Artificial Sequence
  derived and/or modified sequence opt5 from anti-HIV_CDR
ggcagagacuacaacuucuggggagggggcgggaagaucaauuuuccc

SEQ ID NO: 44492 - RNA, 48 nt, Artificial Sequence; identical to SEQ ID NO: 29208
  derived and/or modified sequence opt5 from anti-HIV_CDR

SEQ ID NO: 44493 - RNA, 48 nt, Artificial Sequence
  derived and/or modified sequence opt5 from anti-HIV_CDR
gccggccacugcagcuccaccucuagcguguacugucccuucgacaug

SEQ ID NO: 44494 - RNA, 48 nt, Artificial Sequence
  derived and/or modified sequence opt5 from anti-HIV_CDR
caggugagcuccuacucuagcuccggcuauagacgggaguucgacuac

SEQ ID NO: 44495 - RNA, 48 nt, Artificial Sequence; identical to SEQ ID NO: 29211
  derived and/or modified sequence opt5 from anti-HIV_CDR

SEQ ID NO: 44496 - RNA, 48 nt, Artificial Sequence
  derived and/or modified sequence opt5 from anti-HIV_CDR
gagggcggguacagcgacuucugguccggauauucuggcuuugauuac

SEQ ID NO: 44497 - RNA, 48 nt, Artificial Sequence
  derived and/or modified sequence opt5 from anti-HIV_CDR
cuguacuauaacuucggcagcggguacgacaccggaaucggcgaucac

SEQ ID NO: 44498 - RNA, 48 nt, Artificial Sequence
  derived and/or modified sequence opt5 from anti-HIV_CDR
gccagagagggccggugguucagcgacaacuacuaugcuauggaugug

SEQ ID NO: 44499 - RNA, 48 nt, Artificial Sequence
  derived and/or modified sequence opt5 from anti-HIV_CDR
gacagagugggccggcgccugggggagcucagcgccggauucgauuac

SEQ ID NO: 44500 - RNA, 48 nt, Artificial Sequence
  derived and/or modified sequence opt5 from anti-HIV_CDR
gccagaccccggagcccuugggacuccaccggcuggucugugggguac

SEQ ID NO: 44501 - RNA, 48 nt, Artificial Sequence; identical to SEQ ID NO: 29217
  derived and/or modified sequence opt5 from anti-HIV_CDR

SEQ ID NO: 44502 - RNA, 48 nt, Artificial Sequence; identical to SEQ ID NO: 29218
  derived and/or modified sequence opt5 from anti-HIV_CDR

SEQ ID NO: 44503 - RNA, 48 nt, Artificial Sequence
  derived and/or modified sequence opt5 from anti-HIV_CDR
gacaaccccgugcugcagcucggcgagcugagcuccucucuugauuac

SEQ ID NO: 44504 - RNA, 48 nt, Artificial Sequence
  derived and/or modified sequence opt5 from anti-HIV_CDR
ggcuucagagggagccccuuuuccucuggaagcauguacuucgacucc

SEQ ID NO: 44505 - RNA, 48 nt, Artificial Sequence
  derived and/or modified sequence opt5 from anti-HIV_CDR
ggcuucagagggagcccccuguccucuggaagccucuacuuugacucc

SEQ ID NO: 44506 - RNA, 48 nt, Artificial Sequence; identical to SEQ ID NO: 29222
  derived and/or modified sequence opt5 from anti-HIV_CDR

SEQ ID NO: 44507 - RNA, 48 nt, Artificial Sequence; identical to SEQ ID NO: 29223
  derived and/or modified sequence opt5 from anti-HIV_CDR

SEQ ID NO: 44508 - RNA, 48 nt, Artificial Sequence; identical to SEQ ID NO: 29224
  derived and/or modified sequence opt5 from anti-HIV_CDR

SEQ ID NO: 44509 - RNA, 48 nt, Artificial Sequence; identical to SEQ ID NO: 29225
  derived and/or modified sequence opt5 from anti-HIV_CDR

SEQ ID NO: 44510 - RNA, 51 nt, Artificial Sequence
  derived and/or modified sequence opt5 from anti-HIV_CDR
uacaucagcuccggcucuagcacccugcacuaugccgacacagugaagggg

SEQ ID NO: 44511 - RNA, 51 nt, Artificial Sequence
  derived and/or modified sequence opt5 from anti-HIV_CDR
agauaccuggacuggagccccaucggccgggauaccuaugggacagacgug

SEQ ID NO: 44512 - RNA, 51 nt, Artificial Sequence
  derived and/or modified sequence opt5 from anti-HIV_CDR
agauacuucgacuggagccccuuucggcgcgauaccuauggcacagacgug

SEQ ID NO: 44513 - RNA, 51 nt, Artificial Sequence
  derived and/or modified sequence opt5 from anti-HIV_CDR
ggcagagacuacaacuucuggagcgggggaggccgguauuacuuugauuuc

SEQ ID NO: 44514 - RNA, 51 nt, Artificial Sequence
  derived and/or modified sequence opt5 from anti-HIV_CDR
ggcauccaggaggacuacgauuucuggagagaauaucgggagcuggacuac

SEQ ID NO: 44515 - RNA, 51 nt, Artificial Sequence
  derived and/or modified sequence opt5 from anti-HIV_CDR
gugcugaacaauaacaccagaaagagcaucaauauuggccccgggcgggcc

SEQ ID NO: 44516 - RNA, 51 nt, Artificial Sequence; identical to SEQ ID NO: 29232
  derived and/or modified sequence opt5 from anti-HIV_CDR

SEQ ID NO: 44517 - RNA, 51 nt, Artificial Sequence
  derived and/or modified sequence opt5 from anti-HIV_CDR
cacggcagaaccguguucggggucguucggaacuacuauuacauggacgug

SEQ ID NO: 44518 - RNA, 51 nt, Artificial Sequence; identical to SEQ ID NO: 29234
  derived and/or modified sequence opt5 from anti-HIV_CDR

SEQ ID NO: 44519 - RNA, 51 nt, Artificial Sequence; identical to SEQ ID NO: 29235
  derived and/or modified sequence opt5 from anti-HIV_CDR

SEQ ID NO: 44520 - RNA, 51 nt, Artificial Sequence; identical to SEQ ID NO: 29236
  derived and/or modified sequence opt5 from anti-HIV_CDR

SEQ ID NO: 44521 - RNA, 51 nt, Artificial Sequence
  derived and/or modified sequence opt5 from anti-HIV_CDR
gaccagggcggguaccccgugagcccugucggaccgaagugguucgauccc

SEQ ID NO: 44522 - RNA, 51 nt, Artificial Sequence
  derived and/or modified sequence opt5 from anti-HIV_CDR
agagacaaguaccaguauaucgauagcuccggcgacuaccccuucgaucgg

SEQ ID NO: 44523 - RNA, 51 nt, Artificial Sequence
  derived and/or modified sequence opt5 from anti-HIV_CDR
cagcugagagcccccaccacacgguuccgccacggcggguacuuugagaac

SEQ ID NO: 44524 - RNA, 51 nt, Artificial Sequence
  derived and/or modified sequence opt5 from anti-HIV_CDR
caggugagagcccccacccugcgguuccgccacggcggguacuuugagaca

SEQ ID NO: 44525 - RNA, 51 nt, Artificial Sequence; identical to SEQ ID NO: 29241
  derived and/or modified sequence opt5 from anti-HIV_CDR

SEQ ID NO: 44526 - RNA, 51 nt, Artificial Sequence; identical to SEQ ID NO: 29242
  derived and/or modified sequence opt5 from anti-HIV_CDR

SEQ ID NO: 44527 - RNA, 51 nt, Artificial Sequence
  derived and/or modified sequence opt5 from anti-HIV_CDR
agccugaccggcagacuccaccugggggagcuuuccucuggaaucggcccc

SEQ ID NO: 44528 - RNA, 51 nt, Artificial Sequence; identical to SEQ ID NO: 29244
  derived and/or modified sequence opt5 from anti-HIV_CDR

SEQ ID NO: 44529 - RNA, 51 nt, Artificial Sequence; identical to SEQ ID NO: 29245
  derived and/or modified sequence opt5 from anti-HIV_CDR

SEQ ID NO: 44530 - RNA, 51 nt, Artificial Sequence; identical to SEQ ID NO: 29246
  derived and/or modified sequence opt5 from anti-HIV_CDR

SEQ ID NO: 44531 - RNA, 51 nt, Artificial Sequence; identical to SEQ ID NO: 29247
  derived and/or modified sequence opt5 from anti-HIV_CDR

SEQ ID NO: 44532 - RNA, 54 nt, Artificial Sequence; identical to SEQ ID NO: 29248
  derived and/or modified sequence opt5 from anti-HIV_CDR

SEQ ID NO: 44533 - RNA, 54 nt, Artificial Sequence
  derived and/or modified sequence opt5 from anti-HIV_CDR
aacagacggguggccaugcccgaggcuaugauccugagcuucuacauggacguc

SEQ ID NO: 44534 - RNA, 54 nt, Artificial Sequence
  derived and/or modified sequence opt5 from anti-HIV_CDR
ggccugugcagagggggaaacugucggcucggccccagcggguggcuggacccu

SEQ ID NO: 44535 - RNA, 54 nt, Artificial Sequence
  derived and/or modified sequence opt5 from anti-HIV_CDR
acacccccucacuacgacgugcugaccggcuauccgagcuccguccucgaguuc

SEQ ID NO: 44536 - RNA, 54 nt, Artificial Sequence; identical to SEQ ID NO: 29252
  derived and/or modified sequence opt5 from anti-HIV_CDR

SEQ ID NO: 44537 - RNA, 54 nt, Artificial Sequence; identical to SEQ ID NO: 29253
  derived and/or modified sequence opt5 from anti-HIV_CDR

SEQ ID NO: 44538 - RNA, 54 nt, Artificial Sequence; identical to SEQ ID NO: 29254
  derived and/or modified sequence opt5 from anti-HIV_CDR

SEQ ID NO: 44539 - RNA, 54 nt, Artificial Sequence; identical to SEQ ID NO: 29255
  derived and/or modified sequence opt5 from anti-HIV_CDR

SEQ ID NO: 44540 - RNA, 54 nt, Artificial Sequence
  derived and/or modified sequence opt5 from anti-HIV_CDR
ggcagacagaccuuccgggccaucuggagcgggcccccugcuguguuugacauu

SEQ ID NO: 44541 - RNA, 54 nt, Artificial Sequence
  derived and/or modified sequence opt5 from anti-HIV_CDR
ggcagacagaccuuccgggccaucuggagcgggcccccuguggucuuugacauu

SEQ ID NO: 44542 - RNA, 54 nt, Artificial Sequence
  derived and/or modified sequence opt5 from anti-HIV_CDR
agcagaggcgacuacaacuucugguccggguaucccgaguaccacuuugaucgg

SEQ ID NO: 44543 - RNA, 54 nt, Artificial Sequence
  derived and/or modified sequence opt5 from anti-HIV_CDR
cugcccaagagcagaauggugggcggggaccaccucccuuucuacccggauuuu

SEQ ID NO: 44544 - RNA, 54 nt, Artificial Sequence; identical to SEQ ID NO: 29260
  derived and/or modified sequence opt5 from anti-HIV_CDR

SEQ ID NO: 44545 - RNA, 54 nt, Artificial Sequence
  derived and/or modified sequence opt5 from anti-HIV_CDR
ggcgggagcaugaucagaggagugcccuccccuuucuacuauggcauggacguc

SEQ ID NO: 44546 - RNA, 54 nt, Artificial Sequence; identical to SEQ ID NO: 29262
  derived and/or modified sequence opt5 from anti-HIV_CDR

SEQ ID NO: 44547 - RNA, 54 nt, Artificial Sequence
  derived and/or modified sequence opt5 from anti-HIV_CDR
gacagauacgaggccgcuugguucggcgccgauaagguguaugggauggacguc

SEQ ID NO: 44548 - RNA, 54 nt, Artificial Sequence
  derived and/or modified sequence opt5 from anti-HIV_CDR
gagcacagacugcccccuccgaccggccggcgcacaagaaacugguucgacccc

SEQ ID NO: 44549 - RNA, 54 nt, Artificial Sequence
  derived and/or modified sequence opt5 from anti-HIV_CDR
ggcagagggagcuuccagggauuucaacaguacgaguauuacggcauggacgug

SEQ ID NO: 44550 - RNA, 54 nt, Artificial Sequence
  derived and/or modified sequence opt5 from anti-HIV_CDR
ggcagaggguacagccacggauuccagcaauauaacuacuauggcauggacgug

SEQ ID NO: 44551 - RNA, 54 nt, Artificial Sequence
  derived and/or modified sequence opt5 from anti-HIV_CDR
ggcagagggagcuucaccggauuugaccaguaccacuauuacggcauggaugug

SEQ ID NO: 44552 - RNA, 54 nt, Artificial Sequence; identical to SEQ ID NO: 29268
  derived and/or modified sequence opt5 from anti-HIV_CDR

SEQ ID NO: 44553 - RNA, 54 nt, Artificial Sequence; identical to SEQ ID NO: 29269
  derived and/or modified sequence opt5 from anti-HIV_CDR

SEQ ID NO: 44554 - RNA, 54 nt, Artificial Sequence
  derived and/or modified sequence opt5 from anti-HIV_CDR
agaggccggcugaacauccccagcccuuccgccauucucaccgcuuucgacgug

SEQ ID NO: 44555 - RNA, 54 nt, Artificial Sequence
  derived and/or modified sequence opt5 from anti-HIV_CDR
ggccccgggagcauggugagaggacugaucgucaccuccuacggcauggacguu

SEQ ID NO: 44556 - RNA, 54 nt, Artificial Sequence
  derived and/or modified sequence opt5 from anti-HIV_CDR
aagagagugaccaucuucggcgucguugacacaccccggggguacuuugauuau

SEQ ID NO: 44557 - RNA, 54 nt, Artificial Sequence
  derived and/or modified sequence opt5 from anti-HIV_CDR
ggccagagaaacgugcugcacuuccucgagcggaagaaugacgccuuugauauc

SEQ ID NO: 44558 - RNA, 54 nt, Artificial Sequence; identical to SEQ ID NO: 29274
  derived and/or modified sequence opt5 from anti-HIV_CDR

SEQ ID NO: 44559 - RNA, 57 nt, Artificial Sequence
  derived and/or modified sequence opt5 from anti-HIV_CDR
gacaccacaacguucaccacauuuggcgggggacccaacaugggcggguucgauccu

SEQ ID NO: 44560 - RNA, 57 nt, Artificial Sequence
  derived and/or modified sequence opt5 from anti-HIV_CDR
gccggccuggacuacaacuucuggaaugggaagggaagaaaaggcgcuuuugaugug

SEQ ID NO: 44561 - RNA, 57 nt, Artificial Sequence; identical to SEQ ID NO: 29277
  derived and/or modified sequence opt5 from anti-HIV_CDR

SEQ ID NO: 44562 - RNA, 57 nt, Artificial Sequence; identical to SEQ ID NO: 29278
  derived and/or modified sequence opt5 from anti-HIV_CDR

SEQ ID NO: 44563 - RNA, 57 nt, Artificial Sequence; identical to SEQ ID NO: 29279
  derived and/or modified sequence opt5 from anti-HIV_CDR

SEQ ID NO: 44564 - RNA, 57 nt, Artificial Sequence; identical to SEQ ID NO: 29280
  derived and/or modified sequence opt5 from anti-HIV_CDR

SEQ ID NO: 44565 - RNA, 57 nt, Artificial Sequence; identical to SEQ ID NO: 29281
  derived and/or modified sequence opt5 from anti-HIV_CDR

SEQ ID NO: 44566 - RNA, 57 nt, Artificial Sequence; identical to SEQ ID NO: 29282
  derived and/or modified sequence opt5 from anti-HIV_CDR

SEQ ID NO: 44567 - RNA, 57 nt, Artificial Sequence; identical to SEQ ID NO: 29283
  derived and/or modified sequence opt5 from anti-HIV_CDR

SEQ ID NO: 44568 - RNA, 57 nt, Artificial Sequence; identical to SEQ ID NO: 29284
  derived and/or modified sequence opt5 from anti-HIV_CDR

SEQ ID NO: 44569 - RNA, 57 nt, Artificial Sequence; identical to SEQ ID NO: 29285
  derived and/or modified sequence opt5 from anti-HIV_CDR

SEQ ID NO: 44570 - RNA, 57 nt, Artificial Sequence; identical to SEQ ID NO: 29286
  derived and/or modified sequence opt5 from anti-HIV_CDR

SEQ ID NO: 44571 - RNA, 57 nt, Artificial Sequence
  derived and/or modified sequence opt5 from anti-HIV_CDR
accaacggcacagagaucuucagacccgggggaggcgacaugcgggauaauuggcgc

SEQ ID NO: 44572 - RNA, 57 nt, Artificial Sequence; identical to SEQ ID NO: 29288
  derived and/or modified sequence opt5 from anti-HIV_CDR

SEQ ID NO: 44573 - RNA, 57 nt, Artificial Sequence; identical to SEQ ID NO: 29289
  derived and/or modified sequence opt5 from anti-HIV_CDR

SEQ ID NO: 44574 - RNA, 57 nt, Artificial Sequence
  derived and/or modified sequence opt5 from anti-HIV_CDR
ggcgccaccuacuauuacgacagcuccgggcaccagucuagacgggcuuucgauauc

SEQ ID NO: 44575 - RNA, 57 nt, Artificial Sequence; identical to SEQ ID NO: 29291
  derived and/or modified sequence opt5 from anti-HIV_CDR

SEQ ID NO: 44576 - RNA, 57 nt, Artificial Sequence
  derived and/or modified sequence opt5 from anti-HIV_CDR
cacagagccgacuacgauuucuggaacggcagcaaucugcggggguauuuugacccc

SEQ ID NO: 44577 - RNA, 57 nt, Artificial Sequence
  derived and/or modified sequence opt5 from anti-HIV_CDR
cacagagccaacuacgacuucuggggcgggagcaaucugcggggauauuuugauccc

SEQ ID NO: 44578 - RNA, 57 nt, Artificial Sequence
  derived and/or modified sequence opt5 from anti-HIV_CDR
ggcuuccacuuuuggagcgggaccggaacaagaccccggaacugguacuucgaccug

SEQ ID NO: 44579 - RNA, 57 nt, Artificial Sequence; identical to SEQ ID NO: 29295
  derived and/or modified sequence opt5 from anti-HIV_CDR

SEQ ID NO: 44580 - RNA, 57 nt, Artificial Sequence; identical to SEQ ID NO: 29296
  derived and/or modified sequence opt5 from anti-HIV_CDR

SEQ ID NO: 44581 - RNA, 57 nt, Artificial Sequence
  derived and/or modified sequence opt5 from anti-HIV_CDR
gacaccacaacguucggcgccuuugggggaagccccaacaugggcgggcuggauccu

SEQ ID NO: 44582 - RNA, 57 nt, Artificial Sequence
  derived and/or modified sequence opt5 from anti-HIV_CDR
caccugguggucgccguugcugccggccccgacuacuucagcuaugggauggaugug

SEQ ID NO: 44583 - RNA, 57 nt, Artificial Sequence
  derived and/or modified sequence opt5 from anti-HIV_CDR
gacaccacaacguucagcuccuuuggcucucccccuaacaugggagggcuggauccg

SEQ ID NO: 44584 - RNA, 57 nt, Artificial Sequence
  derived and/or modified sequence opt5 from anti-HIV_CDR
gacaccacaacguucggcgccuuugggggaggcgcuaacaugggagggcuggauccc

SEQ ID NO: 44585 - RNA, 57 nt, Artificial Sequence
  derived and/or modified sequence opt5 from anti-HIV_CDR
gacaccacaacguucaccagcuuuggcuccccucccagaaugggagggcuggauccg

SEQ ID NO: 44586 - RNA, 57 nt, Artificial Sequence
  derived and/or modified sequence opt5 from anti-HIV_CDR
gacaccacaacguucagcuccuuuggcucucccccucacaugggagggcuggauccg

SEQ ID NO: 44587 - RNA, 57 nt, Artificial Sequence
  derived and/or modified sequence opt5 from anti-HIV_CDR
gacagagugagcgauuacgacuucugguccggcaagcggggguauggaauggauguc

SEQ ID NO: 44588 - RNA, 57 nt, Artificial Sequence; identical to SEQ ID NO: 29304
  derived and/or modified sequence opt5 from anti-HIV_CDR

SEQ ID NO: 44589 - RNA, 57 nt, Artificial Sequence; identical to SEQ ID NO: 29305
  derived and/or modified sequence opt5 from anti-HIV_CDR

SEQ ID NO: 44590 - RNA, 57 nt, Artificial Sequence
  derived and/or modified sequence opt5 from anti-HIV_CDR
cacggcgccagcgcuaacuacgggcccggauccuauucugccgagcauuuccagcac

SEQ ID NO: 44591 - RNA, 60 nt, Artificial Sequence
  derived and/or modified sequence opt5 from anti-HIV_CDR
cacgaggcccccagauacagcuaugcuuuccggcgcuacuaucauuacggccuggacgug

SEQ ID NO: 44592 - RNA, 60 nt, Artificial Sequence
  derived and/or modified sequence opt5 from anti-HIV_CDR
accagcacauacgaccagugguccggccugcaccaugauggggugauggccuucucuagc

SEQ ID NO: 44593 - RNA, 60 nt, Artificial Sequence; identical to SEQ ID NO: 29309
  derived and/or modified sequence opt5 from anti-HIV_CDR

SEQ ID NO: 44594 - RNA, 60 nt, Artificial Sequence; identical to SEQ ID NO: 29310
  derived and/or modified sequence opt5 from anti-HIV_CDR

SEQ ID NO: 44595 - RNA, 60 nt, Artificial Sequence; identical to SEQ ID NO: 29311
  derived and/or modified sequence opt5 from anti-HIV_CDR

SEQ ID NO: 44596 - RNA, 60 nt, Artificial Sequence
  derived and/or modified sequence opt5 from anti-HIV_CDR
aaccugaucgaggaaagccagacccaacaggagauuaaugaaagagaccuccuggcccuu

SEQ ID NO: 44597 - RNA, 60 nt, Artificial Sequence
  derived and/or modified sequence opt5 from anti-HIV_CDR
aaccugaucgaggaaagccagauucaacaggagaagaaugaaaaagagcuccuggaacuu

SEQ ID NO: 44598 - RNA, 60 nt, Artificial Sequence
  derived and/or modified sequence opt5 from anti-HIV_CDR
agccugaucgagaacucccagauucaacaggaaaagaaugagcaggaccuccugcagcuu

SEQ ID NO: 44599 - RNA, 60 nt, Artificial Sequence
  derived and/or modified sequence opt5 from anti-HIV_CDR
agccugaucgaggaaucccagauucaacaggagaagaacgaaaaagagcuccuggaacuu

SEQ ID NO: 44600 - RNA, 60 nt, Artificial Sequence
  derived and/or modified sequence opt5 from anti-HIV_CDR
agacugaucgaggaaagccagacccaacaggagaagaacgaacaggagcuccuggaacuu

SEQ ID NO: 44601 - RNA, 60 nt, Artificial Sequence
  derived and/or modified sequence opt5 from anti-HIV_CDR
agccugaucgaggaaucccagacccaacaggagaagaacgaaaaagagcuccuggaacuu

SEQ ID NO: 44602 - RNA, 60 nt, Artificial Sequence
  derived and/or modified sequence opt5 from anti-HIV_CDR
aaccugcucgaggaaagccagaaucaacaggagaagaacgaacaggagcugcuugaacug

SEQ ID NO: 44603 - RNA, 60 nt, Artificial Sequence
  derived and/or modified sequence opt5 from anti-HIV_CDR
acccugaucgaggaaagccagaaccaacaggagaagaaugaacucgagcugcuugaacug

SEQ ID NO: 44604 - RNA, 60 nt, Artificial Sequence
  derived and/or modified sequence opt5 from anti-HIV_CDR
acccugcaggaggaaagccaaaaccagcaggagaagaaugaacaggagcuccuggaacuu

SEQ ID NO: 44605 - RNA, 60 nt, Artificial Sequence
  derived and/or modified sequence opt5 from anti-HIV_CDR
agccugcucgaggaaucccagaaccaacaggagaagaaugaacaggagcugcuugaacug

SEQ ID NO: 44606 - RNA, 60 nt, Artificial Sequence
  derived and/or modified sequence opt5 from anti-HIV_CDR
acccugaucgaggaaagccagaaccaacaggagaagaaucagcaggaacuccugcaacuu

SEQ ID NO: 44607 - RNA, 60 nt, Artificial Sequence
  derived and/or modified sequence opt5 from anti-HIV_CDR
acccugaucgaggaaagccagaaccaacaggagaagaaugaacaggagcuccugggccuu

SEQ ID NO: 44608 - RNA, 60 nt, Artificial Sequence
  derived and/or modified sequence opt5 from anti-HIV_CDR
acccugaucgaggaaagccagaaccaacaggagaagaaugaacaggagcuccuggaacuu

SEQ ID NO: 44609 - RNA, 60 nt, Artificial Sequence
  derived and/or modified sequence opt5 from anti-HIV_CDR
agccugaucgaggacucccagauucaacaggaaaagaacgagaaagaacuccuggagcuu

SEQ ID NO: 44610 - RNA, 60 nt, Artificial Sequence
  derived and/or modified sequence opt5 from anti-HIV_CDR
agccugcucgagaagucccagacccaacaggagaaaaacgaacaggaacugcuugagcug

SEQ ID NO: 44611 - RNA, 60 nt, Artificial Sequence
  derived and/or modified sequence opt5 from anti-HIV_CDR
agccugaucgaggaaucccagaaccaacaggagaagaaugaacaggagcuccuggaacuu

SEQ ID NO: 44612 - RNA, 60 nt, Artificial Sequence; identical to SEQ ID NO: 29328
  derived and/or modified sequence opt5 from anti-HIV_CDR

SEQ ID NO: 44613 - RNA, 60 nt, Artificial Sequence
  derived and/or modified sequence opt5 from anti-HIV_CDR
gacaccaacggcacagagaucuucagacccgggggaggcgauaugcgggacaauuggcgc

SEQ ID NO: 44614 - RNA, 60 nt, Artificial Sequence
  derived and/or modified sequence opt5 from anti-HIV_CDR
gacguggucgagagacccggcuucggggauuuucgguacgacuauuacggaauggauguu

SEQ ID NO: 44615 - RNA, 60 nt, Artificial Sequence
  derived and/or modified sequence opt5 from anti-HIV_CDR
gaccagagagauugcagcaccaaccgguguuucggcguguuuggguacuauauggacguc

SEQ ID NO: 44616 - RNA, 60 nt, Artificial Sequence
  derived and/or modified sequence opt5 from anti-HIV_CDR
gacagaugggugcggccccaguucccuagcauggauuuucaauacaacggccuggacguc

SEQ ID NO: 44617 - RNA, 60 nt, Artificial Sequence; identical to SEQ ID NO: 29333
  derived and/or modified sequence opt5 from anti-HIV_CDR

SEQ ID NO: 44618 - RNA, 60 nt, Artificial Sequence; identical to SEQ ID NO: 29334
  derived and/or modified sequence opt5 from anti-HIV_CDR

SEQ ID NO: 44619 - RNA, 60 nt, Artificial Sequence; identical to SEQ ID NO: 29335
  derived and/or modified sequence opt5 from anti-HIV_CDR

SEQ ID NO: 44620 - RNA, 60 nt, Artificial Sequence; identical to SEQ ID NO: 29336
  derived and/or modified sequence opt5 from anti-HIV_CDR

SEQ ID NO: 44621 - RNA, 60 nt, Artificial Sequence
  derived and/or modified sequence opt5 from anti-HIV_CDR
gagagaagcaccaaguacuccuucuggucugccgugaugcggcccgacgcuuuugaucug

SEQ ID NO: 44622 - RNA, 60 nt, Artificial Sequence
  derived and/or modified sequence opt5 from anti-HIV_CDR
cacgaggcccccagauacagcuaugcuuuccggaacuacuaucauuacggccuggacgug

SEQ ID NO: 44623 - RNA, 60 nt, Artificial Sequence; identical to SEQ ID NO: 29339
  derived and/or modified sequence opt5 from anti-HIV_CDR

SEQ ID NO: 44624 - RNA, 60 nt, Artificial Sequence; identical to SEQ ID NO: 29340
  derived and/or modified sequence opt5 from anti-HIV_CDR

SEQ ID NO: 44625 - RNA, 60 nt, Artificial Sequence; identical to SEQ ID NO: 29341
  derived and/or modified sequence opt5 from anti-HIV_CDR

SEQ ID NO: 44626 - RNA, 63 nt, Artificial Sequence
  derived and/or modified sequence opt5 from anti-HIV_CDR
gacagaagcuccgccaucggcuacugcucuagcauuuccuguuauaaggggucuuucgauauc

SEQ ID NO: 44627 - RNA, 63 nt, Artificial Sequence
  derived and/or modified sequence opt5 from anti-HIV_CDR
guggucaagaucgagccccugggcguugccccuaccaaagcuaagagaguggcccgggaaaaa

SEQ ID NO: 44628 - RNA, 63 nt, Artificial Sequence
  derived and/or modified sequence opt5 from anti-HIV_CDR
guggucagaaucgagccccugggcguugccccuaccaaggcuaaacggguggaacgcgagaag

SEQ ID NO: 44629 - RNA, 63 nt, Artificial Sequence
  derived and/or modified sequence opt5 from anti-HIV_CDR
guggucagaaucgagccccugggcauugccccuacccgggcuaagcgcguugaaagagagaaa

SEQ ID NO: 44630 - RNA, 63 nt, Artificial Sequence
  derived and/or modified sequence opt5 from anti-HIV_CDR
guggucaagaucgagcccauuggcguugccccuaccaaagcuagacggguggaacgcgagaag

SEQ ID NO: 44631 - RNA, 63 nt, Artificial Sequence
  derived and/or modified sequence opt5 from anti-HIV_CDR
guggucaagaucgagccccugggcguugccccuaccagagcuaaacggguggaacgcgagaag

SEQ ID NO: 44632 - RNA, 63 nt, Artificial Sequence
  derived and/or modified sequence opt5 from anti-HIV_CDR
gugguccagaucgagccccugggcguugccccuaccagagcuaagcggguggaacgcgagaaa

SEQ ID NO: 44633 - RNA, 63 nt, Artificial Sequence
  derived and/or modified sequence opt5 from anti-HIV_CDR
guggucagaaucgagccccugggcguugccccuaccaaggcuaaacgggugcagcgcgaaaag

SEQ ID NO: 44634 - RNA, 63 nt, Artificial Sequence
  derived and/or modified sequence opt5 from anti-HIV_CDR
guggucaagaucgagccccugggcguugccccuaccaaagcuaagagagugcagcggaaaaag

SEQ ID NO: 44635 - RNA, 63 nt, Artificial Sequence
  derived and/or modified sequence opt5 from anti-HIV_CDR
gugaucaagauugagccccugaucgucgccccuaccaaagcuaagagaguucagcgggaaaaa

SEQ ID NO: 44636 - RNA, 63 nt, Artificial Sequence
  derived and/or modified sequence opt5 from anti-HIV_CDR
guggucaagaucgagccccugggcguugccccuaccaaagcuagacgggugcagcgcgaaaag

SEQ ID NO: 44637 - RNA, 63 nt, Artificial Sequence
  derived and/or modified sequence opt5 from anti-HIV_CDR
guggucaagaucgagcugcucggcguugcccccaccaaagcuaagagagugcagcgggaaaaa

SEQ ID NO: 44638 - RNA, 63 nt, Artificial Sequence
  derived and/or modified sequence opt5 from anti-HIV_CDR
guggucaccaucgagccccugggcguugccccuacaaaggcuaaaagagugcagcgggaaaag

SEQ ID NO: 44639 - RNA, 63 nt, Artificial Sequence
  derived and/or modified sequence opt5 from anti-HIV_CDR
guggucaagaucgagccccugggcguugccccuaccaaagcuaagagagugcagcgggaaaaa

SEQ ID NO: 44640 - RNA, 63 nt, Artificial Sequence
  derived and/or modified sequence opt5 from anti-HIV_CDR
gaccuggugagcgucuccccucccuacggcaacuaugggccggauaauaacugguucgacuuu

SEQ ID NO: 44641 - RNA, 63 nt, Artificial Sequence
  derived and/or modified sequence opt5 from anti-HIV_CDR
augaaucccccuugguucagaggcgggagcaacaacccguacuccuauuacuauauggacgug

SEQ ID NO: 44642 - RNA, 63 nt, Artificial Sequence; identical to SEQ ID NO: 29358
  derived and/or modified sequence opt5 from anti-HIV_CDR

SEQ ID NO: 44643 - RNA, 63 nt, Artificial Sequence; identical to SEQ ID NO: 29359
  derived and/or modified sequence opt5 from anti-HIV_CDR

SEQ ID NO: 44644 - RNA, 63 nt, Artificial Sequence
  derived and/or modified sequence opt5 from anti-HIV_CDR
gacuucgugagcaucuacggcgucgccuauuuuaccgggggaggccccuccucuccugauauu

SEQ ID NO: 44645 - RNA, 66 nt, Artificial Sequence; identical to SEQ ID NO: 29361
  derived and/or modified sequence opt5 from anti-HIV_CDR

SEQ ID NO: 44646 - RNA, 66 nt, Artificial Sequence; identical to SEQ ID NO: 29362
  derived and/or modified sequence opt5 from anti-HIV_CDR

SEQ ID NO: 44647 - RNA, 66 nt, Artificial Sequence; identical to SEQ ID NO: 29363
  derived and/or modified sequence opt5 from anti-HIV_CDR

SEQ ID NO: 44648 - RNA, 66 nt, Artificial Sequence
  derived and/or modified sequence opt5 from anti-HIV_CDR
gacgaggccagcuggguggaagcugccgaugagugggacgaacaccuguucagagagauggcgguc

SEQ ID NO: 44649 - RNA, 66 nt, Artificial Sequence
  derived and/or modified sequence opt5 from anti-HIV_CDR
gacgaggugagcugggucgaagccgcugaugagugggacgaacaccuguucagagagauggccguu

SEQ ID NO: 44650 - RNA, 66 nt, Artificial Sequence
  derived and/or modified sequence opt5 from anti-HIV_CDR
gacgagggcagcuggguggaagccgcugaugagugggacgaacaccuguucagagagauggccguc

SEQ ID NO: 44651 - RNA, 66 nt, Artificial Sequence
  derived and/or modified sequence opt5 from anti-HIV_CDR
gaccagagaggccgguacagcuucggguuugugaccggacaaacaaaggucuccgccaucucugau

SEQ ID NO: 44652 - RNA, 66 nt, Artificial Sequence; identical to SEQ ID NO: 29368
  derived and/or modified sequence opt5 from anti-HIV_CDR

SEQ ID NO: 44653 - RNA, 66 nt, Artificial Sequence
  derived and/or modified sequence opt5 from anti-HIV_CDR
gaccaggugggcagauacagcuucggguuugccaccggacaacagcgggucuccgcuaucucugau

SEQ ID NO: 44654 - RNA, 69 nt, Artificial Sequence
  derived and/or modified sequence opt5 from anti-HIV_CDR
guggucaagaucgagccccugggcguugccccuaccaaagcuaagagacggguggugcagcgcgaaaaa

SEQ ID NO: 44655 - RNA, 69 nt, Artificial Sequence
  derived and/or modified sequence opt5 from anti-HIV_CDR
agaaucagcuccucuagcugguacaugguggacaacucccacacccugcauuucuauuacauggauguc

SEQ ID NO: 44656 - RNA, 69 nt, Artificial Sequence
  derived and/or modified sequence opt5 from anti-HIV_CDR
gacaagcccgccuacgaugaguaugcugaagagaccaucgccccucacaacuaccaugcgauggaccug

SEQ ID NO: 44657 - RNA, 69 nt, Artificial Sequence
  derived and/or modified sequence opt5 from anti-HIV_CDR
cagaacaucgccgcuagagccgcggagaagcuguacgaaaaugacuauuacuucuauggcauggaugug

SEQ ID NO: 44658 - RNA, 69 nt, Artificial Sequence
  derived and/or modified sequence opt5 from anti-HIV_CDR
cagaacaucgccgcuagaaccgccgagcggcuguacgaaaaugacuauuacuucuauggcauggaugug

SEQ ID NO: 44659 - RNA, 72 nt, Artificial Sequence; identical to SEQ ID NO: 29375
  derived and/or modified sequence opt5 from anti-HIV_CDR

SEQ ID NO: 44660 - RNA, 72 nt, Artificial Sequence; identical to SEQ ID NO: 29376
  derived and/or modified sequence opt5 from anti-HIV_CDR

SEQ ID NO: 44661 - RNA, 72 nt, Artificial Sequence
  derived and/or modified sequence opt5 from anti-HIV_CDR
gccagacggggccagcgcaucuacgggguggucagcuucggagaguuuuucuauuacuauuccauggacguu

SEQ ID NO: 44662 - RNA, 72 nt, Artificial Sequence
  derived and/or modified sequence opt5 from anti-HIV_CDR
acccugcacggcagacggaucuacgggauuguggccuucaacgagugguuuacauauuucuacauggacguc

SEQ ID NO: 44663 - RNA, 72 nt, Artificial Sequence
  derived and/or modified sequence opt5 from anti-HIV_CDR
accaagcacggcagacggaucuacgggauuguggccuucaacgagugguuuacauauuucuacauggacguc

SEQ ID NO: 44664 - RNA, 72 nt, Artificial Sequence
  derived and/or modified sequence opt5 from anti-HIV_CDR
gccagacacggccagcggaucuacgggguggucagcuucggagaguuuuucaccuauuacuccauggacguu

SEQ ID NO: 44665 - RNA, 72 nt, Artificial Sequence; identical to SEQ ID NO: 29381
  derived and/or modified sequence opt5 from anti-HIV_CDR

SEQ ID NO: 44666 - RNA, 72 nt, Artificial Sequence
  derived and/or modified sequence opt5 from anti-HIV_CDR
accaagcacggcagacggaucuacgggguggucgccuucggagagugguuuacauauuucuacauggacguu

SEQ ID NO: 44667 - RNA, 72 nt, Artificial Sequence; identical to SEQ ID NO: 29383
  derived and/or modified sequence opt5 from anti-HIV_CDR

SEQ ID NO: 44668 - RNA, 72 nt, Artificial Sequence
  derived and/or modified sequence opt5 from anti-HIV_CDR
gacagaggcgauacccggcugcucgacuacggggauuaugaggacgaacgcuacuauuacggaauggaugug

SEQ ID NO: 44669 - RNA, 72 nt, Artificial Sequence
  derived and/or modified sequence opt5 from anti-HIV_CDR
ggcaccagauacgacuucuggagcggguuuuccaaccgggauggacgcgcccuggcuggcuauuucgacuac

SEQ ID NO: 44670 - RNA, 72 nt, Artificial Sequence
  derived and/or modified sequence opt5 from anti-HIV_CDR
gacggcaaggggaaagccuacuaugauuucuggagcggauacagaaaccagaaguauuacggccuggacgug

SEQ ID NO: 44671 - RNA, 72 nt, Artificial Sequence; identical to SEQ ID NO: 29387
  derived and/or modified sequence opt5 from anti-HIV_CDR

SEQ ID NO: 44672 - RNA, 72 nt, Artificial Sequence; identical to SEQ ID NO: 29388
  derived and/or modified sequence opt5 from anti-HIV_CDR

SEQ ID NO: 44673 - RNA, 81 nt, Artificial Sequence
  derived and/or modified sequence opt5 from anti-HIV_CDR
gacuuccccagauuucaccggcuggugggcaacuacgauuucuggcgcgggacccucgacagauuuagcuauauggaucug

SEQ ID NO: 44674 - RNA, 105 nt, Artificial Sequence
  derived and/or modified sequence opt5 from anti-HIV_CDR
agaauccuggccguggagcgguaccucaaggaccagcaacugcuuggcauuugggggugcagcggaaaaaucauuugucccaccauggucccuuggaacuccucu

SEQ ID NO: 44675 - RNA, 105 nt, Artificial Sequence
  derived and/or modified sequence opt5 from anti-HIV_CDR
agagugcuggccgucgagcgguaccuccaggaccaacgccugcuuggcaugugggggugcagcggaaagcacaucuguaccacauucguucccuggaacuccucu

SEQ ID NO: 44676 - RNA, 105 nt, Artificial Sequence
  derived and/or modified sequence opt5 from anti-HIV_CDR
agagugcuggccgucgagagcuaccucaaggaccagcaacugcuuggcaucugggggugcuccggaaaacacauuuguaccacaacgguucccuggaacucuagc

SEQ ID NO: 44677 - RNA, 105 nt, Artificial Sequence
  derived and/or modified sequence opt5 from anti-HIV_CDR
agagugcuggccgucgagcgguaccuccgcgaccagcaacugcuuggcaucugggggugcagcggaagacacauuuguaccacaaauguucccuggaacuccucu

SEQ ID NO: 44678 - RNA, 105 nt, Artificial Sequence
  derived and/or modified sequence opt5 from anti-HIV_CDR
agaauccuggccguggagcgguaccucaaggaccagcaacugcuuggcauuugggggugcagcggaaaacugaucuguaccacaacgguccccuggaacuccucu

SEQ ID NO: 44679 - RNA, 105 nt, Artificial Sequence
  derived and/or modified sequence opt5 from anti-HIV_CDR
agaauccuggccguggagcgguaccucaaggaccagcaacugcuuggcauuugggggugcagcggaaaacacaucuguaccacaaauguccccuggaacuccucu

SEQ ID NO: 44680 - RNA, 105 nt, Artificial Sequence
  derived and/or modified sequence opt5 from anti-HIV_CDR
agagugcuggccgucgagcgguaccuccgcgaccagcaacugcuuggcaucugggggugcagcggaaagcugauuuguaccacaacgguucccuggaacgcuucc

SEQ ID NO: 44681 - RNA, 105 nt, Artificial Sequence
  derived and/or modified sequence opt5 from anti-HIV_CDR
agagugcuggccgucgagcgguaccuccgcgaccagcaacugcuuggcaucugggggugcagcggaaagcugauuuguaccacagcuguucccuggaacgccucc

SEQ ID NO: 44682 - RNA, 105 nt, Artificial Sequence
  derived and/or modified sequence opt5 from anti-HIV_CDR
agagugcuggccgucgagcgguaccucaaggaccagcaacugcuuggcaucugggggugcagcggaaaacugauuuguaccacaacgguucccuggaacgcuucc

SEQ ID NO: 44683 - RNA, 105 nt, Artificial Sequence
  derived and/or modified sequence opt5 from anti-HIV_CDR
agaauccuggccguggagcgguaccucaaggaccagcaacugcuuggcuucugggggugcagcggaaaacugauuuguaccacagcuguccccuggaacgccucc

SEQ ID NO: 44684 - RNA, 105 nt, Artificial Sequence
  derived and/or modified sequence opt5 from anti-HIV_CDR
agagugcuggccgucgagcgguaccuccgcgaccagcaacugcuuggcaucugggggugcagcggaaagcugauuuguaccacaacgguucccuggaacaccucc

SEQ ID NO: 44685 - RNA, 105 nt, Artificial Sequence
  derived and/or modified sequence opt5 from anti-HIV_CDR
agagugcuggccgucgagcgguaccucaaggaccagcaacugcuuggcaucugggggugcagcggaaaacugauuuguaccacagcuguucccuggaacgccucc

SEQ ID NO: 44686 - RNA, 105 nt, Artificial Sequence
  derived and/or modified sequence opt5 from anti-HIV_CDR
agagugcuggccgucgagcgguaccucaaggaccagcaacugcuuggcuucugggggugcagcggaaaacugaucuguaccacaacgguucccuggaacgcuucc

SEQ ID NO: 44687 - RNA, 105 nt, Artificial Sequence
  derived and/or modified sequence opt5 from anti-HIV_CDR
agaauccuggccguggagcgguaccucaaggaccagcaacugcuuggcauuugggggugcagcggaaaacugaucuguaccacagcuguccccuggaacgccucc

SEQ ID NO: 44688-44713 - skipped (26 entries)

SEQ ID NO: 44714 - RNA, 12 nt, Artificial Sequence
  derived and/or modified sequence opt5 from anti-influenza_CDR
gacgugcccgau

SEQ ID NO: 44715 - RNA, 12 nt, Artificial Sequence
  derived and/or modified sequence opt5 from anti-influenza_CDR
agacugagcggc

SEQ ID NO: 44716 - RNA, 12 nt, Artificial Sequence
  derived and/or modified sequence opt5 from anti-influenza_CDR
uucugggaccug

SEQ ID NO: 44717 - RNA, 15 nt, Artificial Sequence
  derived and/or modified sequence opt5 from anti-influenza_CDR
accggccugagaaac

SEQ ID NO: 44718 - RNA, 15 nt, Artificial Sequence
  derived and/or modified sequence opt5 from anti-influenza_CDR
cagcaaagcagaacc

SEQ ID NO: 44719 - RNA, 15 nt, Artificial Sequence
  derived and/or modified sequence opt5 from anti-influenza_CDR
cagcugagcagaacc

SEQ ID NO: 44720 - RNA, 15 nt, Artificial Sequence
  derived and/or modified sequence opt5 from anti-influenza_CDR
agcaacuacaucacc

SEQ ID NO: 44721 - RNA, 15 nt, Artificial Sequence
  derived and/or modified sequence opt5 from anti-influenza_CDR
gacuacagcuggaac

SEQ ID NO: 44722 - RNA, 15 nt, Artificial Sequence
  derived and/or modified sequence opt5 from anti-influenza_CDR
aacuacgccuucagc

SEQ ID NO: 44723 - RNA, 15 nt, Artificial Sequence
  derived and/or modified sequence opt5 from anti-influenza_CDR
aagaacgccaucagc

SEQ ID NO: 44724 - RNA, 15 nt, Artificial Sequence
  derived and/or modified sequence opt5 from anti-influenza_CDR
agccacuggaugacc

SEQ ID NO: 44725 - RNA, 15 nt, Artificial Sequence
  derived and/or modified sequence opt5 from anti-influenza_CDR
aacuacgacaucaau

SEQ ID NO: 44726 - RNA, 15 nt, Artificial Sequence
  derived and/or modified sequence opt5 from anti-influenza_CDR
gacuacggcgugacc

SEQ ID NO: 44727 - RNA, 15 nt, Artificial Sequence
  derived and/or modified sequence opt5 from anti-influenza_CDR
aacuacggcaucaau

SEQ ID NO: 44728 - RNA, 15 nt, Artificial Sequence
  derived and/or modified sequence opt5 from anti-influenza_CDR
ggcuacaccaucaca

SEQ ID NO: 44729 - RNA, 15 nt, Artificial Sequence
  derived and/or modified sequence opt5 from anti-influenza_CDR
aacuacggcaucagc

SEQ ID NO: 44730 - RNA, 15 nt, Artificial Sequence
  derived and/or modified sequence opt5 from anti-influenza_CDR
gacgauuacuggacc

SEQ ID NO: 44731 - RNA, 15 nt, Artificial Sequence
  derived and/or modified sequence opt5 from anti-influenza_CDR
accuacgccaugcac

SEQ ID NO: 44732 - RNA, 15 nt, Artificial Sequence
  derived and/or modified sequence opt5 from anti-influenza_CDR
agcuacgccaugcac

SEQ ID NO: 44733 - RNA, 15 nt, Artificial Sequence
  derived and/or modified sequence opt5 from anti-influenza_CDR
agcuacuauuggaac

SEQ ID NO: 44734 - RNA, 15 nt, Artificial Sequence
  derived and/or modified sequence opt5 from anti-influenza_CDR
accuaccccguggcc

SEQ ID NO: 44735 - RNA, 15 nt, Artificial Sequence
  derived and/or modified sequence opt5 from anti-influenza_CDR
cacuacuucuggagc

SEQ ID NO: 44736 - RNA, 15 nt, Artificial Sequence
  derived and/or modified sequence opt5 from anti-influenza_CDR
gacuacuauuggacc

SEQ ID NO: 44737 - RNA, 15 nt, Artificial Sequence
  derived and/or modified sequence opt5 from anti-influenza_CDR
gacuacuauuggagc

SEQ ID NO: 44738 - RNA, 15 nt, Artificial Sequence
  derived and/or modified sequence opt5 from anti-influenza_CDR
ggcuacuauaugcac

SEQ ID NO: 44739 - RNA, 15 nt, Artificial Sequence
  derived and/or modified sequence opt5 from anti-influenza_CDR
agccacuacuggucc

SEQ ID NO: 44740 - RNA, 15 nt, Artificial Sequence
  derived and/or modified sequence opt5 from anti-influenza_CDR
aacuacuggaucggc

SEQ ID NO: 44741 - RNA, 15 nt, Artificial Sequence
  derived and/or modified sequence opt5 from anti-influenza_CDR
aacuacgccaucauu

SEQ ID NO: 44742 - RNA, 15 nt, Artificial Sequence
  derived and/or modified sequence opt5 from anti-influenza_CDR
gacuacuauauccac

SEQ ID NO: 44743 - RNA, 15 nt, Artificial Sequence
  derived and/or modified sequence opt5 from anti-influenza_CDR
ggcuacgacaugcac

SEQ ID NO: 44744 - RNA, 15 nt, Artificial Sequence
  derived and/or modified sequence opt5 from anti-influenza_CDR
ggcuacuauauccac

SEQ ID NO: 44745 - RNA, 15 nt, Artificial Sequence
  derived and/or modified sequence opt5 from anti-influenza_CDR
ggcuacuaugugcac

SEQ ID NO: 44746 - RNA, 15 nt, Artificial Sequence
  derived and/or modified sequence opt5 from anti-influenza_CDR
aacuacuggaugagc

SEQ ID NO: 44747 - RNA, 15 nt, Artificial Sequence
  derived and/or modified sequence opt5 from anti-influenza_CDR
ggcgagagcacccug

SEQ ID NO: 44748 - RNA, 15 nt, Artificial Sequence
  derived and/or modified sequence opt5 from anti-influenza_CDR
aacuacuauuggagc

SEQ ID NO: 44749 - RNA, 15 nt, Artificial Sequence
  derived and/or modified sequence opt5 from anti-influenza_CDR
agcaacuacaugucc

SEQ ID NO: 44750 - RNA, 15 nt, Artificial Sequence
  derived and/or modified sequence opt5 from anti-influenza_CDR
agcgacuacuggucc

SEQ ID NO: 44751 - RNA, 15 nt, Artificial Sequence
  derived and/or modified sequence opt5 from anti-influenza_CDR
agcuacaacuggauc

SEQ ID NO: 44752 - RNA, 15 nt, Artificial Sequence
  derived and/or modified sequence opt5 from anti-influenza_CDR
agcaccuacaugaac

SEQ ID NO: 44753 - RNA, 15 nt, Artificial Sequence
  derived and/or modified sequence opt5 from anti-influenza_CDR
aacuacgccaugagc

SEQ ID NO: 44754 - RNA, 15 nt, Artificial Sequence
  derived and/or modified sequence opt5 from anti-influenza_CDR
agcgacuucuggucc

SEQ ID NO: 44755 - RNA, 15 nt, Artificial Sequence
  derived and/or modified sequence opt5 from anti-influenza_CDR
uacuaugccaugagc

SEQ ID NO: 44756 - RNA, 15 nt, Artificial Sequence
  derived and/or modified sequence opt5 from anti-influenza_CDR
ggcuacuauguguac

SEQ ID NO: 44757 - RNA, 15 nt, Artificial Sequence
  derived and/or modified sequence opt5 from anti-influenza_CDR
agcuacgccaucucc

SEQ ID NO: 44758 - RNA, 15 nt, Artificial Sequence
  derived and/or modified sequence opt5 from anti-influenza_CDR
agcuacuccuggucu

SEQ ID NO: 44759 - RNA, 15 nt, Artificial Sequence
  derived and/or modified sequence opt5 from anti-influenza_CDR
aacagcuucuggggc

SEQ ID NO: 44760 - RNA, 15 nt, Artificial Sequence
  derived and/or modified sequence opt5 from anti-influenza_CDR
gccuaccacuggagc

SEQ ID NO: 44761 - RNA, 15 nt, Artificial Sequence
  derived and/or modified sequence opt5 from anti-influenza_CDR
gacaacuacaucaau

SEQ ID NO: 44762 - RNA, 15 nt, Artificial Sequence
  derived and/or modified sequence opt5 from anti-influenza_CDR
agcggcuucuccgug

SEQ ID NO: 44763 - RNA, 15 nt, Artificial Sequence
  derived and/or modified sequence opt5 from anti-influenza_CDR
gccuacgcuuucacc

SEQ ID NO: 44764 - RNA, 15 nt, Artificial Sequence
  derived and/or modified sequence opt5 from anti-influenza_CDR
ggcagcgccaucucc

SEQ ID NO: 44765 - RNA, 15 nt, Artificial Sequence
  derived and/or modified sequence opt5 from anti-influenza_CDR
agcuacgccaucacc

SEQ ID NO: 44766 - RNA, 15 nt, Artificial Sequence
  derived and/or modified sequence opt5 from anti-influenza_CDR
agcuacuauaugcac

SEQ ID NO: 44767 - RNA, 15 nt, Artificial Sequence
  derived and/or modified sequence opt5 from anti-influenza_CDR
aucuacgccaugagc

SEQ ID NO: 44768 - RNA, 15 nt, Artificial Sequence
  derived and/or modified sequence opt5 from anti-influenza_CDR
agcuacuccaugaac

SEQ ID NO: 44769 - RNA, 15 nt, Artificial Sequence
  derived and/or modified sequence opt5 from anti-influenza_CDR
agcuacggcaucucc

SEQ ID NO: 44770 - RNA, 15 nt, Artificial Sequence
  derived and/or modified sequence opt5 from anti-influenza_CDR
uucuacagcaugucc

SEQ ID NO: 44771 - RNA, 15 nt, Artificial Sequence
  derived and/or modified sequence opt5 from anti-influenza_CDR
acccacgccaucagc

SEQ ID NO: 44772 - RNA, 15 nt, Artificial Sequence
  derived and/or modified sequence opt5 from anti-influenza_CDR
ggcuacgccaucagc

SEQ ID NO: 44773 - RNA, 15 nt, Artificial Sequence
  derived and/or modified sequence opt5 from anti-influenza_CDR
agcaacuccaucucu

SEQ ID NO: 44774 - RNA, 15 nt, Artificial Sequence
  derived and/or modified sequence opt5 from anti-influenza_CDR
aacuucgccaucaau

SEQ ID NO: 44775 - RNA, 15 nt, Artificial Sequence
  derived and/or modified sequence opt5 from anti-influenza_CDR
agcaacgccgugucc

SEQ ID NO: 44776 - RNA, 15 nt, Artificial Sequence
  derived and/or modified sequence opt5 from anti-influenza_CDR
gacaacgccaucagc

SEQ ID NO: 44777 - RNA, 15 nt, Artificial Sequence
  derived and/or modified sequence opt5 from anti-influenza_CDR
uucagcgagguggaa

SEQ ID NO: 44778 - RNA, 15 nt, Artificial Sequence
  derived and/or modified sequence opt5 from anti-influenza_CDR
gcccaccauaugcac

SEQ ID NO: 44779 - RNA, 15 nt, Artificial Sequence
  derived and/or modified sequence opt5 from anti-influenza_CDR
agccaguggaucggc

SEQ ID NO: 44780 - RNA, 15 nt, Artificial Sequence
  derived and/or modified sequence opt5 from anti-influenza_CDR
gacuacgccaugaac

SEQ ID NO: 44781 - RNA, 15 nt, Artificial Sequence
  derived and/or modified sequence opt5 from anti-influenza_CDR
aacgccuggaugagc

SEQ ID NO: 44782 - RNA, 15 nt, Artificial Sequence
  derived and/or modified sequence opt5 from anti-influenza_CDR
gacuacgccaucaac

SEQ ID NO: 44783 - RNA, 15 nt, Artificial Sequence
  derived and/or modified sequence opt5 from anti-influenza_CDR
agacacggcaucagc

SEQ ID NO: 44784 - RNA, 15 nt, Artificial Sequence
  derived and/or modified sequence opt5 from anti-influenza_CDR
gagcugagcauccac

SEQ ID NO: 44785 - RNA, 15 nt, Artificial Sequence
  derived and/or modified sequence opt5 from anti-influenza_CDR
agcuccaacuacuau

SEQ ID NO: 44786 - RNA, 15 nt, Artificial Sequence
  derived and/or modified sequence opt5 from anti-influenza_CDR
accuacgccaugagc

SEQ ID NO: 44787 - RNA, 15 nt, Artificial Sequence
  derived and/or modified sequence opt5 from anti-influenza_CDR
aacuacgccaucagc

SEQ ID NO: 44788 - RNA, 18 nt, Artificial Sequence
  derived and/or modified sequence opt5 from anti-influenza_CDR
uucggcgccaucgcuggg

SEQ ID NO: 44789 - RNA, 18 nt, Artificial Sequence
  derived and/or modified sequence opt5 from anti-influenza_CDR
caggacaucagcagauac

SEQ ID NO: 44790 - RNA, 18 nt, Artificial Sequence
  derived and/or modified sequence opt5 from anti-influenza_CDR
cagaacaucggccccugg

SEQ ID NO: 44791 - RNA, 18 nt, Artificial Sequence
  derived and/or modified sequence opt5 from anti-influenza_CDR
cagagcgugaacagacgg

SEQ ID NO: 44792 - RNA, 18 nt, Artificial Sequence
  derived and/or modified sequence opt5 from anti-influenza_CDR
cagagcaucuccaccuac

SEQ ID NO: 44793 - RNA, 18 nt, Artificial Sequence
  derived and/or modified sequence opt5 from anti-influenza_CDR
cagggcaucauuaccuac

SEQ ID NO: 44794 - RNA, 18 nt, Artificial Sequence
  derived and/or modified sequence opt5 from anti-influenza_CDR
cagggcaucagcuccuac

SEQ ID NO: 44795 - RNA, 18 nt, Artificial Sequence
  derived and/or modified sequence opt5 from anti-influenza_CDR
caggacgugagcaccugg

SEQ ID NO: 44796 - RNA, 18 nt, Artificial Sequence
  derived and/or modified sequence opt5 from anti-influenza_CDR
caggacaucuacauuuau

SEQ ID NO: 44797 - RNA, 18 nt, Artificial Sequence
  derived and/or modified sequence opt5 from anti-influenza_CDR
gagaacaucuggaauaac

SEQ ID NO: 44798 - RNA, 18 nt, Artificial Sequence
  derived and/or modified sequence opt5 from anti-influenza_CDR
ggcuucaccgugacaagc

SEQ ID NO: 44799 - RNA, 18 nt, Artificial Sequence
  derived and/or modified sequence opt5 from anti-influenza_CDR
caggacaucagcggccac

SEQ ID NO: 44800 - RNA, 18 nt, Artificial Sequence
  derived and/or modified sequence opt5 from anti-influenza_CDR
agccugcucaccgaggug

SEQ ID NO: 44801 - RNA, 18 nt, Artificial Sequence
  derived and/or modified sequence opt5 from anti-influenza_CDR
ggcagcuccaucucuaac

SEQ ID NO: 44802 - RNA, 18 nt, Artificial Sequence
  derived and/or modified sequence opt5 from anti-influenza_CDR
ggcgggagcaucaccucc

SEQ ID NO: 44803 - RNA, 18 nt, Artificial Sequence
  derived and/or modified sequence opt5 from anti-influenza_CDR
ggcgggagcaucuccucu

SEQ ID NO: 44804 - RNA, 18 nt, Artificial Sequence
  derived and/or modified sequence opt5 from anti-influenza_CDR
ggccugagcguguccucu

SEQ ID NO: 44805 - RNA, 18 nt, Artificial Sequence
  derived and/or modified sequence opt5 from anti-influenza_CDR
ggcgccagcaucuccucu

SEQ ID NO: 44806 - RNA, 18 nt, Artificial Sequence
  derived and/or modified sequence opt5 from anti-influenza_CDR
ggcgacagcaucuccucu

SEQ ID NO: 44807 - RNA, 18 nt, Artificial Sequence
  derived and/or modified sequence opt5 from anti-influenza_CDR
ggcgggagcaucuccaac

SEQ ID NO: 44808 - RNA, 18 nt, Artificial Sequence
  derived and/or modified sequence opt5 from anti-influenza_CDR
ggcgggagcaucuccgcc

SEQ ID NO: 44809 - RNA, 18 nt, Artificial Sequence
  derived and/or modified sequence opt5 from anti-influenza_CDR
ggcuucagcguguccgac

SEQ ID NO: 44810 - RNA, 18 nt, Artificial Sequence
  derived and/or modified sequence opt5 from anti-influenza_CDR
agcagaucccuggacgug

SEQ ID NO: 44811 - RNA, 18 nt, Artificial Sequence
  derived and/or modified sequence opt5 from anti-influenza_CDR
agaagccagcaaaccgug

SEQ ID NO: 44812 - RNA, 18 nt, Artificial Sequence
  derived and/or modified sequence opt5 from anti-influenza_CDR
cagaccaucaacaauuac

SEQ ID NO: 44813 - RNA, 18 nt, Artificial Sequence
  derived and/or modified sequence opt5 from anti-influenza_CDR
aacaugggccccaccagc

SEQ ID NO: 44814 - RNA, 18 nt, Artificial Sequence
  derived and/or modified sequence opt5 from anti-influenza_CDR
cagguggucggcaccaac

SEQ ID NO: 44815 - RNA, 18 nt, Artificial Sequence
  derived and/or modified sequence opt5 from anti-influenza_CDR
cagggcaucaacacccac

SEQ ID NO: 44816 - RNA, 18 nt, Artificial Sequence
  derived and/or modified sequence opt5 from anti-influenza_CDR
caggacaucagaaaccgg

SEQ ID NO: 44817 - RNA, 18 nt, Artificial Sequence
  derived and/or modified sequence opt5 from anti-influenza_CDR
cagggcaucgggagcaac

SEQ ID NO: 44818 - RNA, 18 nt, Artificial Sequence
  derived and/or modified sequence opt5 from anti-influenza_CDR
cagaccaucuacagaugg

SEQ ID NO: 44819 - RNA, 18 nt, Artificial Sequence
  derived and/or modified sequence opt5 from anti-influenza_CDR
cagaccaucacaagauuc

SEQ ID NO: 44820 - RNA, 18 nt, Artificial Sequence
  derived and/or modified sequence opt5 from anti-influenza_CDR
agacugggcgagaaguuc

SEQ ID NO: 44821 - RNA, 18 nt, Artificial Sequence
  derived and/or modified sequence opt5 from anti-influenza_CDR
aagcugggcgacaaauuc

SEQ ID NO: 44822 - RNA, 18 nt, Artificial Sequence
  derived and/or modified sequence opt5 from anti-influenza_CDR
cagggccuggggagcaac

SEQ ID NO: 44823 - RNA, 18 nt, Artificial Sequence
  derived and/or modified sequence opt5 from anti-influenza_CDR
uacaucggcagcaagucc

SEQ ID NO: 44824 - RNA, 18 nt, Artificial Sequence
  derived and/or modified sequence opt5 from anti-influenza_CDR
cagcugaucagcuccuac

SEQ ID NO: 44825 - RNA, 18 nt, Artificial Sequence
  derived and/or modified sequence opt5 from anti-influenza_CDR
cagagcguguccucuaac

SEQ ID NO: 44826 - RNA, 18 nt, Artificial Sequence
  derived and/or modified sequence opt5 from anti-influenza_CDR
caggugaucagcuccuac

SEQ ID NO: 44827 - RNA, 18 nt, Artificial Sequence
  derived and/or modified sequence opt5 from anti-influenza_CDR
cagagcgugaacagaaau

SEQ ID NO: 44828 - RNA, 18 nt, Artificial Sequence
  derived and/or modified sequence opt5 from anti-influenza_CDR
gacaucggcagcaagucc

SEQ ID NO: 44829 - RNA, 18 nt, Artificial Sequence
  derived and/or modified sequence opt5 from anti-influenza_CDR
cagagcguguccaccaac

SEQ ID NO: 44830 - RNA, 18 nt, Artificial Sequence
  derived and/or modified sequence opt5 from anti-influenza_CDR
augaucgccggcuggcac

SEQ ID NO: 44831 - RNA, 18 nt, Artificial Sequence
  derived and/or modified sequence opt5 from anti-influenza_CDR
caggacaucagcaccugg

SEQ ID NO: 44832 - RNA, 18 nt, Artificial Sequence
  derived and/or modified sequence opt5 from anti-influenza_CDR
gagaagaucuacagcaac

SEQ ID NO: 44833 - RNA, 21 nt, Artificial Sequence
  derived and/or modified sequence opt5 from anti-influenza_CDR
aucuacuauaacuacaauauu

SEQ ID NO: 44834 - RNA, 21 nt, Artificial Sequence
  derived and/or modified sequence opt5 from anti-influenza_CDR
cagagcaucuccucuggcuac

SEQ ID NO: 44835 - RNA, 21 nt, Artificial Sequence
  derived and/or modified sequence opt5 from anti-influenza_CDR
cagagcguguccucuagcuac

SEQ ID NO: 44836 - RNA, 21 nt, Artificial Sequence
  derived and/or modified sequence opt5 from anti-influenza_CDR
cagaccgugagcuccucuuac

SEQ ID NO: 44837 - RNA, 21 nt, Artificial Sequence
  derived and/or modified sequence opt5 from anti-influenza_CDR
agcaacaaugccguguggaac

SEQ ID NO: 44838 - RNA, 21 nt, Artificial Sequence
  derived and/or modified sequence opt5 from anti-influenza_CDR
agcaacuccgccguguggaau

SEQ ID NO: 44839 - RNA, 21 nt, Artificial Sequence
  derived and/or modified sequence opt5 from anti-influenza_CDR
gccgcuaccacacugcagagc

SEQ ID NO: 44840 - RNA, 21 nt, Artificial Sequence
  derived and/or modified sequence opt5 from anti-influenza_CDR
agcaacagagccaccuggaau

SEQ ID NO: 44841 - RNA, 21 nt, Artificial Sequence
  derived and/or modified sequence opt5 from anti-influenza_CDR
gccaccagcacacugcagucc

SEQ ID NO: 44842 - RNA, 21 nt, Artificial Sequence
  derived and/or modified sequence opt5 from anti-influenza_CDR
agcaacuccgccaccuggaau

SEQ ID NO: 44843 - RNA, 21 nt, Artificial Sequence
  derived and/or modified sequence opt5 from anti-influenza_CDR
gccagcuccacccugcagucu

SEQ ID NO: 44844 - RNA, 21 nt, Artificial Sequence
  derived and/or modified sequence opt5 from anti-influenza_CDR
agcuacaacgccguguggaau

SEQ ID NO: 44845 - RNA, 21 nt, Artificial Sequence
  derived and/or modified sequence opt5 from anti-influenza_CDR
gccgcuagcuccagacugucu

SEQ ID NO: 44846 - RNA, 21 nt, Artificial Sequence
  derived and/or modified sequence opt5 from anti-influenza_CDR
gccgcuagcuccagaggcucu

SEQ ID NO: 44847 - RNA, 21 nt, Artificial Sequence
  derived and/or modified sequence opt5 from anti-influenza_CDR
aucuaccacagcggcuccgcc

SEQ ID NO: 44848 - RNA, 21 nt, Artificial Sequence
  derived and/or modified sequence opt5 from anti-influenza_CDR
aucuacuauagcggcgugacc

SEQ ID NO: 44849 - RNA, 21 nt, Artificial Sequence
  derived and/or modified sequence opt5 from anti-influenza_CDR
agcuccuaccuggccugguau

SEQ ID NO: 44850 - RNA, 21 nt, Artificial Sequence
  derived and/or modified sequence opt5 from anti-influenza_CDR
cagagccuguccucuagcucc

SEQ ID NO: 44851 - RNA, 21 nt, Artificial Sequence
  derived and/or modified sequence opt5 from anti-influenza_CDR
cagagcguguccaucucuuac

SEQ ID NO: 44852 - RNA, 21 nt, Artificial Sequence
  derived and/or modified sequence opt5 from anti-influenza_CDR
gacgugaccgagagacccagc

SEQ ID NO: 44853 - RNA, 21 nt, Artificial Sequence
  derived and/or modified sequence opt5 from anti-influenza_CDR
gccgcuagcacccugcucgac

SEQ ID NO: 44854 - RNA, 21 nt, Artificial Sequence
  derived and/or modified sequence opt5 from anti-influenza_CDR
gccgcuagcacccugcacucc

SEQ ID NO: 44855 - RNA, 21 nt, Artificial Sequence
  derived and/or modified sequence opt5 from anti-influenza_CDR
ggcgccagcucccugcagggg

SEQ ID NO: 44856 - RNA, 21 nt, Artificial Sequence
  derived and/or modified sequence opt5 from anti-influenza_CDR
accaacggcgugaaugucggg

SEQ ID NO: 44857 - RNA, 21 nt, Artificial Sequence
  derived and/or modified sequence opt5 from anti-influenza_CDR
gacgccagcaccagagcuaca

SEQ ID NO: 44858 - RNA, 21 nt, Artificial Sequence
  derived and/or modified sequence opt5 from anti-influenza_CDR
agcgagaccuacuauuggucc

SEQ ID NO: 44859 - RNA, 21 nt, Artificial Sequence
  derived and/or modified sequence opt5 from anti-influenza_CDR
gaggccgugaaccuggaaagc

SEQ ID NO: 44860 - RNA, 21 nt, Artificial Sequence
  derived and/or modified sequence opt5 from anti-influenza_CDR
ggcgccagcaccagagcuaca

SEQ ID NO: 44861 - RNA, 21 nt, Artificial Sequence
  derived and/or modified sequence opt5 from anti-influenza_CDR
gugagcggcuacuauuggucc

SEQ ID NO: 44862 - RNA, 21 nt, Artificial Sequence
  derived and/or modified sequence opt5 from anti-influenza_CDR
aucaccggcgugagagucggg

SEQ ID NO: 44863 - RNA, 21 nt, Artificial Sequence
  derived and/or modified sequence opt5 from anti-influenza_CDR
gacgccagcaacagagcuacc

SEQ ID NO: 44864 - RNA, 21 nt, Artificial Sequence
  derived and/or modified sequence opt5 from anti-influenza_CDR
gaggugaccaacuggcccagc

SEQ ID NO: 44865 - RNA, 21 nt, Artificial Sequence
  derived and/or modified sequence opt5 from anti-influenza_CDR
aaggacagcgagagacccucc

SEQ ID NO: 44866 - RNA, 21 nt, Artificial Sequence
  derived and/or modified sequence opt5 from anti-influenza_CDR
agcggcaacuacuauuggaau

SEQ ID NO: 44867 - RNA, 21 nt, Artificial Sequence
  derived and/or modified sequence opt5 from anti-influenza_CDR
agcaccacaaucagacacucc

SEQ ID NO: 44868 - RNA, 21 nt, Artificial Sequence
  derived and/or modified sequence opt5 from anti-influenza_CDR
gacgauagcggcagacccucc

SEQ ID NO: 44869 - RNA, 21 nt, Artificial Sequence
  derived and/or modified sequence opt5 from anti-influenza_CDR
agaaacgaccugcggcccagc

SEQ ID NO: 44870 - RNA, 21 nt, Artificial Sequence
  derived and/or modified sequence opt5 from anti-influenza_CDR
agcguggaccacuacuggucc

SEQ ID NO: 44871 - RNA, 21 nt, Artificial Sequence
  derived and/or modified sequence opt5 from anti-influenza_CDR
gccgugagcauccugcagucc

SEQ ID NO: 44872 - RNA, 21 nt, Artificial Sequence
  derived and/or modified sequence opt5 from anti-influenza_CDR
gacgauaccgacagacccagc

SEQ ID NO: 44873 - RNA, 21 nt, Artificial Sequence
  derived and/or modified sequence opt5 from anti-influenza_CDR
gagaacaauaagagacccagc

SEQ ID NO: 44874 - RNA, 21 nt, Artificial Sequence
  derived and/or modified sequence opt5 from anti-influenza_CDR
gacagcuccaacagagccccc

SEQ ID NO: 44875 - RNA, 21 nt, Artificial Sequence
  derived and/or modified sequence opt5 from anti-influenza_CDR
gaggugaccaagagacccagc

SEQ ID NO: 44876 - RNA, 21 nt, Artificial Sequence
  derived and/or modified sequence opt5 from anti-influenza_CDR
gccaccagcaacacacacucc

SEQ ID NO: 44877 - RNA, 21 nt, Artificial Sequence
  derived and/or modified sequence opt5 from anti-influenza_CDR
gccgcuagcaaccuggagaau

SEQ ID NO: 44878 - RNA, 21 nt, Artificial Sequence
  derived and/or modified sequence opt5 from anti-influenza_CDR
gccgcuagcggccugcagucc

SEQ ID NO: 44879 - RNA, 21 nt, Artificial Sequence
  derived and/or modified sequence opt5 from anti-influenza_CDR
ggcuucaccgugagcuccaac

SEQ ID NO: 44880 - RNA, 21 nt, Artificial Sequence
  derived and/or modified sequence opt5 from anti-influenza_CDR
ggcgggggauacagcuggaac

SEQ ID NO: 44881 - RNA, 21 nt, Artificial Sequence
  derived and/or modified sequence opt5 from anti-influenza_CDR
ggcgccagcaaccugcagucc

SEQ ID NO: 44882 - RNA, 21 nt, Artificial Sequence
  derived and/or modified sequence opt5 from anti-influenza_CDR
ggcgccaccaaccugcagagc

SEQ ID NO: 44883 - RNA, 21 nt, Artificial Sequence
  derived and/or modified sequence opt5 from anti-influenza_CDR
ggcgccagcaaccugcacucc

SEQ ID NO: 44884 - RNA, 21 nt, Artificial Sequence
  derived and/or modified sequence opt5 from anti-influenza_CDR
ggcgccagcacccugcagucc

SEQ ID NO: 44885 - RNA, 21 nt, Artificial Sequence
  derived and/or modified sequence opt5 from anti-influenza_CDR
gacaacagcgauagacccucc

SEQ ID NO: 44886 - RNA, 21 nt, Artificial Sequence
  derived and/or modified sequence opt5 from anti-influenza_CDR
ggcgccagcucccugcagucu

SEQ ID NO: 44887 - RNA, 21 nt, Artificial Sequence
  derived and/or modified sequence opt5 from anti-influenza_CDR
ggcaacagcaauagacccucc

SEQ ID NO: 44888 - RNA, 21 nt, Artificial Sequence
  derived and/or modified sequence opt5 from anti-influenza_CDR
gccgcuagcucccugcagucu

SEQ ID NO: 44889 - RNA, 21 nt, Artificial Sequence
  derived and/or modified sequence opt5 from anti-influenza_CDR
gccgcuagcucccugcacucu

SEQ ID NO: 44890 - RNA, 21 nt, Artificial Sequence
  derived and/or modified sequence opt5 from anti-influenza_CDR
ggcgccagcacccugcagaac

SEQ ID NO: 44891 - RNA, 21 nt, Artificial Sequence
  derived and/or modified sequence opt5 from anti-influenza_CDR
ggcgccaccgaccugcagagc

SEQ ID NO: 44892 - RNA, 21 nt, Artificial Sequence
  derived and/or modified sequence opt5 from anti-influenza_CDR
agcggcgccuacuauuggacc

SEQ ID NO: 44893 - RNA, 21 nt, Artificial Sequence
  derived and/or modified sequence opt5 from anti-influenza_CDR
gugagcgacaacuacaucaau

SEQ ID NO: 44894 - RNA, 21 nt, Artificial Sequence
  derived and/or modified sequence opt5 from anti-influenza_CDR
ugggccagcaccagagagucc

SEQ ID NO: 44895 - RNA, 21 nt, Artificial Sequence
  derived and/or modified sequence opt5 from anti-influenza_CDR
agcaacaaucagagacccucc

SEQ ID NO: 44896 - RNA, 21 nt, Artificial Sequence
  derived and/or modified sequence opt5 from anti-influenza_CDR
gaggugagcaacagacccucc

SEQ ID NO: 44897 - RNA, 21 nt, Artificial Sequence
  derived and/or modified sequence opt5 from anti-influenza_CDR
aagaacacccagagacccagc

SEQ ID NO: 44898 - RNA, 21 nt, Artificial Sequence
  derived and/or modified sequence opt5 from anti-influenza_CDR
gacaacaauaagagacccagc

SEQ ID NO: 44899 - RNA, 21 nt, Artificial Sequence
  derived and/or modified sequence opt5 from anti-influenza_CDR
gacgccagcacccugagaucc

SEQ ID NO: 44900 - RNA, 21 nt, Artificial Sequence
  derived and/or modified sequence opt5 from anti-influenza_CDR
caggacaacagacggcccagc

SEQ ID NO: 44901 - RNA, 21 nt, Artificial Sequence
  derived and/or modified sequence opt5 from anti-influenza_CDR
gacgugagcaagagacccucc

SEQ ID NO: 44902 - RNA, 21 nt, Artificial Sequence
  derived and/or modified sequence opt5 from anti-influenza_CDR
gacgccagcuccagagcuacc

SEQ ID NO: 44903 - RNA, 21 nt, Artificial Sequence
  derived and/or modified sequence opt5 from anti-influenza_CDR
cugggcagcaacagagccucc

SEQ ID NO: 44904 - RNA, 21 nt, Artificial Sequence
  derived and/or modified sequence opt5 from anti-influenza_CDR
ggcgccagcaccagagcugcc

SEQ ID NO: 44905 - RNA, 21 nt, Artificial Sequence
  derived and/or modified sequence opt5 from anti-influenza_CDR
gacgauagcgacagacccucc

SEQ ID NO: 44906 - RNA, 21 nt, Artificial Sequence
  derived and/or modified sequence opt5 from anti-influenza_CDR
agagacggccagcggcccagc

SEQ ID NO: 44907 - RNA, 21 nt, Artificial Sequence
  derived and/or modified sequence opt5 from anti-influenza_CDR
ggcgccagcuccagagcuacc

SEQ ID NO: 44908 - RNA, 21 nt, Artificial Sequence
  derived and/or modified sequence opt5 from anti-influenza_CDR
ggcgccagcuccagagcuucu

SEQ ID NO: 44909 - RNA, 21 nt, Artificial Sequence
  derived and/or modified sequence opt5 from anti-influenza_CDR
gccgcuagcacccugcagucc

SEQ ID NO: 44910 - RNA, 21 nt, Artificial Sequence
  derived and/or modified sequence opt5 from anti-influenza_CDR
cuggugagcaagagagccucc

SEQ ID NO: 44911 - RNA, 21 nt, Artificial Sequence
  derived and/or modified sequence opt5 from anti-influenza_CDR
gacgugaccuacagacccagc

SEQ ID NO: 44912 - RNA, 21 nt, Artificial Sequence
  derived and/or modified sequence opt5 from anti-influenza_CDR
augcaggcccuggagaccccc

SEQ ID NO: 44913 - RNA, 21 nt, Artificial Sequence
  derived and/or modified sequence opt5 from anti-influenza_CDR
cagaacuacggcagccccuuc

SEQ ID NO: 44914 - RNA, 21 nt, Artificial Sequence
  derived and/or modified sequence opt5 from anti-influenza_CDR
cagcaauacggcagccugccc

SEQ ID NO: 44915 - RNA, 21 nt, Artificial Sequence
  derived and/or modified sequence opt5 from anti-influenza_CDR
uggggcagcuaccuggagucc

SEQ ID NO: 44916 - RNA, 21 nt, Artificial Sequence
  derived and/or modified sequence opt5 from anti-influenza_CDR
agcgccuccaccagagcuaca

SEQ ID NO: 44917 - RNA, 21 nt, Artificial Sequence
  derived and/or modified sequence opt5 from anti-influenza_CDR
ggcgccagcaccagagcuucc

SEQ ID NO: 44918 - RNA, 21 nt, Artificial Sequence
  derived and/or modified sequence opt5 from anti-influenza_CDR
ggcgccagcaccagagacaca

SEQ ID NO: 44919 - RNA, 21 nt, Artificial Sequence
  derived and/or modified sequence opt5 from anti-influenza_CDR
aaggugagcacccuggagucc

SEQ ID NO: 44920 - RNA, 21 nt, Artificial Sequence
  derived and/or modified sequence opt5 from anti-influenza_CDR
agcaacaccgagagacccucc

SEQ ID NO: 44921 - RNA, 21 nt, Artificial Sequence
  derived and/or modified sequence opt5 from anti-influenza_CDR
aagaucagcaacagagacucc

SEQ ID NO: 44922 - RNA, 21 nt, Artificial Sequence
  derived and/or modified sequence opt5 from anti-influenza_CDR
agcgccucccacagauacucu

SEQ ID NO: 44923 - RNA, 21 nt, Artificial Sequence
  derived and/or modified sequence opt5 from anti-influenza_CDR
cagagcgugagauccaacaau

SEQ ID NO: 44924 - RNA, 21 nt, Artificial Sequence
  derived and/or modified sequence opt5 from anti-influenza_CDR
cagagcgugagauccggcuac

SEQ ID NO: 44925 - RNA, 21 nt, Artificial Sequence
  derived and/or modified sequence opt5 from anti-influenza_CDR
aucuacuauagaggcagcacc

SEQ ID NO: 44926 - RNA, 21 nt, Artificial Sequence
  derived and/or modified sequence opt5 from anti-influenza_CDR
guguacuauagcggcaucacc

SEQ ID NO: 44927 - RNA, 21 nt, Artificial Sequence
  derived and/or modified sequence opt5 from anti-influenza_CDR
agccacuucgccaaccugaag

SEQ ID NO: 44928 - RNA, 21 nt, Artificial Sequence
  derived and/or modified sequence opt5 from anti-influenza_CDR
cugaacaagagcaaacccuac

SEQ ID NO: 44929 - RNA, 21 nt, Artificial Sequence
  derived and/or modified sequence opt5 from anti-influenza_CDR
aagcuggccaacaccggcaca

SEQ ID NO: 44930 - RNA, 21 nt, Artificial Sequence
  derived and/or modified sequence opt5 from anti-influenza_CDR
gccgcuagcacccugacaucc

SEQ ID NO: 44931 - RNA, 21 nt, Artificial Sequence
  derived and/or modified sequence opt5 from anti-influenza_CDR
gacgccagcaagcuggcuucc

SEQ ID NO: 44932 - RNA, 21 nt, Artificial Sequence
  derived and/or modified sequence opt5 from anti-influenza_CDR
uucgccagcagacuggcuucc

SEQ ID NO: 44933 - RNA, 21 nt, Artificial Sequence
  derived and/or modified sequence opt5 from anti-influenza_CDR
agcgccuccacccuggcuucu

SEQ ID NO: 44934 - RNA, 21 nt, Artificial Sequence
  derived and/or modified sequence opt5 from anti-influenza_CDR
gaggugagccagagacccucc

SEQ ID NO: 44935 - RNA, 21 nt, Artificial Sequence
  derived and/or modified sequence opt5 from anti-influenza_CDR
ggcgggacccugaacaauuac

SEQ ID NO: 44936 - RNA, 21 nt, Artificial Sequence
  derived and/or modified sequence opt5 from anti-influenza_CDR
gacaucgugaugacccagagc

SEQ ID NO: 44937 - RNA, 24 nt, Artificial Sequence
  derived and/or modified sequence opt5 from anti-influenza_CDR
ggcuucaccuuuagcaacuacgcc

SEQ ID NO: 44938 - RNA, 24 nt, Artificial Sequence
  derived and/or modified sequence opt5 from anti-influenza_CDR
ggcuucaccuuuagcaacuacggg

SEQ ID NO: 44939 - RNA, 24 nt, Artificial Sequence
  derived and/or modified sequence opt5 from anti-influenza_CDR
ggcuucaccuuuagcuccuacgcc

SEQ ID NO: 44940 - RNA, 24 nt, Artificial Sequence
  derived and/or modified sequence opt5 from anti-influenza_CDR
ggcuucaccuuuagcacauacgcc

SEQ ID NO: 44941 - RNA, 24 nt, Artificial Sequence
  derived and/or modified sequence opt5 from anti-influenza_CDR
ggcgggaucuucauuagccaggcc

SEQ ID NO: 44942 - RNA, 24 nt, Artificial Sequence
  derived and/or modified sequence opt5 from anti-influenza_CDR
ggcgggaucuucagccccuacgcc

SEQ ID NO: 44943 - RNA, 24 nt, Artificial Sequence
  derived and/or modified sequence opt5 from anti-influenza_CDR
ggcgggcccuucagcggauuugcc

SEQ ID NO: 44944 - RNA, 24 nt, Artificial Sequence
  derived and/or modified sequence opt5 from anti-influenza_CDR
ggcgggaccuucaacagccacgcc

SEQ ID NO: 44945 - RNA, 24 nt, Artificial Sequence
  derived and/or modified sequence opt5 from anti-influenza_CDR
ggcagcaacaucggguccaauacc

SEQ ID NO: 44946 - RNA, 24 nt, Artificial Sequence
  derived and/or modified sequence opt5 from anti-influenza_CDR
ggcgugaccuucagcauguacgcc

SEQ ID NO: 44947 - RNA, 24 nt, Artificial Sequence
  derived and/or modified sequence opt5 from anti-influenza_CDR
ggcgugaccuucagcauguacaca

SEQ ID NO: 44948 - RNA, 24 nt, Artificial Sequence
  derived and/or modified sequence opt5 from anti-influenza_CDR
ggcgugaccagcuccaacuacccc

SEQ ID NO: 44949 - RNA, 24 nt, Artificial Sequence
  derived and/or modified sequence opt5 from anti-influenza_CDR
aucauugccaucuucggcaccaca

SEQ ID NO: 44950 - RNA, 24 nt, Artificial Sequence
  derived and/or modified sequence opt5 from anti-influenza_CDR
aucauuccccuguucggcaccgcc

SEQ ID NO: 44951 - RNA, 24 nt, Artificial Sequence
  derived and/or modified sequence opt5 from anti-influenza_CDR
aucauuccccuguucggcaccaca

SEQ ID NO: 44952 - RNA, 24 nt, Artificial Sequence
  derived and/or modified sequence opt5 from anti-influenza_CDR
aucauucccauguucggcgccacc

SEQ ID NO: 44953 - RNA, 24 nt, Artificial Sequence
  derived and/or modified sequence opt5 from anti-influenza_CDR
aucauucccauguucggcaccaca

SEQ ID NO: 44954 - RNA, 24 nt, Artificial Sequence
  derived and/or modified sequence opt5 from anti-influenza_CDR
aucaacagcggcgggggagccacc

SEQ ID NO: 44955 - RNA, 24 nt, Artificial Sequence
  derived and/or modified sequence opt5 from anti-influenza_CDR
aucagcgccguguucggcaccgcu

SEQ ID NO: 44956 - RNA, 24 nt, Artificial Sequence
  derived and/or modified sequence opt5 from anti-influenza_CDR
aucagcuacgacgccaacuauaag

SEQ ID NO: 44957 - RNA, 24 nt, Artificial Sequence
  derived and/or modified sequence opt5 from anti-influenza_CDR
aucagcuacgacggcaacuauaag

SEQ ID NO: 44958 - RNA, 24 nt, Artificial Sequence
  derived and/or modified sequence opt5 from anti-influenza_CDR
aucagcuacgacggcuccaacaag

SEQ ID NO: 44959 - RNA, 24 nt, Artificial Sequence
  derived and/or modified sequence opt5 from anti-influenza_CDR
aucagcuacgacggcuccaaccag

SEQ ID NO: 44960 - RNA, 24 nt, Artificial Sequence
  derived and/or modified sequence opt5 from anti-influenza_CDR
cagcaauacuauagaagccccucc

SEQ ID NO: 44961 - RNA, 24 nt, Artificial Sequence
  derived and/or modified sequence opt5 from anti-influenza_CDR
gugcugccccucuucggcgucacc

SEQ ID NO: 44962 - RNA, 24 nt, Artificial Sequence
  derived and/or modified sequence opt5 from anti-influenza_CDR
ggcgggaccuucagcuccgacgcc

SEQ ID NO: 44963 - RNA, 24 nt, Artificial Sequence
  derived and/or modified sequence opt5 from anti-influenza_CDR
aucauucccguguuccagaccgcc

SEQ ID NO: 44964 - RNA, 24 nt, Artificial Sequence
  derived and/or modified sequence opt5 from anti-influenza_CDR
accagcaacaucggcuccaaugcc

SEQ ID NO: 44965 - RNA, 24 nt, Artificial Sequence
  derived and/or modified sequence opt5 from anti-influenza_CDR
ggcuacagcuucaccuccagaugg

SEQ ID NO: 44966 - RNA, 24 nt, Artificial Sequence
  derived and/or modified sequence opt5 from anti-influenza_CDR
aucuaccccagcgacuccgaugug

SEQ ID NO: 44967 - RNA, 24 nt, Artificial Sequence
  derived and/or modified sequence opt5 from anti-influenza_CDR
cagcaauacgacaacuggcugagc

SEQ ID NO: 44968 - RNA, 24 nt, Artificial Sequence
  derived and/or modified sequence opt5 from anti-influenza_CDR
ggcgggaccuucagcaacuacgga

SEQ ID NO: 44969 - RNA, 24 nt, Artificial Sequence
  derived and/or modified sequence opt5 from anti-influenza_CDR
ggcgccagcaucuccucuagcuac

SEQ ID NO: 44970 - RNA, 24 nt, Artificial Sequence
  derived and/or modified sequence opt5 from anti-influenza_CDR
ggcgggaccuucagcuccuacgac

SEQ ID NO: 44971 - RNA, 24 nt, Artificial Sequence
  derived and/or modified sequence opt5 from anti-influenza_CDR
aucauucccaucuacggcaccgcc

SEQ ID NO: 44972 - RNA, 24 nt, Artificial Sequence
  derived and/or modified sequence opt5 from anti-influenza_CDR
ggcuacaccagcacaacguauggg

SEQ ID NO: 44973 - RNA, 24 nt, Artificial Sequence
  derived and/or modified sequence opt5 from anti-influenza_CDR
aucaaccccuacaauggcaacccu

SEQ ID NO: 44974 - RNA, 24 nt, Artificial Sequence
  derived and/or modified sequence opt5 from anti-influenza_CDR
aucugguacgacggcgauaacaag

SEQ ID NO: 44975 - RNA, 24 nt, Artificial Sequence
  derived and/or modified sequence opt5 from anti-influenza_CDR
ggcuucaccuuuagcgacuucugg

SEQ ID NO: 44976 - RNA, 24 nt, Artificial Sequence
  derived and/or modified sequence opt5 from anti-influenza_CDR
aucgaccaggauggcaacgagaga

SEQ ID NO: 44977 - RNA, 24 nt, Artificial Sequence
  derived and/or modified sequence opt5 from anti-influenza_CDR
agcuccaacaucggcaagaauuac

SEQ ID NO: 44978 - RNA, 24 nt, Artificial Sequence
  derived and/or modified sequence opt5 from anti-influenza_CDR
ggcuacaccuucacaaacuauugg

SEQ ID NO: 44979 - RNA, 24 nt, Artificial Sequence
  derived and/or modified sequence opt5 from anti-influenza_CDR
aucuucccucccgacagccagacc

SEQ ID NO: 44980 - RNA, 24 nt, Artificial Sequence
  derived and/or modified sequence opt5 from anti-influenza_CDR
ggcuacagcuucuccgacuauugg

SEQ ID NO: 44981 - RNA, 24 nt, Artificial Sequence
  derived and/or modified sequence opt5 from anti-influenza_CDR
aucuaccccgccagcuccgagauu

SEQ ID NO: 44982 - RNA, 24 nt, Artificial Sequence
  derived and/or modified sequence opt5 from anti-influenza_CDR
agcggcgacuccgggaccuggaac

SEQ ID NO: 44983 - RNA, 24 nt, Artificial Sequence
  derived and/or modified sequence opt5 from anti-influenza_CDR
ggcgggacccugaacaauuacgcc

SEQ ID NO: 44984 - RNA, 24 nt, Artificial Sequence
  derived and/or modified sequence opt5 from anti-influenza_CDR
aucagccccauuuucggcacccug

SEQ ID NO: 44985 - RNA, 24 nt, Artificial Sequence
  derived and/or modified sequence opt5 from anti-influenza_CDR
ggcguguucuuuagcucccacgcc

SEQ ID NO: 44986 - RNA, 24 nt, Artificial Sequence
  derived and/or modified sequence opt5 from anti-influenza_CDR
aucagccccauguucggcaccaca

SEQ ID NO: 44987 - RNA, 24 nt, Artificial Sequence
  derived and/or modified sequence opt5 from anti-influenza_CDR
ggcuucaccuuuagcagauucggg

SEQ ID NO: 44988 - RNA, 24 nt, Artificial Sequence
  derived and/or modified sequence opt5 from anti-influenza_CDR
aucugguacgacggcagcaacaag

SEQ ID NO: 44989 - RNA, 24 nt, Artificial Sequence
  derived and/or modified sequence opt5 from anti-influenza_CDR
cagaccuacggcggggugagcaca

SEQ ID NO: 44990 - RNA, 24 nt, Artificial Sequence
  derived and/or modified sequence opt5 from anti-influenza_CDR
gacagcgccggcaacagacacucc

SEQ ID NO: 44991 - RNA, 24 nt, Artificial Sequence
  derived and/or modified sequence opt5 from anti-influenza_CDR
uucagaggcgggaacagccugucc

SEQ ID NO: 44992 - RNA, 24 nt, Artificial Sequence
  derived and/or modified sequence opt5 from anti-influenza_CDR
ggcuacaccuucacaacguauugg

SEQ ID NO: 44993 - RNA, 24 nt, Artificial Sequence
  derived and/or modified sequence opt5 from anti-influenza_CDR
aucgaccccuacgauagcgagacc

SEQ ID NO: 44994 - RNA, 24 nt, Artificial Sequence
  derived and/or modified sequence opt5 from anti-influenza_CDR
aucagaaaguuccugaacugguac

SEQ ID NO: 44995 - RNA, 24 nt, Artificial Sequence
  derived and/or modified sequence opt5 from anti-influenza_CDR
cagcaauacgacggccugcccuuc

SEQ ID NO: 44996 - RNA, 24 nt, Artificial Sequence
  derived and/or modified sequence opt5 from anti-influenza_CDR
aucagaaacagccugaauugguac

SEQ ID NO: 44997 - RNA, 24 nt, Artificial Sequence
  derived and/or modified sequence opt5 from anti-influenza_CDR
cagcaagccaacagcuucccccug

SEQ ID NO: 44998 - RNA, 24 nt, Artificial Sequence
  derived and/or modified sequence opt5 from anti-influenza_CDR
agccugcucaccgagguggaaaca

SEQ ID NO: 44999 - RNA, 24 nt, Artificial Sequence
  derived and/or modified sequence opt5 from anti-influenza_CDR
cagcaaagcuacuccaugcccgcc

SEQ ID NO: 45000 - RNA, 24 nt, Artificial Sequence
  derived and/or modified sequence opt5 from anti-influenza_CDR
ggcgggcccgugagcggaggcggg

SEQ ID NO: 45001 - RNA, 24 nt, Artificial Sequence
  derived and/or modified sequence opt5 from anti-influenza_CDR
caacagagcuucuccgugcccgcc

SEQ ID NO: 45002 - RNA, 24 nt, Artificial Sequence
  derived and/or modified sequence opt5 from anti-influenza_CDR
cagcaaaccuacagcaucccccug

SEQ ID NO: 45003 - RNA, 24 nt, Artificial Sequence
  derived and/or modified sequence opt5 from anti-influenza_CDR
cagcaaagcuacuccgugcccgcc

SEQ ID NO: 45004 - RNA, 24 nt, Artificial Sequence
  derived and/or modified sequence opt5 from anti-influenza_CDR
cagcaaaccuucagcaucccccug

SEQ ID NO: 45005 - RNA, 24 nt, Artificial Sequence
  derived and/or modified sequence opt5 from anti-influenza_CDR
ggcgacagcaucaccuccggggcc

SEQ ID NO: 45006 - RNA, 24 nt, Artificial Sequence
  derived and/or modified sequence opt5 from anti-influenza_CDR
caggccugggacagcuccaccgcu

SEQ ID NO: 45007 - RNA, 24 nt, Artificial Sequence
  derived and/or modified sequence opt5 from anti-influenza_CDR
cagcaauacggcagcucccugugg

SEQ ID NO: 45008 - RNA, 24 nt, Artificial Sequence
  derived and/or modified sequence opt5 from anti-influenza_CDR
gccuacggcuauaccuucgacccc

SEQ ID NO: 45009 - RNA, 24 nt, Artificial Sequence
  derived and/or modified sequence opt5 from anti-influenza_CDR
augcaggcccugcaaaccccccuc

SEQ ID NO: 45010 - RNA, 24 nt, Artificial Sequence
  derived and/or modified sequence opt5 from anti-influenza_CDR
cagcaauacggcagcucccugacc

SEQ ID NO: 45011 - RNA, 24 nt, Artificial Sequence
  derived and/or modified sequence opt5 from anti-influenza_CDR
cagaaguacaacagcgcccccucc

SEQ ID NO: 45012 - RNA, 24 nt, Artificial Sequence
  derived and/or modified sequence opt5 from anti-influenza_CDR
cagcaaagaagcaacuggcugaag

SEQ ID NO: 45013 - RNA, 24 nt, Artificial Sequence
  derived and/or modified sequence opt5 from anti-influenza_CDR
agcucccagucuagaagcuccacc

SEQ ID NO: 45014 - RNA, 24 nt, Artificial Sequence
  derived and/or modified sequence opt5 from anti-influenza_CDR
cccuacgacgugccugauuaugag

SEQ ID NO: 45015 - RNA, 24 nt, Artificial Sequence
  derived and/or modified sequence opt5 from anti-influenza_CDR
cccuacgacgugccugauuaugcc

SEQ ID NO: 45016 - RNA, 24 nt, Artificial Sequence
  derived and/or modified sequence opt5 from anti-influenza_CDR
cccggcgacuucaacgauuacgag

SEQ ID NO: 45017 - RNA, 24 nt, Artificial Sequence
  derived and/or modified sequence opt5 from anti-influenza_CDR
cccaaggugagagaccaggagagc

SEQ ID NO: 45018 - RNA, 24 nt, Artificial Sequence
  derived and/or modified sequence opt5 from anti-influenza_CDR
accagcuacacauccucuaacacg

SEQ ID NO: 45019 - RNA, 24 nt, Artificial Sequence
  derived and/or modified sequence opt5 from anti-influenza_CDR
ggcgggaacuucaauaacuacgcc

SEQ ID NO: 45020 - RNA, 24 nt, Artificial Sequence
  derived and/or modified sequence opt5 from anti-influenza_CDR
aucagccccauuuucggcuccacc

SEQ ID NO: 45021 - RNA, 24 nt, Artificial Sequence
  derived and/or modified sequence opt5 from anti-influenza_CDR
agcuccuacaccucuagcaacaca

SEQ ID NO: 45022 - RNA, 24 nt, Artificial Sequence
  derived and/or modified sequence opt5 from anti-influenza_CDR
ggcgggaccuucaacaauuacgcc

SEQ ID NO: 45023 - RNA, 24 nt, Artificial Sequence
  derived and/or modified sequence opt5 from anti-influenza_CDR
aucagccccauuuucggcuccgug

SEQ ID NO: 45024 - RNA, 24 nt, Artificial Sequence
  derived and/or modified sequence opt5 from anti-influenza_CDR
agcuccaacaucggccacaauuuc

SEQ ID NO: 45025 - RNA, 24 nt, Artificial Sequence
  derived and/or modified sequence opt5 from anti-influenza_CDR
ggcaccugggacagcucccugucu

SEQ ID NO: 45026 - RNA, 24 nt, Artificial Sequence
  derived and/or modified sequence opt5 from anti-influenza_CDR
ggcgggaucauuagaaaguacgcc

SEQ ID NO: 45027 - RNA, 24 nt, Artificial Sequence
  derived and/or modified sequence opt5 from anti-influenza_CDR
aucauugccaucuucaacaccgcu

SEQ ID NO: 45028 - RNA, 24 nt, Artificial Sequence
  derived and/or modified sequence opt5 from anti-influenza_CDR
ggcuacaccuucacagccuauacg

SEQ ID NO: 45029 - RNA, 24 nt, Artificial Sequence
  derived and/or modified sequence opt5 from anti-influenza_CDR
aucaacgccggcaaugggcacacc

SEQ ID NO: 45030 - RNA, 24 nt, Artificial Sequence
  derived and/or modified sequence opt5 from anti-influenza_CDR
ggcgggaccuucaucaacuacgcc

SEQ ID NO: 45031 - RNA, 24 nt, Artificial Sequence
  derived and/or modified sequence opt5 from anti-influenza_CDR
aucauucccguguacggcaccagc

SEQ ID NO: 45032 - RNA, 24 nt, Artificial Sequence
  derived and/or modified sequence opt5 from anti-influenza_CDR
ggcuucaccuuuagaagccacgcc

SEQ ID NO: 45033 - RNA, 24 nt, Artificial Sequence
  derived and/or modified sequence opt5 from anti-influenza_CDR
aucagcuacgacgaggugaacaag

SEQ ID NO: 45034 - RNA, 24 nt, Artificial Sequence
  derived and/or modified sequence opt5 from anti-influenza_CDR
ggcuacaacuucgccgcuuauuac

SEQ ID NO: 45035 - RNA, 24 nt, Artificial Sequence
  derived and/or modified sequence opt5 from anti-influenza_CDR
agcaaccccaauaccggcggggcc

SEQ ID NO: 45036 - RNA, 24 nt, Artificial Sequence
  derived and/or modified sequence opt5 from anti-influenza_CDR
ggcuacacccugaucgacuauuac

SEQ ID NO: 45037 - RNA, 24 nt, Artificial Sequence
  derived and/or modified sequence opt5 from anti-influenza_CDR
aucaaccccauuaauggcgggacc

SEQ ID NO: 45038 - RNA, 24 nt, Artificial Sequence
  derived and/or modified sequence opt5 from anti-influenza_CDR
ggcuucaccuuuagcgccuacgcu

SEQ ID NO: 45039 - RNA, 24 nt, Artificial Sequence
  derived and/or modified sequence opt5 from anti-influenza_CDR
accagcuacgacggcagagauucc

SEQ ID NO: 45040 - RNA, 24 nt, Artificial Sequence
  derived and/or modified sequence opt5 from anti-influenza_CDR
ggcuucaccuuuacaaacuacgcc

SEQ ID NO: 45041 - RNA, 24 nt, Artificial Sequence
  derived and/or modified sequence opt5 from anti-influenza_CDR
aucagcuucgacgaggauaacaag

SEQ ID NO: 45042 - RNA, 24 nt, Artificial Sequence
  derived and/or modified sequence opt5 from anti-influenza_CDR
ggcuucaacuuuagcuccuacggg

SEQ ID NO: 45043 - RNA, 24 nt, Artificial Sequence
  derived and/or modified sequence opt5 from anti-influenza_CDR
aucuggagcggcggguccaacaag

SEQ ID NO: 45044 - RNA, 24 nt, Artificial Sequence
  derived and/or modified sequence opt5 from anti-influenza_CDR
ggcuucaucuuuggggacuucgcc

SEQ ID NO: 45045 - RNA, 24 nt, Artificial Sequence
  derived and/or modified sequence opt5 from anti-influenza_CDR
ggcuucaacuuugacgaguacgug

SEQ ID NO: 45046 - RNA, 24 nt, Artificial Sequence
  derived and/or modified sequence opt5 from anti-influenza_CDR
aucggcgccgacgggagaggaacc

SEQ ID NO: 45047 - RNA, 24 nt, Artificial Sequence
  derived and/or modified sequence opt5 from anti-influenza_CDR
ggcgggagcguguccaacuacuau

SEQ ID NO: 45048 - RNA, 24 nt, Artificial Sequence
  derived and/or modified sequence opt5 from anti-influenza_CDR
ggcgggaccuucagcuacuaugcc

SEQ ID NO: 45049 - RNA, 24 nt, Artificial Sequence
  derived and/or modified sequence opt5 from anti-influenza_CDR
aucauucccaucgugggcaccgcc

SEQ ID NO: 45050 - RNA, 24 nt, Artificial Sequence
  derived and/or modified sequence opt5 from anti-influenza_CDR
accagcaacaucggcuccaauaca

SEQ ID NO: 45051 - RNA, 24 nt, Artificial Sequence
  derived and/or modified sequence opt5 from anti-influenza_CDR
ggcuacaacuuccccaaguauugg

SEQ ID NO: 45052 - RNA, 24 nt, Artificial Sequence
  derived and/or modified sequence opt5 from anti-influenza_CDR
aucuaccccggcgacagcgaugug

SEQ ID NO: 45053 - RNA, 24 nt, Artificial Sequence
  derived and/or modified sequence opt5 from anti-influenza_CDR
ggccacaccuucaucagcuacgcc

SEQ ID NO: 45054 - RNA, 24 nt, Artificial Sequence
  derived and/or modified sequence opt5 from anti-influenza_CDR
aucgugcccauuuucggcaccguc

SEQ ID NO: 45055 - RNA, 24 nt, Artificial Sequence
  derived and/or modified sequence opt5 from anti-influenza_CDR
ggcuucaccuuuagaacauacggg

SEQ ID NO: 45056 - RNA, 24 nt, Artificial Sequence
  derived and/or modified sequence opt5 from anti-influenza_CDR
aucagcuacgacggcaccaacaag

SEQ ID NO: 45057 - RNA, 24 nt, Artificial Sequence
  derived and/or modified sequence opt5 from anti-influenza_CDR
ggcuucaccuuuagcuccuacggg

SEQ ID NO: 45058 - RNA, 24 nt, Artificial Sequence
  derived and/or modified sequence opt5 from anti-influenza_CDR
aucagcuacgacgagauuaacaag

SEQ ID NO: 45059 - RNA, 24 nt, Artificial Sequence
  derived and/or modified sequence opt5 from anti-influenza_CDR
ggcuucagccuguggaccuccggg

SEQ ID NO: 45060 - RNA, 24 nt, Artificial Sequence
  derived and/or modified sequence opt5 from anti-influenza_CDR
augagcuacgacgagaccaagaaa

SEQ ID NO: 45061 - RNA, 24 nt, Artificial Sequence
  derived and/or modified sequence opt5 from anti-influenza_CDR
ggcuucaccuuuagcagauacucc

SEQ ID NO: 45062 - RNA, 24 nt, Artificial Sequence
  derived and/or modified sequence opt5 from anti-influenza_CDR
aucagcgacaccuccagaacaauu

SEQ ID NO: 45063 - RNA, 24 nt, Artificial Sequence
  derived and/or modified sequence opt5 from anti-influenza_CDR
ggcuucaccuuuaacagcuacgcc

SEQ ID NO: 45064 - RNA, 24 nt, Artificial Sequence
  derived and/or modified sequence opt5 from anti-influenza_CDR
aucagaggcagcggggagaacacc

SEQ ID NO: 45065 - RNA, 24 nt, Artificial Sequence
  derived and/or modified sequence opt5 from anti-influenza_CDR
ggcuucaccuuuagcagauucucc

SEQ ID NO: 45066 - RNA, 24 nt, Artificial Sequence
  derived and/or modified sequence opt5 from anti-influenza_CDR
aucagcgacaccggcagaacaauu

SEQ ID NO: 45067 - RNA, 24 nt, Artificial Sequence
  derived and/or modified sequence opt5 from anti-influenza_CDR
ggcgacagcuucaccuccuacugg

SEQ ID NO: 45068 - RNA, 24 nt, Artificial Sequence
  derived and/or modified sequence opt5 from anti-influenza_CDR
aucuaccccagagacagcgagacc

SEQ ID NO: 45069 - RNA, 24 nt, Artificial Sequence
  derived and/or modified sequence opt5 from anti-influenza_CDR
ggcuacaccuucacagccuaucac

SEQ ID NO: 45070 - RNA, 24 nt, Artificial Sequence
  derived and/or modified sequence opt5 from anti-influenza_CDR
aucaaccccaauagcggcgccacc

SEQ ID NO: 45071 - RNA, 24 nt, Artificial Sequence
  derived and/or modified sequence opt5 from anti-influenza_CDR
ggcuucaccuuuagcgacuacugg

SEQ ID NO: 45072 - RNA, 24 nt, Artificial Sequence
  derived and/or modified sequence opt5 from anti-influenza_CDR
aucagcuccgacggcucuaccaca

SEQ ID NO: 45073 - RNA, 24 nt, Artificial Sequence
  derived and/or modified sequence opt5 from anti-influenza_CDR
ggcuucagcuuuuccaacgccugg

SEQ ID NO: 45074 - RNA, 24 nt, Artificial Sequence
  derived and/or modified sequence opt5 from anti-influenza_CDR
ggccugaccuucagcaacgccugg

SEQ ID NO: 45075 - RNA, 24 nt, Artificial Sequence
  derived and/or modified sequence opt5 from anti-influenza_CDR
ggcuucaccuuuagcaacgccugg

SEQ ID NO: 45076 - RNA, 24 nt, Artificial Sequence
  derived and/or modified sequence opt5 from anti-influenza_CDR
ggccugagcuuccucaacgccugg

SEQ ID NO: 45077 - RNA, 24 nt, Artificial Sequence
  derived and/or modified sequence opt5 from anti-influenza_CDR
ggcuucagcuuucugaacgccugg

SEQ ID NO: 45078 - RNA, 24 nt, Artificial Sequence
  derived and/or modified sequence opt5 from anti-influenza_CDR
ggccugaccuuccucaacgccugg

SEQ ID NO: 45079 - RNA, 24 nt, Artificial Sequence
  derived and/or modified sequence opt5 from anti-influenza_CDR
ggcuucaccuuucugaacgccugg

SEQ ID NO: 45080 - RNA, 24 nt, Artificial Sequence
  derived and/or modified sequence opt5 from anti-influenza_CDR
ggcuacaccuucacagacuauuac

SEQ ID NO: 45081 - RNA, 24 nt, Artificial Sequence
  derived and/or modified sequence opt5 from anti-influenza_CDR
gugaaccccuacagcggcgggacc

SEQ ID NO: 45082 - RNA, 24 nt, Artificial Sequence
  derived and/or modified sequence opt5 from anti-influenza_CDR
ggcuacaccuucacagacuauaac

SEQ ID NO: 45083 - RNA, 24 nt, Artificial Sequence
  derived and/or modified sequence opt5 from anti-influenza_CDR
aucuaccccaacaauggcgggacc

SEQ ID NO: 45084 - RNA, 24 nt, Artificial Sequence
  derived and/or modified sequence opt5 from anti-influenza_CDR
ggcuacaccuucacaggguauaac

SEQ ID NO: 45085 - RNA, 24 nt, Artificial Sequence
  derived and/or modified sequence opt5 from anti-influenza_CDR
aucuaccccaacaauggcgugacc

SEQ ID NO: 45086 - RNA, 24 nt, Artificial Sequence
  derived and/or modified sequence opt5 from anti-influenza_CDR
auggagaccgacacacugcuccug

SEQ ID NO: 45087 - RNA, 27 nt, Artificial Sequence
  derived and/or modified sequence opt5 from anti-influenza_CDR
gacggcgugaccaacaaggucaauagc

SEQ ID NO: 45088 - RNA, 27 nt, Artificial Sequence
  derived and/or modified sequence opt5 from anti-influenza_CDR
ggcagcgacgugggguccucuaaccug

SEQ ID NO: 45089 - RNA, 27 nt, Artificial Sequence
  derived and/or modified sequence opt5 from anti-influenza_CDR
augcagaacauccugcucccccugacc

SEQ ID NO: 45090 - RNA, 27 nt, Artificial Sequence
  derived and/or modified sequence opt5 from anti-influenza_CDR
augcagagccugcaacucccccugacc

SEQ ID NO: 45091 - RNA, 27 nt, Artificial Sequence
  derived and/or modified sequence opt5 from anti-influenza_CDR
cagcaacacuacagaacacccccuacc

SEQ ID NO: 45092 - RNA, 27 nt, Artificial Sequence
  derived and/or modified sequence opt5 from anti-influenza_CDR
cagcaauacggcaacagccccuauacc

SEQ ID NO: 45093 - RNA, 27 nt, Artificial Sequence
  derived and/or modified sequence opt5 from anti-influenza_CDR
cagcaauacggcagcucccccuauacc

SEQ ID NO: 45094 - RNA, 27 nt, Artificial Sequence
  derived and/or modified sequence opt5 from anti-influenza_CDR
cagcaauacggcaccagcccccagaca

SEQ ID NO: 45095 - RNA, 27 nt, Artificial Sequence
  derived and/or modified sequence opt5 from anti-influenza_CDR
cagcaauacggcuaucugccccucacc

SEQ ID NO: 45096 - RNA, 27 nt, Artificial Sequence
  derived and/or modified sequence opt5 from anti-influenza_CDR
caggccugggacagcuccaccgcugug

SEQ ID NO: 45097 - RNA, 27 nt, Artificial Sequence
  derived and/or modified sequence opt5 from anti-influenza_CDR
cagcacuacaacgccuauuggggcacc

SEQ ID NO: 45098 - RNA, 27 nt, Artificial Sequence
  derived and/or modified sequence opt5 from anti-influenza_CDR
cagcaaaccuacagcuccccucccaca

SEQ ID NO: 45099 - RNA, 27 nt, Artificial Sequence
  derived and/or modified sequence opt5 from anti-influenza_CDR
cagcaauacuauagcuuccccuacacc

SEQ ID NO: 45100 - RNA, 27 nt, Artificial Sequence
  derived and/or modified sequence opt5 from anti-influenza_CDR
augcaggcccugcaacucccccuggcu

SEQ ID NO: 45101 - RNA, 27 nt, Artificial Sequence
  derived and/or modified sequence opt5 from anti-influenza_CDR
cagcaagccaacagcuuccccuuuacc

SEQ ID NO: 45102 - RNA, 27 nt, Artificial Sequence
  derived and/or modified sequence opt5 from anti-influenza_CDR
cagcaacugaacggcuacccccucacc

SEQ ID NO: 45103 - RNA, 27 nt, Artificial Sequence
  derived and/or modified sequence opt5 from anti-influenza_CDR
augcaggcccugcaaacaccccucacc

SEQ ID NO: 45104 - RNA, 27 nt, Artificial Sequence
  derived and/or modified sequence opt5 from anti-influenza_CDR
cagcaaaacuacaauuggccccugacc

SEQ ID NO: 45105 - RNA, 27 nt, Artificial Sequence
  derived and/or modified sequence opt5 from anti-influenza_CDR
cagcaauacgacaccagcuccggccug

SEQ ID NO: 45106 - RNA, 27 nt, Artificial Sequence
  derived and/or modified sequence opt5 from anti-influenza_CDR
cagcaauacaacagcuggcccagaacc

SEQ ID NO: 45107 - RNA, 27 nt, Artificial Sequence
  derived and/or modified sequence opt5 from anti-influenza_CDR
gugaucuacagccacggcagagccuau

SEQ ID NO: 45108 - RNA, 27 nt, Artificial Sequence
  derived and/or modified sequence opt5 from anti-influenza_CDR
cagcaauacggcgacagcagauauacc

SEQ ID NO: 45109 - RNA, 27 nt, Artificial Sequence
  derived and/or modified sequence opt5 from anti-influenza_CDR
cugcagcacaacagcuaccccuauacc

SEQ ID NO: 45110 - RNA, 27 nt, Artificial Sequence
  derived and/or modified sequence opt5 from anti-influenza_CDR
agaaagaugaccacagccuucgacagc

SEQ ID NO: 45111 - RNA, 27 nt, Artificial Sequence
  derived and/or modified sequence opt5 from anti-influenza_CDR
cagagaaaccacagccccuccuggacc

SEQ ID NO: 45112 - RNA, 27 nt, Artificial Sequence
  derived and/or modified sequence opt5 from anti-influenza_CDR
cagcaaagcuacgacaacccccagacc

SEQ ID NO: 45113 - RNA, 27 nt, Artificial Sequence
  derived and/or modified sequence opt5 from anti-influenza_CDR
cagcaaagcagacggcugcccuacacc

SEQ ID NO: 45114 - RNA, 27 nt, Artificial Sequence
  derived and/or modified sequence opt5 from anti-influenza_CDR
agaaagaugaccacagccaucgacuac

SEQ ID NO: 45115 - RNA, 27 nt, Artificial Sequence
  derived and/or modified sequence opt5 from anti-influenza_CDR
aucagauacaccggccagcaacugcuc

SEQ ID NO: 45116 - RNA, 27 nt, Artificial Sequence
  derived and/or modified sequence opt5 from anti-influenza_CDR
cagcacuacggcaccaucagccaaaca

SEQ ID NO: 45117 - RNA, 27 nt, Artificial Sequence
  derived and/or modified sequence opt5 from anti-influenza_CDR
cagcaauacagcaccuccccucccaca

SEQ ID NO: 45118 - RNA, 27 nt, Artificial Sequence
  derived and/or modified sequence opt5 from anti-influenza_CDR
cagcaauacggcaacagccccaucacc

SEQ ID NO: 45119 - RNA, 27 nt, Artificial Sequence
  derived and/or modified sequence opt5 from anti-influenza_CDR
cagcaauacuauagcagacccuacacc

SEQ ID NO: 45120 - RNA, 27 nt, Artificial Sequence
  derived and/or modified sequence opt5 from anti-influenza_CDR
caggugugggacaacuucggcgggguc

SEQ ID NO: 45121 - RNA, 27 nt, Artificial Sequence
  derived and/or modified sequence opt5 from anti-influenza_CDR
cagcaaagcuacuccucuccccugacc

SEQ ID NO: 45122 - RNA, 27 nt, Artificial Sequence
  derived and/or modified sequence opt5 from anti-influenza_CDR
cagcaauacuucgccacccccagaaca

SEQ ID NO: 45123 - RNA, 27 nt, Artificial Sequence
  derived and/or modified sequence opt5 from anti-influenza_CDR
cagcaauacuauuucagcccccugacc

SEQ ID NO: 45124 - RNA, 27 nt, Artificial Sequence
  derived and/or modified sequence opt5 from anti-influenza_CDR
cagcacuucggcaccagcguguuuaca

SEQ ID NO: 45125 - RNA, 27 nt, Artificial Sequence
  derived and/or modified sequence opt5 from anti-influenza_CDR
cagcaauacuauaacgccccccugacc

SEQ ID NO: 45126 - RNA, 27 nt, Artificial Sequence
  derived and/or modified sequence opt5 from anti-influenza_CDR
gugcuguucaccagccccuuugacuuc

SEQ ID NO: 45127 - RNA, 27 nt, Artificial Sequence
  derived and/or modified sequence opt5 from anti-influenza_CDR
cugcucagcuacuccggcguguggguc

SEQ ID NO: 45128 - RNA, 27 nt, Artificial Sequence
  derived and/or modified sequence opt5 from anti-influenza_CDR
uuccugagcuacuccggcgccugggug

SEQ ID NO: 45129 - RNA, 27 nt, Artificial Sequence
  derived and/or modified sequence opt5 from anti-influenza_CDR
caacagagcuucuccaagucuuggacc

SEQ ID NO: 45130 - RNA, 27 nt, Artificial Sequence
  derived and/or modified sequence opt5 from anti-influenza_CDR
gugcaguacguccaauuccccuggacc

SEQ ID NO: 45131 - RNA, 27 nt, Artificial Sequence
  derived and/or modified sequence opt5 from anti-influenza_CDR
cagcaaagcuacuccccuccccugacc

SEQ ID NO: 45132 - RNA, 27 nt, Artificial Sequence
  derived and/or modified sequence opt5 from anti-influenza_CDR
uucaucuacuauggcgggaacaccaag

SEQ ID NO: 45133 - RNA, 27 nt, Artificial Sequence
  derived and/or modified sequence opt5 from anti-influenza_CDR
gugaucuacagcggcggguccaccuau

SEQ ID NO: 45134 - RNA, 27 nt, Artificial Sequence
  derived and/or modified sequence opt5 from anti-influenza_CDR
uucauguuucacagcggcucccccaga

SEQ ID NO: 45135 - RNA, 27 nt, Artificial Sequence
  derived and/or modified sequence opt5 from anti-influenza_CDR
cagcaaaccuacagcacacccaucacg

SEQ ID NO: 45136 - RNA, 27 nt, Artificial Sequence
  derived and/or modified sequence opt5 from anti-influenza_CDR
uucuuuuacaacggcgggagcaccaag

SEQ ID NO: 45137 - RNA, 27 nt, Artificial Sequence
  derived and/or modified sequence opt5 from anti-influenza_CDR
cagcaaagcuacaacaccccccugauc

SEQ ID NO: 45138 - RNA, 27 nt, Artificial Sequence
  derived and/or modified sequence opt5 from anti-influenza_CDR
cacaucuacgacuauggcagaaccuuc

SEQ ID NO: 45139 - RNA, 27 nt, Artificial Sequence
  derived and/or modified sequence opt5 from anti-influenza_CDR
guguucuacagcgagaccagaacauau

SEQ ID NO: 45140 - RNA, 27 nt, Artificial Sequence
  derived and/or modified sequence opt5 from anti-influenza_CDR
cagguguggggcagcuccucugaccac

SEQ ID NO: 45141 - RNA, 27 nt, Artificial Sequence
  derived and/or modified sequence opt5 from anti-influenza_CDR
uacguguauaacagaggcagcaccaag

SEQ ID NO: 45142 - RNA, 27 nt, Artificial Sequence
  derived and/or modified sequence opt5 from anti-influenza_CDR
uacaucuauaacagaggcagcaccaag

SEQ ID NO: 45143 - RNA, 27 nt, Artificial Sequence
  derived and/or modified sequence opt5 from anti-influenza_CDR
cagcaaagcuacaacacccccaucaca

SEQ ID NO: 45144 - RNA, 27 nt, Artificial Sequence
  derived and/or modified sequence opt5 from anti-influenza_CDR
cagcaauacuauagcuccccucccacc

SEQ ID NO: 45145 - RNA, 27 nt, Artificial Sequence
  derived and/or modified sequence opt5 from anti-influenza_CDR
uaccuguauuacagcggcuccaccaag

SEQ ID NO: 45146 - RNA, 27 nt, Artificial Sequence
  derived and/or modified sequence opt5 from anti-influenza_CDR
cagcaaagcuacuccccucccaucacc

SEQ ID NO: 45147 - RNA, 27 nt, Artificial Sequence
  derived and/or modified sequence opt5 from anti-influenza_CDR
uacguguauaacagcggcaauaccaag

SEQ ID NO: 45148 - RNA, 27 nt, Artificial Sequence
  derived and/or modified sequence opt5 from anti-influenza_CDR
cagcaaagcuacaacacaccccugacc

SEQ ID NO: 45149 - RNA, 27 nt, Artificial Sequence
  derived and/or modified sequence opt5 from anti-influenza_CDR
cacaucuucgacagcggcuccaccuac

SEQ ID NO: 45150 - RNA, 27 nt, Artificial Sequence
  derived and/or modified sequence opt5 from anti-influenza_CDR
guguucuacagcgccgacagaaccucc

SEQ ID NO: 45151 - RNA, 27 nt, Artificial Sequence
  derived and/or modified sequence opt5 from anti-influenza_CDR
cagcaauacuauagcacaccccugacc

SEQ ID NO: 45152 - RNA, 27 nt, Artificial Sequence
  derived and/or modified sequence opt5 from anti-influenza_CDR
uacaucuauuacagcggcaacaccuau

SEQ ID NO: 45153 - RNA, 27 nt, Artificial Sequence
  derived and/or modified sequence opt5 from anti-influenza_CDR
cagcaaagcuacuccacaccccugacc

SEQ ID NO: 45154 - RNA, 27 nt, Artificial Sequence
  derived and/or modified sequence opt5 from anti-influenza_CDR
cagcaauacggcagcuccucucugacc

SEQ ID NO: 45155 - RNA, 27 nt, Artificial Sequence
  derived and/or modified sequence opt5 from anti-influenza_CDR
agcuccuacaccucuagcuccacauau

SEQ ID NO: 45156 - RNA, 27 nt, Artificial Sequence
  derived and/or modified sequence opt5 from anti-influenza_CDR
cagagauacaacagcgccccucccauc

SEQ ID NO: 45157 - RNA, 27 nt, Artificial Sequence
  derived and/or modified sequence opt5 from anti-influenza_CDR
cagcaauacggcagaacaccccugacc

SEQ ID NO: 45158 - RNA, 27 nt, Artificial Sequence
  derived and/or modified sequence opt5 from anti-influenza_CDR
cagcaauacggcagcucccccagaacc

SEQ ID NO: 45159 - RNA, 27 nt, Artificial Sequence
  derived and/or modified sequence opt5 from anti-influenza_CDR
cagcaauacggcuccagcccccugacc

SEQ ID NO: 45160 - RNA, 27 nt, Artificial Sequence
  derived and/or modified sequence opt5 from anti-influenza_CDR
caggugugggacagcuccucugaucac

SEQ ID NO: 45161 - RNA, 27 nt, Artificial Sequence
  derived and/or modified sequence opt5 from anti-influenza_CDR
aaggaguucagcgaaguggagggcaga

SEQ ID NO: 45162 - RNA, 27 nt, Artificial Sequence
  derived and/or modified sequence opt5 from anti-influenza_CDR
aaagaguucaacaaucuggaaaagaga

SEQ ID NO: 45163 - RNA, 27 nt, Artificial Sequence
  derived and/or modified sequence opt5 from anti-influenza_CDR
cagcaacacuacagaaccccucccagc

SEQ ID NO: 45164 - RNA, 27 nt, Artificial Sequence
  derived and/or modified sequence opt5 from anti-influenza_CDR
augcaggccacccacuggccccugaca

SEQ ID NO: 45165 - RNA, 27 nt, Artificial Sequence
  derived and/or modified sequence opt5 from anti-influenza_CDR
cagcaauacuauagcuaccccuauacc

SEQ ID NO: 45166 - RNA, 27 nt, Artificial Sequence
  derived and/or modified sequence opt5 from anti-influenza_CDR
agcuccgacgugggcggguacaacuau

SEQ ID NO: 45167 - RNA, 27 nt, Artificial Sequence
  derived and/or modified sequence opt5 from anti-influenza_CDR
agcuccgacgugggcgauuacaacuau

SEQ ID NO: 45168 - RNA, 27 nt, Artificial Sequence
  derived and/or modified sequence opt5 from anti-influenza_CDR
cagcaauacaacaauuggccccugagc

SEQ ID NO: 45169 - RNA, 27 nt, Artificial Sequence
  derived and/or modified sequence opt5 from anti-influenza_CDR
cagcaaagcuacaacuaucccagaacc

SEQ ID NO: 45170 - RNA, 27 nt, Artificial Sequence
  derived and/or modified sequence opt5 from anti-influenza_CDR
augcagggccugcaaacccccuacaca

SEQ ID NO: 45171 - RNA, 27 nt, Artificial Sequence
  derived and/or modified sequence opt5 from anti-influenza_CDR
cagcaacacuacagcaucccccugacc

SEQ ID NO: 45172 - RNA, 27 nt, Artificial Sequence
  derived and/or modified sequence opt5 from anti-influenza_CDR
cugcagcacaacagcuaccccuggacc

SEQ ID NO: 45173 - RNA, 27 nt, Artificial Sequence
  derived and/or modified sequence opt5 from anti-influenza_CDR
cagcaauacaacaccuggccccugaca

SEQ ID NO: 45174 - RNA, 27 nt, Artificial Sequence
  derived and/or modified sequence opt5 from anti-influenza_CDR
cagcaauacaacagcuuccccuauaga

SEQ ID NO: 45175 - RNA, 27 nt, Artificial Sequence
  derived and/or modified sequence opt5 from anti-influenza_CDR
cagcaaagcuacuccgcccccuucacc

SEQ ID NO: 45176 - RNA, 27 nt, Artificial Sequence
  derived and/or modified sequence opt5 from anti-influenza_CDR
caggccugggacagcuccaccgugguc

SEQ ID NO: 45177 - RNA, 27 nt, Artificial Sequence
  derived and/or modified sequence opt5 from anti-influenza_CDR
caggccugggacagcaccacagugguc

SEQ ID NO: 45178 - RNA, 27 nt, Artificial Sequence
  derived and/or modified sequence opt5 from anti-influenza_CDR
cugcaguacggcagcucccccagaacc

SEQ ID NO: 45179 - RNA, 27 nt, Artificial Sequence
  derived and/or modified sequence opt5 from anti-influenza_CDR
agcuccgacgugggcggguacgauuau

SEQ ID NO: 45180 - RNA, 27 nt, Artificial Sequence
  derived and/or modified sequence opt5 from anti-influenza_CDR
cagcaauacaccuauuggccccugaca

SEQ ID NO: 45181 - RNA, 27 nt, Artificial Sequence
  derived and/or modified sequence opt5 from anti-influenza_CDR
cagcaauacgacaaguggcccccuggc

SEQ ID NO: 45182 - RNA, 27 nt, Artificial Sequence
  derived and/or modified sequence opt5 from anti-influenza_CDR
augcagagccugcaaaccuccaucaca

SEQ ID NO: 45183 - RNA, 27 nt, Artificial Sequence
  derived and/or modified sequence opt5 from anti-influenza_CDR
agccagaucgagcuggccgugcuccug

SEQ ID NO: 45184 - RNA, 27 nt, Artificial Sequence
  derived and/or modified sequence opt5 from anti-influenza_CDR
augcaggcccugcaaacccccuacaca

SEQ ID NO: 45185 - RNA, 27 nt, Artificial Sequence
  derived and/or modified sequence opt5 from anti-influenza_CDR
cagcaaagaagccacuggcccccuauc

SEQ ID NO: 45186 - RNA, 27 nt, Artificial Sequence
  derived and/or modified sequence opt5 from anti-influenza_CDR
cagcacuucuggggcacaccccugacc

SEQ ID NO: 45187 - RNA, 27 nt, Artificial Sequence
  derived and/or modified sequence opt5 from anti-influenza_CDR
cagcaaaacuacgaggaccccuggacc

SEQ ID NO: 45188 - RNA, 27 nt, Artificial Sequence
  derived and/or modified sequence opt5 from anti-influenza_CDR
cagcaagccaacagcuucccucccacc

SEQ ID NO: 45189 - RNA, 27 nt, Artificial Sequence
  derived and/or modified sequence opt5 from anti-influenza_CDR
cagcaaagagaccacuggcccccuauc

SEQ ID NO: 45190 - RNA, 27 nt, Artificial Sequence
  derived and/or modified sequence opt5 from anti-influenza_CDR
auggacagcagacugaaccucguguuc

SEQ ID NO: 45191 - RNA, 27 nt, Artificial Sequence
  derived and/or modified sequence opt5 from anti-influenza_CDR
augaagcugcccgugagacuccugguc

SEQ ID NO: 45192 - RNA, 30 nt, Artificial Sequence; identical to SEQ ID NO: 29908
  derived and/or modified sequence opt5 from anti-influenza_CDR

SEQ ID NO: 45193 - RNA, 30 nt, Artificial Sequence; identical to SEQ ID NO: 29909
  derived and/or modified sequence opt5 from anti-influenza_CDR

SEQ ID NO: 45194 - RNA, 30 nt, Artificial Sequence; identical to SEQ ID NO: 29910
  derived and/or modified sequence opt5 from anti-influenza_CDR

SEQ ID NO: 45195 - RNA, 30 nt, Artificial Sequence; identical to SEQ ID NO: 29911
  derived and/or modified sequence opt5 from anti-influenza_CDR

SEQ ID NO: 45196 - RNA, 30 nt, Artificial Sequence
  derived and/or modified sequence opt5 from anti-influenza_CDR
agcuccuacaccucuagcuccacauaugug

SEQ ID NO: 45197 - RNA, 30 nt, Artificial Sequence; identical to SEQ ID NO: 29913
  derived and/or modified sequence opt5 from anti-influenza_CDR

SEQ ID NO: 45198 - RNA, 30 nt, Artificial Sequence; identical to SEQ ID NO: 29914
  derived and/or modified sequence opt5 from anti-influenza_CDR

SEQ ID NO: 45199 - RNA, 30 nt, Artificial Sequence; identical to SEQ ID NO: 29915
  derived and/or modified sequence opt5 from anti-influenza_CDR

SEQ ID NO: 45200 - RNA, 30 nt, Artificial Sequence; identical to SEQ ID NO: 29916
  derived and/or modified sequence opt5 from anti-influenza_CDR

SEQ ID NO: 45201 - RNA, 30 nt, Artificial Sequence; identical to SEQ ID NO: 29917
  derived and/or modified sequence opt5 from anti-influenza_CDR

SEQ ID NO: 45202 - RNA, 30 nt, Artificial Sequence; identical to SEQ ID NO: 29918
  derived and/or modified sequence opt5 from anti-influenza_CDR

SEQ ID NO: 45203 - RNA, 30 nt, Artificial Sequence; identical to SEQ ID NO: 29919
  derived and/or modified sequence opt5 from anti-influenza_CDR

SEQ ID NO: 45204 - RNA, 30 nt, Artificial Sequence; identical to SEQ ID NO: 29920
  derived and/or modified sequence opt5 from anti-influenza_CDR

SEQ ID NO: 45205 - RNA, 30 nt, Artificial Sequence
  derived and/or modified sequence opt5 from anti-influenza_CDR
agcuccuacgccggcucuagcaccugggug

SEQ ID NO: 45206 - RNA, 30 nt, Artificial Sequence; identical to SEQ ID NO: 14638
  derived and/or modified sequence opt5 from anti-influenza_CDR

SEQ ID NO: 45207 - RNA, 30 nt, Artificial Sequence; identical to SEQ ID NO: 29923
  derived and/or modified sequence opt5 from anti-influenza_CDR

SEQ ID NO: 45208 - RNA, 30 nt, Artificial Sequence; identical to SEQ ID NO: 29924
  derived and/or modified sequence opt5 from anti-influenza_CDR

SEQ ID NO: 45209 - RNA, 30 nt, Artificial Sequence; identical to SEQ ID NO: 29925
  derived and/or modified sequence opt5 from anti-influenza_CDR

SEQ ID NO: 45210 - RNA, 30 nt, Artificial Sequence; identical to SEQ ID NO: 29926
  derived and/or modified sequence opt5 from anti-influenza_CDR

SEQ ID NO: 45211 - RNA, 30 nt, Artificial Sequence; identical to SEQ ID NO: 29927
  derived and/or modified sequence opt5 from anti-influenza_CDR

SEQ ID NO: 45212 - RNA, 30 nt, Artificial Sequence; identical to SEQ ID NO: 29928
  derived and/or modified sequence opt5 from anti-influenza_CDR

SEQ ID NO: 45213 - RNA, 30 nt, Artificial Sequence
  derived and/or modified sequence opt5 from anti-influenza_CDR
cagagcuacgacaacucccugucuggcagc

SEQ ID NO: 45214 - RNA, 30 nt, Artificial Sequence; identical to SEQ ID NO: 14646
  derived and/or modified sequence opt5 from anti-influenza_CDR

SEQ ID NO: 45215 - RNA, 30 nt, Artificial Sequence; identical to SEQ ID NO: 14647
  derived and/or modified sequence opt5 from anti-influenza_CDR

SEQ ID NO: 45216 - RNA, 30 nt, Artificial Sequence; identical to SEQ ID NO: 29932
  derived and/or modified sequence opt5 from anti-influenza_CDR

SEQ ID NO: 45217 - RNA, 30 nt, Artificial Sequence; identical to SEQ ID NO: 29933
  derived and/or modified sequence opt5 from anti-influenza_CDR

SEQ ID NO: 45218 - RNA, 30 nt, Artificial Sequence
  derived and/or modified sequence opt5 from anti-influenza_CDR
agcuccuacaccucuagcuccacacacgug

SEQ ID NO: 45219 - RNA, 30 nt, Artificial Sequence
  derived and/or modified sequence opt5 from anti-influenza_CDR
agcuccuacaccucuagcuccacacuggug

SEQ ID NO: 45220 - RNA, 30 nt, Artificial Sequence; identical to SEQ ID NO: 29936
  derived and/or modified sequence opt5 from anti-influenza_CDR

SEQ ID NO: 45221 - RNA, 30 nt, Artificial Sequence; identical to SEQ ID NO: 29937
  derived and/or modified sequence opt5 from anti-influenza_CDR

SEQ ID NO: 45222 - RNA, 30 nt, Artificial Sequence
  derived and/or modified sequence opt5 from anti-influenza_CDR
agcuccaacuacaauagacgguucaccccc

SEQ ID NO: 45223 - RNA, 30 nt, Artificial Sequence
  derived and/or modified sequence opt5 from anti-influenza_CDR
agacccaaggugcgggaccaggagagccgc

SEQ ID NO: 45224 - RNA, 30 nt, Artificial Sequence
  derived and/or modified sequence opt5 from anti-influenza_CDR
agacccugggugcggggcgucagcucccgc

SEQ ID NO: 45225 - RNA, 30 nt, Artificial Sequence
  derived and/or modified sequence opt5 from anti-influenza_CDR
agacccugggugcggggccugagcucccgc

SEQ ID NO: 45226 - RNA, 30 nt, Artificial Sequence
  derived and/or modified sequence opt5 from anti-influenza_CDR
agacccaaggugcggggccaggccgggcgc

SEQ ID NO: 45227 - RNA, 30 nt, Artificial Sequence
  derived and/or modified sequence opt5 from anti-influenza_CDR
gcccccgcuguggccgcgcaggcuagcgcc

SEQ ID NO: 45228 - RNA, 30 nt, Artificial Sequence; identical to SEQ ID NO: 29944
  derived and/or modified sequence opt5 from anti-influenza_CDR

SEQ ID NO: 45229 - RNA, 30 nt, Artificial Sequence; identical to SEQ ID NO: 29945
  derived and/or modified sequence opt5 from anti-influenza_CDR

SEQ ID NO: 45230 - RNA, 30 nt, Artificial Sequence; identical to SEQ ID NO: 29946
  derived and/or modified sequence opt5 from anti-influenza_CDR

SEQ ID NO: 45231 - RNA, 30 nt, Artificial Sequence; identical to SEQ ID NO: 14663
  derived and/or modified sequence opt5 from anti-influenza_CDR

SEQ ID NO: 45232 - RNA, 30 nt, Artificial Sequence; identical to SEQ ID NO: 14664
  derived and/or modified sequence opt5 from anti-influenza_CDR

SEQ ID NO: 45233 - RNA, 30 nt, Artificial Sequence; identical to SEQ ID NO: 29949
  derived and/or modified sequence opt5 from anti-influenza_CDR

SEQ ID NO: 45234 - RNA, 30 nt, Artificial Sequence; identical to SEQ ID NO: 29950
  derived and/or modified sequence opt5 from anti-influenza_CDR

SEQ ID NO: 45235 - RNA, 30 nt, Artificial Sequence; identical to SEQ ID NO: 29951
  derived and/or modified sequence opt5 from anti-influenza_CDR

SEQ ID NO: 45236 - RNA, 30 nt, Artificial Sequence; identical to SEQ ID NO: 29952
  derived and/or modified sequence opt5 from anti-influenza_CDR

SEQ ID NO: 45237 - RNA, 30 nt, Artificial Sequence; identical to SEQ ID NO: 29953
  derived and/or modified sequence opt5 from anti-influenza_CDR

SEQ ID NO: 45238 - RNA, 30 nt, Artificial Sequence; identical to SEQ ID NO: 29954
  derived and/or modified sequence opt5 from anti-influenza_CDR

SEQ ID NO: 45239 - RNA, 30 nt, Artificial Sequence; identical to SEQ ID NO: 29955
  derived and/or modified sequence opt5 from anti-influenza_CDR

SEQ ID NO: 45240 - RNA, 30 nt, Artificial Sequence
  derived and/or modified sequence opt5 from anti-influenza_CDR
aucagaagcggccugaaccgguucgagacc

SEQ ID NO: 45241 - RNA, 30 nt, Artificial Sequence; identical to SEQ ID NO: 29957
  derived and/or modified sequence opt5 from anti-influenza_CDR

SEQ ID NO: 45242 - RNA, 30 nt, Artificial Sequence; identical to SEQ ID NO: 29958
  derived and/or modified sequence opt5 from anti-influenza_CDR

SEQ ID NO: 45243 - RNA, 30 nt, Artificial Sequence; identical to SEQ ID NO: 29959
  derived and/or modified sequence opt5 from anti-influenza_CDR

SEQ ID NO: 45244 - RNA, 30 nt, Artificial Sequence; identical to SEQ ID NO: 29960
  derived and/or modified sequence opt5 from anti-influenza_CDR

SEQ ID NO: 45245 - RNA, 30 nt, Artificial Sequence; identical to SEQ ID NO: 29961
  derived and/or modified sequence opt5 from anti-influenza_CDR

SEQ ID NO: 45246 - RNA, 30 nt, Artificial Sequence; identical to SEQ ID NO: 29962
  derived and/or modified sequence opt5 from anti-influenza_CDR

SEQ ID NO: 45247 - RNA, 30 nt, Artificial Sequence
  derived and/or modified sequence opt5 from anti-influenza_CDR
cagcaacugaccacauacccucccaucacg

SEQ ID NO: 45248 - RNA, 30 nt, Artificial Sequence
  derived and/or modified sequence opt5 from anti-influenza_CDR
ggcgggagcaucuccaacggaggcuaccac

SEQ ID NO: 45249 - RNA, 30 nt, Artificial Sequence; identical to SEQ ID NO: 29965
  derived and/or modified sequence opt5 from anti-influenza_CDR

SEQ ID NO: 45250 - RNA, 30 nt, Artificial Sequence; identical to SEQ ID NO: 29966
  derived and/or modified sequence opt5 from anti-influenza_CDR

SEQ ID NO: 45251 - RNA, 30 nt, Artificial Sequence; identical to SEQ ID NO: 29967
  derived and/or modified sequence opt5 from anti-influenza_CDR

SEQ ID NO: 45252 - RNA, 30 nt, Artificial Sequence; identical to SEQ ID NO: 29968
  derived and/or modified sequence opt5 from anti-influenza_CDR

SEQ ID NO: 45253 - RNA, 30 nt, Artificial Sequence
  derived and/or modified sequence opt5 from anti-influenza_CDR
gccggcgacuacagcggggcuaacuaugcc

SEQ ID NO: 45254 - RNA, 30 nt, Artificial Sequence; identical to SEQ ID NO: 29970
  derived and/or modified sequence opt5 from anti-influenza_CDR

SEQ ID NO: 45255 - RNA, 30 nt, Artificial Sequence; identical to SEQ ID NO: 29971
  derived and/or modified sequence opt5 from anti-influenza_CDR

SEQ ID NO: 45256 - RNA, 30 nt, Artificial Sequence; identical to SEQ ID NO: 29972
  derived and/or modified sequence opt5 from anti-influenza_CDR

SEQ ID NO: 45257 - RNA, 30 nt, Artificial Sequence
  derived and/or modified sequence opt5 from anti-influenza_CDR
aucaagagcaacaccgacggcgggacaacg

SEQ ID NO: 45258 - RNA, 30 nt, Artificial Sequence; identical to SEQ ID NO: 14690
  derived and/or modified sequence opt5 from anti-influenza_CDR

SEQ ID NO: 45259 - RNA, 30 nt, Artificial Sequence; identical to SEQ ID NO: 29975
  derived and/or modified sequence opt5 from anti-influenza_CDR

SEQ ID NO: 45260 - RNA, 30 nt, Artificial Sequence; identical to SEQ ID NO: 29976
  derived and/or modified sequence opt5 from anti-influenza_CDR

SEQ ID NO: 45261 - RNA, 33 nt, Artificial Sequence; identical to SEQ ID NO: 29977
  derived and/or modified sequence opt5 from anti-influenza_CDR

SEQ ID NO: 45262 - RNA, 33 nt, Artificial Sequence
  derived and/or modified sequence opt5 from anti-influenza_CDR
ugcagcuacgccggcuccucuagcuccagagug

SEQ ID NO: 45263 - RNA, 33 nt, Artificial Sequence
  derived and/or modified sequence opt5 from anti-influenza_CDR
cuggugcucgccaccggccugagaaacagcccc

SEQ ID NO: 45264 - RNA, 33 nt, Artificial Sequence; identical to SEQ ID NO: 14696
  derived and/or modified sequence opt5 from anti-influenza_CDR

SEQ ID NO: 45265 - RNA, 33 nt, Artificial Sequence
  derived and/or modified sequence opt5 from anti-influenza_CDR
agaaccagccagucccugucuagcuaccuccac

SEQ ID NO: 45266 - RNA, 33 nt, Artificial Sequence
  derived and/or modified sequence opt5 from anti-influenza_CDR
agagccagccagcggcugaacuccuaccuccac

SEQ ID NO: 45267 - RNA, 33 nt, Artificial Sequence
  derived and/or modified sequence opt5 from anti-influenza_CDR
agaaccagccagucccugcggucuuaccuccac

SEQ ID NO: 45268 - RNA, 33 nt, Artificial Sequence
  derived and/or modified sequence opt5 from anti-influenza_CDR
agaaccagccagucccugucuagcuacacacac

SEQ ID NO: 45269 - RNA, 33 nt, Artificial Sequence
  derived and/or modified sequence opt5 from anti-influenza_CDR
agaaccagccagucccugucuagcuacgaccac

SEQ ID NO: 45270 - RNA, 33 nt, Artificial Sequence; identical to SEQ ID NO: 29986
  derived and/or modified sequence opt5 from anti-influenza_CDR

SEQ ID NO: 45271 - RNA, 33 nt, Artificial Sequence; identical to SEQ ID NO: 29987
  derived and/or modified sequence opt5 from anti-influenza_CDR

SEQ ID NO: 45272 - RNA, 33 nt, Artificial Sequence; identical to SEQ ID NO: 29988
  derived and/or modified sequence opt5 from anti-influenza_CDR

SEQ ID NO: 45273 - RNA, 33 nt, Artificial Sequence; identical to SEQ ID NO: 29989
  derived and/or modified sequence opt5 from anti-influenza_CDR

SEQ ID NO: 45274 - RNA, 33 nt, Artificial Sequence
  derived and/or modified sequence opt5 from anti-influenza_CDR
agagccagccagggcauccggaacgaccugggg

SEQ ID NO: 45275 - RNA, 33 nt, Artificial Sequence
  derived and/or modified sequence opt5 from anti-influenza_CDR
agagccagccagaacauccgguccuaccugaau

SEQ ID NO: 45276 - RNA, 33 nt, Artificial Sequence; identical to SEQ ID NO: 29992
  derived and/or modified sequence opt5 from anti-influenza_CDR

SEQ ID NO: 45277 - RNA, 33 nt, Artificial Sequence; identical to SEQ ID NO: 29993
  derived and/or modified sequence opt5 from anti-influenza_CDR

SEQ ID NO: 45278 - RNA, 33 nt, Artificial Sequence; identical to SEQ ID NO: 29994
  derived and/or modified sequence opt5 from anti-influenza_CDR

SEQ ID NO: 45279 - RNA, 33 nt, Artificial Sequence; identical to SEQ ID NO: 29995
  derived and/or modified sequence opt5 from anti-influenza_CDR

SEQ ID NO: 45280 - RNA, 33 nt, Artificial Sequence
  derived and/or modified sequence opt5 from anti-influenza_CDR
agagccagccaguccaucgcuucuuggcuggcc

SEQ ID NO: 45281 - RNA, 33 nt, Artificial Sequence; identical to SEQ ID NO: 29997
  derived and/or modified sequence opt5 from anti-influenza_CDR

SEQ ID NO: 45282 - RNA, 33 nt, Artificial Sequence
  derived and/or modified sequence opt5 from anti-influenza_CDR
agagccagccaguccgugucuagcuaccuggcu

SEQ ID NO: 45283 - RNA, 33 nt, Artificial Sequence; identical to SEQ ID NO: 29999
  derived and/or modified sequence opt5 from anti-influenza_CDR

SEQ ID NO: 45284 - RNA, 33 nt, Artificial Sequence
  derived and/or modified sequence opt5 from anti-influenza_CDR
cagagcgccgacuccucuggcaccagcugggug

SEQ ID NO: 45285 - RNA, 33 nt, Artificial Sequence
  derived and/or modified sequence opt5 from anti-influenza_CDR
ggcgggagcaacaucggaggcaaguccgugcac

SEQ ID NO: 45286 - RNA, 33 nt, Artificial Sequence; identical to SEQ ID NO: 30002
  derived and/or modified sequence opt5 from anti-influenza_CDR

SEQ ID NO: 45287 - RNA, 33 nt, Artificial Sequence
  derived and/or modified sequence opt5 from anti-influenza_CDR
agagccagccaguccaucucuagcuaccugaac

SEQ ID NO: 45288 - RNA, 33 nt, Artificial Sequence; identical to SEQ ID NO: 30004
  derived and/or modified sequence opt5 from anti-influenza_CDR

SEQ ID NO: 45289 - RNA, 33 nt, Artificial Sequence; identical to SEQ ID NO: 30005
  derived and/or modified sequence opt5 from anti-influenza_CDR

SEQ ID NO: 45290 - RNA, 33 nt, Artificial Sequence; identical to SEQ ID NO: 30006
  derived and/or modified sequence opt5 from anti-influenza_CDR

SEQ ID NO: 45291 - RNA, 33 nt, Artificial Sequence; identical to SEQ ID NO: 30007
  derived and/or modified sequence opt5 from anti-influenza_CDR

SEQ ID NO: 45292 - RNA, 33 nt, Artificial Sequence; identical to SEQ ID NO: 30008
  derived and/or modified sequence opt5 from anti-influenza_CDR

SEQ ID NO: 45293 - RNA, 33 nt, Artificial Sequence; identical to SEQ ID NO: 30009
  derived and/or modified sequence opt5 from anti-influenza_CDR

SEQ ID NO: 45294 - RNA, 33 nt, Artificial Sequence
  derived and/or modified sequence opt5 from anti-influenza_CDR
agagccagccagaacaucaagcgguacuucaau

SEQ ID NO: 45295 - RNA, 33 nt, Artificial Sequence; identical to SEQ ID NO: 30011
  derived and/or modified sequence opt5 from anti-influenza_CDR

SEQ ID NO: 45296 - RNA, 33 nt, Artificial Sequence; identical to SEQ ID NO: 30012
  derived and/or modified sequence opt5 from anti-influenza_CDR

SEQ ID NO: 45297 - RNA, 33 nt, Artificial Sequence; identical to SEQ ID NO: 30013
  derived and/or modified sequence opt5 from anti-influenza_CDR

SEQ ID NO: 45298 - RNA, 33 nt, Artificial Sequence; identical to SEQ ID NO: 30014
  derived and/or modified sequence opt5 from anti-influenza_CDR

SEQ ID NO: 45299 - RNA, 33 nt, Artificial Sequence
  derived and/or modified sequence opt5 from anti-influenza_CDR
agaaccagccaguccaucucuagcuaccugaac

SEQ ID NO: 45300 - RNA, 33 nt, Artificial Sequence; identical to SEQ ID NO: 30016
  derived and/or modified sequence opt5 from anti-influenza_CDR

SEQ ID NO: 45301 - RNA, 33 nt, Artificial Sequence; identical to SEQ ID NO: 30017
  derived and/or modified sequence opt5 from anti-influenza_CDR

SEQ ID NO: 45302 - RNA, 33 nt, Artificial Sequence; identical to SEQ ID NO: 30018
  derived and/or modified sequence opt5 from anti-influenza_CDR

SEQ ID NO: 45303 - RNA, 33 nt, Artificial Sequence; identical to SEQ ID NO: 30019
  derived and/or modified sequence opt5 from anti-influenza_CDR

SEQ ID NO: 45304 - RNA, 33 nt, Artificial Sequence; identical to SEQ ID NO: 30020
  derived and/or modified sequence opt5 from anti-influenza_CDR

SEQ ID NO: 45305 - RNA, 33 nt, Artificial Sequence; identical to SEQ ID NO: 30021
  derived and/or modified sequence opt5 from anti-influenza_CDR

SEQ ID NO: 45306 - RNA, 33 nt, Artificial Sequence; identical to SEQ ID NO: 30022
  derived and/or modified sequence opt5 from anti-influenza_CDR

SEQ ID NO: 45307 - RNA, 33 nt, Artificial Sequence; identical to SEQ ID NO: 30023
  derived and/or modified sequence opt5 from anti-influenza_CDR

SEQ ID NO: 45308 - RNA, 33 nt, Artificial Sequence; identical to SEQ ID NO: 30024
  derived and/or modified sequence opt5 from anti-influenza_CDR

SEQ ID NO: 45309 - RNA, 33 nt, Artificial Sequence
  derived and/or modified sequence opt5 from anti-influenza_CDR
agagccagccaguccaucucucgguaccugaac

SEQ ID NO: 45310 - RNA, 33 nt, Artificial Sequence; identical to SEQ ID NO: 30026
  derived and/or modified sequence opt5 from anti-influenza_CDR

SEQ ID NO: 45311 - RNA, 33 nt, Artificial Sequence; identical to SEQ ID NO: 30027
  derived and/or modified sequence opt5 from anti-influenza_CDR

SEQ ID NO: 45312 - RNA, 33 nt, Artificial Sequence; identical to SEQ ID NO: 30028
  derived and/or modified sequence opt5 from anti-influenza_CDR

SEQ ID NO: 45313 - RNA, 33 nt, Artificial Sequence; identical to SEQ ID NO: 30029
  derived and/or modified sequence opt5 from anti-influenza_CDR

SEQ ID NO: 45314 - RNA, 33 nt, Artificial Sequence; identical to SEQ ID NO: 30030
  derived and/or modified sequence opt5 from anti-influenza_CDR

SEQ ID NO: 45315 - RNA, 33 nt, Artificial Sequence; identical to SEQ ID NO: 30031
  derived and/or modified sequence opt5 from anti-influenza_CDR

SEQ ID NO: 45316 - RNA, 33 nt, Artificial Sequence; identical to SEQ ID NO: 30032
  derived and/or modified sequence opt5 from anti-influenza_CDR

SEQ ID NO: 45317 - RNA, 33 nt, Artificial Sequence; identical to SEQ ID NO: 30033
  derived and/or modified sequence opt5 from anti-influenza_CDR

SEQ ID NO: 45318 - RNA, 33 nt, Artificial Sequence; identical to SEQ ID NO: 30034
  derived and/or modified sequence opt5 from anti-influenza_CDR

SEQ ID NO: 45319 - RNA, 33 nt, Artificial Sequence
  derived and/or modified sequence opt5 from anti-influenza_CDR
agagccagccagcggguguccucuuaccuggcu

SEQ ID NO: 45320 - RNA, 33 nt, Artificial Sequence; identical to SEQ ID NO: 28929
  derived and/or modified sequence opt5 from anti-influenza_CDR

SEQ ID NO: 45321 - RNA, 33 nt, Artificial Sequence; identical to SEQ ID NO: 30037
  derived and/or modified sequence opt5 from anti-influenza_CDR

SEQ ID NO: 45322 - RNA, 33 nt, Artificial Sequence; identical to SEQ ID NO: 30038
  derived and/or modified sequence opt5 from anti-influenza_CDR

SEQ ID NO: 45323 - RNA, 33 nt, Artificial Sequence; identical to SEQ ID NO: 30039
  derived and/or modified sequence opt5 from anti-influenza_CDR

SEQ ID NO: 45324 - RNA, 33 nt, Artificial Sequence
  derived and/or modified sequence opt5 from anti-influenza_CDR
ggcgggaacaauaucggaagcaagggcgugcac

SEQ ID NO: 45325 - RNA, 33 nt, Artificial Sequence; identical to SEQ ID NO: 30041
  derived and/or modified sequence opt5 from anti-influenza_CDR

SEQ ID NO: 45326 - RNA, 33 nt, Artificial Sequence; identical to SEQ ID NO: 30042
  derived and/or modified sequence opt5 from anti-influenza_CDR

SEQ ID NO: 45327 - RNA, 33 nt, Artificial Sequence; identical to SEQ ID NO: 30043
  derived and/or modified sequence opt5 from anti-influenza_CDR

SEQ ID NO: 45328 - RNA, 33 nt, Artificial Sequence; identical to SEQ ID NO: 30044
  derived and/or modified sequence opt5 from anti-influenza_CDR

SEQ ID NO: 45329 - RNA, 33 nt, Artificial Sequence; identical to SEQ ID NO: 30045
  derived and/or modified sequence opt5 from anti-influenza_CDR

SEQ ID NO: 45330 - RNA, 33 nt, Artificial Sequence; identical to SEQ ID NO: 30046
  derived and/or modified sequence opt5 from anti-influenza_CDR

SEQ ID NO: 45331 - RNA, 33 nt, Artificial Sequence; identical to SEQ ID NO: 30047
  derived and/or modified sequence opt5 from anti-influenza_CDR

SEQ ID NO: 45332 - RNA, 33 nt, Artificial Sequence; identical to SEQ ID NO: 30048
  derived and/or modified sequence opt5 from anti-influenza_CDR

SEQ ID NO: 45333 - RNA, 33 nt, Artificial Sequence
  derived and/or modified sequence opt5 from anti-influenza_CDR
agagccagccaguccgugucucgguaccuggcu

SEQ ID NO: 45334 - RNA, 33 nt, Artificial Sequence
  derived and/or modified sequence opt5 from anti-influenza_CDR
uggggccaggggaccacacugacggugagcucc

SEQ ID NO: 45335 - RNA, 33 nt, Artificial Sequence; identical to SEQ ID NO: 30051
  derived and/or modified sequence opt5 from anti-influenza_CDR

SEQ ID NO: 45336 - RNA, 33 nt, Artificial Sequence; identical to SEQ ID NO: 30052
  derived and/or modified sequence opt5 from anti-influenza_CDR

SEQ ID NO: 45337 - RNA, 33 nt, Artificial Sequence
  derived and/or modified sequence opt5 from anti-influenza_CDR
agagccagccaguccgugucuagcaaccuggcu

SEQ ID NO: 45338 - RNA, 33 nt, Artificial Sequence; identical to SEQ ID NO: 30054
  derived and/or modified sequence opt5 from anti-influenza_CDR

SEQ ID NO: 45339 - RNA, 33 nt, Artificial Sequence; identical to SEQ ID NO: 30055
  derived and/or modified sequence opt5 from anti-influenza_CDR

SEQ ID NO: 45340 - RNA, 33 nt, Artificial Sequence; identical to SEQ ID NO: 30056
  derived and/or modified sequence opt5 from anti-influenza_CDR

SEQ ID NO: 45341 - RNA, 33 nt, Artificial Sequence; identical to SEQ ID NO: 30057
  derived and/or modified sequence opt5 from anti-influenza_CDR

SEQ ID NO: 45342 - RNA, 33 nt, Artificial Sequence; identical to SEQ ID NO: 30058
  derived and/or modified sequence opt5 from anti-influenza_CDR

SEQ ID NO: 45343 - RNA, 33 nt, Artificial Sequence; identical to SEQ ID NO: 30059
  derived and/or modified sequence opt5 from anti-influenza_CDR

SEQ ID NO: 45344 - RNA, 33 nt, Artificial Sequence; identical to SEQ ID NO: 30060
  derived and/or modified sequence opt5 from anti-influenza_CDR

SEQ ID NO: 45345 - RNA, 33 nt, Artificial Sequence; identical to SEQ ID NO: 30061
  derived and/or modified sequence opt5 from anti-influenza_CDR

SEQ ID NO: 45346 - RNA, 33 nt, Artificial Sequence
  derived and/or modified sequence opt5 from anti-influenza_CDR
agagccagccaguccguggcuaacaaucuggcc

SEQ ID NO: 45347 - RNA, 33 nt, Artificial Sequence; identical to SEQ ID NO: 30063
  derived and/or modified sequence opt5 from anti-influenza_CDR

SEQ ID NO: 45348 - RNA, 33 nt, Artificial Sequence; identical to SEQ ID NO: 30064
  derived and/or modified sequence opt5 from anti-influenza_CDR

SEQ ID NO: 45349 - RNA, 33 nt, Artificial Sequence; identical to SEQ ID NO: 30065
  derived and/or modified sequence opt5 from anti-influenza_CDR

SEQ ID NO: 45350 - RNA, 33 nt, Artificial Sequence; identical to SEQ ID NO: 30066
  derived and/or modified sequence opt5 from anti-influenza_CDR

SEQ ID NO: 45351 - RNA, 33 nt, Artificial Sequence; identical to SEQ ID NO: 30067
  derived and/or modified sequence opt5 from anti-influenza_CDR

SEQ ID NO: 45352 - RNA, 33 nt, Artificial Sequence
  derived and/or modified sequence opt5 from anti-influenza_CDR
caggugugggacaugagcuccgauagacggguc

SEQ ID NO: 45353 - RNA, 33 nt, Artificial Sequence; identical to SEQ ID NO: 30069
  derived and/or modified sequence opt5 from anti-influenza_CDR

SEQ ID NO: 45354 - RNA, 33 nt, Artificial Sequence; identical to SEQ ID NO: 14786
  derived and/or modified sequence opt5 from anti-influenza_CDR

SEQ ID NO: 45355 - RNA, 33 nt, Artificial Sequence; identical to SEQ ID NO: 28982
  derived and/or modified sequence opt5 from anti-influenza_CDR

SEQ ID NO: 45356 - RNA, 33 nt, Artificial Sequence; identical to SEQ ID NO: 30072
  derived and/or modified sequence opt5 from anti-influenza_CDR

SEQ ID NO: 45357 - RNA, 33 nt, Artificial Sequence; identical to SEQ ID NO: 30073
  derived and/or modified sequence opt5 from anti-influenza_CDR

SEQ ID NO: 45358 - RNA, 33 nt, Artificial Sequence; identical to SEQ ID NO: 30074
  derived and/or modified sequence opt5 from anti-influenza_CDR

SEQ ID NO: 45359 - RNA, 33 nt, Artificial Sequence; identical to SEQ ID NO: 30075
  derived and/or modified sequence opt5 from anti-influenza_CDR

SEQ ID NO: 45360 - RNA, 33 nt, Artificial Sequence; identical to SEQ ID NO: 30076
  derived and/or modified sequence opt5 from anti-influenza_CDR

SEQ ID NO: 45361 - RNA, 33 nt, Artificial Sequence
  derived and/or modified sequence opt5 from anti-influenza_CDR
agagccagccgguccaucaccacauuccuggcu

SEQ ID NO: 45362 - RNA, 33 nt, Artificial Sequence; identical to SEQ ID NO: 30078
  derived and/or modified sequence opt5 from anti-influenza_CDR

SEQ ID NO: 45363 - RNA, 33 nt, Artificial Sequence
  derived and/or modified sequence opt5 from anti-influenza_CDR
agagccagccaguccgugucuagcuccuaccug

SEQ ID NO: 45364 - RNA, 36 nt, Artificial Sequence; identical to SEQ ID NO: 30080
  derived and/or modified sequence opt5 from anti-influenza_CDR

SEQ ID NO: 45365 - RNA, 36 nt, Artificial Sequence; identical to SEQ ID NO: 30081
  derived and/or modified sequence opt5 from anti-influenza_CDR

SEQ ID NO: 45366 - RNA, 36 nt, Artificial Sequence; identical to SEQ ID NO: 30082
  derived and/or modified sequence opt5 from anti-influenza_CDR

SEQ ID NO: 45367 - RNA, 36 nt, Artificial Sequence; identical to SEQ ID NO: 30083
  derived and/or modified sequence opt5 from anti-influenza_CDR

SEQ ID NO: 45368 - RNA, 36 nt, Artificial Sequence; identical to SEQ ID NO: 30084
  derived and/or modified sequence opt5 from anti-influenza_CDR

SEQ ID NO: 45369 - RNA, 36 nt, Artificial Sequence
  derived and/or modified sequence opt5 from anti-influenza_CDR
gugggcaccgggggaaucgucggcagcaagggggac

SEQ ID NO: 45370 - RNA, 36 nt, Artificial Sequence
  derived and/or modified sequence opt5 from anti-influenza_CDR
agauacagccgguccucucccggcaccuucgagagc

SEQ ID NO: 45371 - RNA, 36 nt, Artificial Sequence
  derived and/or modified sequence opt5 from anti-influenza_CDR
cagagcuacgacuccucucugagcggcuuccacgug

SEQ ID NO: 45372 - RNA, 36 nt, Artificial Sequence
  derived and/or modified sequence opt5 from anti-influenza_CDR
agagccagccaguccgugucuagcucccaacuggcu

SEQ ID NO: 45373 - RNA, 36 nt, Artificial Sequence
  derived and/or modified sequence opt5 from anti-influenza_CDR
agagccagccaguucguguccacccggucucuggcu

SEQ ID NO: 45374 - RNA, 36 nt, Artificial Sequence; identical to SEQ ID NO: 30090
  derived and/or modified sequence opt5 from anti-influenza_CDR

SEQ ID NO: 45375 - RNA, 36 nt, Artificial Sequence
  derived and/or modified sequence opt5 from anti-influenza_CDR
agagccagccacuucgugaacuaccggucccuggcu

SEQ ID NO: 45376 - RNA, 36 nt, Artificial Sequence
  derived and/or modified sequence opt5 from anti-influenza_CDR
agagccagccacuucgugaucggccgggcugucgcc

SEQ ID NO: 45377 - RNA, 36 nt, Artificial Sequence; identical to SEQ ID NO: 30093
  derived and/or modified sequence opt5 from anti-influenza_CDR

SEQ ID NO: 45378 - RNA, 36 nt, Artificial Sequence; identical to SEQ ID NO: 14810
  derived and/or modified sequence opt5 from anti-influenza_CDR

SEQ ID NO: 45379 - RNA, 36 nt, Artificial Sequence
  derived and/or modified sequence opt5 from anti-influenza_CDR
gugggcaacgggggaaaugucgccagcaagggcgac

SEQ ID NO: 45380 - RNA, 36 nt, Artificial Sequence; identical to SEQ ID NO: 30096
  derived and/or modified sequence opt5 from anti-influenza_CDR

SEQ ID NO: 45381 - RNA, 36 nt, Artificial Sequence
  derived and/or modified sequence opt5 from anti-influenza_CDR
ugccugagcagaaugcggggcuacgggcucgacgug

SEQ ID NO: 45382 - RNA, 36 nt, Artificial Sequence; identical to SEQ ID NO: 30098
  derived and/or modified sequence opt5 from anti-influenza_CDR

SEQ ID NO: 45383 - RNA, 36 nt, Artificial Sequence; identical to SEQ ID NO: 30099
  derived and/or modified sequence opt5 from anti-influenza_CDR

SEQ ID NO: 45384 - RNA, 36 nt, Artificial Sequence; identical to SEQ ID NO: 30100
  derived and/or modified sequence opt5 from anti-influenza_CDR

SEQ ID NO: 45385 - RNA, 36 nt, Artificial Sequence; identical to SEQ ID NO: 30101
  derived and/or modified sequence opt5 from anti-influenza_CDR

SEQ ID NO: 45386 - RNA, 36 nt, Artificial Sequence
  derived and/or modified sequence opt5 from anti-influenza_CDR
ccccugggcauccuccacuacuaugccauggaccug

SEQ ID NO: 45387 - RNA, 36 nt, Artificial Sequence; identical to SEQ ID NO: 30103
  derived and/or modified sequence opt5 from anti-influenza_CDR

SEQ ID NO: 45388 - RNA, 36 nt, Artificial Sequence
  derived and/or modified sequence opt5 from anti-influenza_CDR
ggcaucaccaacaaggugaauagcauuaucgacaaa

SEQ ID NO: 45389 - RNA, 36 nt, Artificial Sequence; identical to SEQ ID NO: 30105
  derived and/or modified sequence opt5 from anti-influenza_CDR

SEQ ID NO: 45390 - RNA, 36 nt, Artificial Sequence; identical to SEQ ID NO: 30106
  derived and/or modified sequence opt5 from anti-influenza_CDR

SEQ ID NO: 45391 - RNA, 36 nt, Artificial Sequence; identical to SEQ ID NO: 30107
  derived and/or modified sequence opt5 from anti-influenza_CDR

SEQ ID NO: 45392 - RNA, 36 nt, Artificial Sequence; identical to SEQ ID NO: 30108
  derived and/or modified sequence opt5 from anti-influenza_CDR

SEQ ID NO: 45393 - RNA, 36 nt, Artificial Sequence; identical to SEQ ID NO: 30109
  derived and/or modified sequence opt5 from anti-influenza_CDR

SEQ ID NO: 45394 - RNA, 36 nt, Artificial Sequence; identical to SEQ ID NO: 30110
  derived and/or modified sequence opt5 from anti-influenza_CDR

SEQ ID NO: 45395 - RNA, 36 nt, Artificial Sequence
  derived and/or modified sequence opt5 from anti-influenza_CDR
gccaccugggacagacggcccacagcuuacgugguc

SEQ ID NO: 45396 - RNA, 36 nt, Artificial Sequence; identical to SEQ ID NO: 30112
  derived and/or modified sequence opt5 from anti-influenza_CDR

SEQ ID NO: 45397 - RNA, 36 nt, Artificial Sequence; identical to SEQ ID NO: 30113
  derived and/or modified sequence opt5 from anti-influenza_CDR

SEQ ID NO: 45398 - RNA, 36 nt, Artificial Sequence; identical to SEQ ID NO: 14830
  derived and/or modified sequence opt5 from anti-influenza_CDR

SEQ ID NO: 45399 - RNA, 36 nt, Artificial Sequence
  derived and/or modified sequence opt5 from anti-influenza_CDR
agagccagccaguccgugucuagcuccuaccuggcu

SEQ ID NO: 45400 - RNA, 36 nt, Artificial Sequence; identical to SEQ ID NO: 30116
  derived and/or modified sequence opt5 from anti-influenza_CDR

SEQ ID NO: 45401 - RNA, 36 nt, Artificial Sequence
  derived and/or modified sequence opt5 from anti-influenza_CDR
agagccagccaguccgugucuagcaacuaccugggc

SEQ ID NO: 45402 - RNA, 36 nt, Artificial Sequence; identical to SEQ ID NO: 30118
  derived and/or modified sequence opt5 from anti-influenza_CDR

SEQ ID NO: 45403 - RNA, 36 nt, Artificial Sequence; identical to SEQ ID NO: 30119
  derived and/or modified sequence opt5 from anti-influenza_CDR

SEQ ID NO: 45404 - RNA, 36 nt, Artificial Sequence; identical to SEQ ID NO: 30120
  derived and/or modified sequence opt5 from anti-influenza_CDR

SEQ ID NO: 45405 - RNA, 36 nt, Artificial Sequence; identical to SEQ ID NO: 30121
  derived and/or modified sequence opt5 from anti-influenza_CDR

SEQ ID NO: 45406 - RNA, 36 nt, Artificial Sequence; identical to SEQ ID NO: 30122
  derived and/or modified sequence opt5 from anti-influenza_CDR

SEQ ID NO: 45407 - RNA, 36 nt, Artificial Sequence
  derived and/or modified sequence opt5 from anti-influenza_CDR
ggcgggcugaucggaaccggcagcuacuauuggggg

SEQ ID NO: 45408 - RNA, 36 nt, Artificial Sequence
  derived and/or modified sequence opt5 from anti-influenza_CDR
gccagauacaacuggggcauccgguauuucgacuuu

SEQ ID NO: 45409 - RNA, 36 nt, Artificial Sequence; identical to SEQ ID NO: 30125
  derived and/or modified sequence opt5 from anti-influenza_CDR

SEQ ID NO: 45410 - RNA, 36 nt, Artificial Sequence; identical to SEQ ID NO: 30126
  derived and/or modified sequence opt5 from anti-influenza_CDR

SEQ ID NO: 45411 - RNA, 39 nt, Artificial Sequence
  derived and/or modified sequence opt5 from anti-influenza_CDR
gccagaggcgggcgguacuauguggacuacuucgauuau

SEQ ID NO: 45412 - RNA, 39 nt, Artificial Sequence; identical to SEQ ID NO: 30128
  derived and/or modified sequence opt5 from anti-influenza_CDR

SEQ ID NO: 45413 - RNA, 39 nt, Artificial Sequence; identical to SEQ ID NO: 30129
  derived and/or modified sequence opt5 from anti-influenza_CDR

SEQ ID NO: 45414 - RNA, 39 nt, Artificial Sequence
  derived and/or modified sequence opt5 from anti-influenza_CDR
agcggcuccucuagcaacaucggguccaauaccgugaac

SEQ ID NO: 45415 - RNA, 39 nt, Artificial Sequence
  derived and/or modified sequence opt5 from anti-influenza_CDR
gacagccccuacuccucuagcugguccuucuuugauuau

SEQ ID NO: 45416 - RNA, 39 nt, Artificial Sequence; identical to SEQ ID NO: 30132
  derived and/or modified sequence opt5 from anti-influenza_CDR

SEQ ID NO: 45417 - RNA, 39 nt, Artificial Sequence; identical to SEQ ID NO: 30133
  derived and/or modified sequence opt5 from anti-influenza_CDR

SEQ ID NO: 45418 - RNA, 39 nt, Artificial Sequence
  derived and/or modified sequence opt5 from anti-influenza_CDR
uggcugagcaucauuaacgccggcgggggagacaucgau

SEQ ID NO: 45419 - RNA, 39 nt, Artificial Sequence
  derived and/or modified sequence opt5 from anti-influenza_CDR
gccgcuagcucccugcagucuggcgugcccagcagauuc

SEQ ID NO: 45420 - RNA, 39 nt, Artificial Sequence; identical to SEQ ID NO: 30136
  derived and/or modified sequence opt5 from anti-influenza_CDR

SEQ ID NO: 45421 - RNA, 39 nt, Artificial Sequence; identical to SEQ ID NO: 30137
  derived and/or modified sequence opt5 from anti-influenza_CDR

SEQ ID NO: 45422 - RNA, 39 nt, Artificial Sequence
  derived and/or modified sequence opt5 from anti-influenza_CDR
accggcagcgaguccacaacgggguacggaauggacgug

SEQ ID NO: 45423 - RNA, 39 nt, Artificial Sequence; identical to SEQ ID NO: 30139
  derived and/or modified sequence opt5 from anti-influenza_CDR

SEQ ID NO: 45424 - RNA, 39 nt, Artificial Sequence; identical to SEQ ID NO: 30140
  derived and/or modified sequence opt5 from anti-influenza_CDR

SEQ ID NO: 45425 - RNA, 39 nt, Artificial Sequence
  derived and/or modified sequence opt5 from anti-influenza_CDR
agcggcuccagaucuaacgugggggacaauagcgucuac

SEQ ID NO: 45426 - RNA, 39 nt, Artificial Sequence
  derived and/or modified sequence opt5 from anti-influenza_CDR
agcggcuccucuagcaacaucgggaaugacuacgugucc

SEQ ID NO: 45427 - RNA, 39 nt, Artificial Sequence
  derived and/or modified sequence opt5 from anti-influenza_CDR
ggcgggggaagcuacggcgccuaugagggguucgacuac

SEQ ID NO: 45428 - RNA, 39 nt, Artificial Sequence
  derived and/or modified sequence opt5 from anti-influenza_CDR
agcggcuccucuagcaacaucggguccaauuacguguau

SEQ ID NO: 45429 - RNA, 39 nt, Artificial Sequence
  derived and/or modified sequence opt5 from anti-influenza_CDR
gccagacggcagcaacuguacaagggcuauuaccaccau

SEQ ID NO: 45430 - RNA, 39 nt, Artificial Sequence
  derived and/or modified sequence opt5 from anti-influenza_CDR
agcggcuccaccucuaacaucggguacaaucccgugagc

SEQ ID NO: 45431 - RNA, 39 nt, Artificial Sequence; identical to SEQ ID NO: 30147
  derived and/or modified sequence opt5 from anti-influenza_CDR

SEQ ID NO: 45432 - RNA, 39 nt, Artificial Sequence
  derived and/or modified sequence opt5 from anti-influenza_CDR
gccagaggccacagcggguccuaccggcuguucgacuuu

SEQ ID NO: 45433 - RNA, 39 nt, Artificial Sequence
  derived and/or modified sequence opt5 from anti-influenza_CDR
gccaagccccugagaggcagcuaccgguauuucgaccuc

SEQ ID NO: 45434 - RNA, 39 nt, Artificial Sequence; identical to SEQ ID NO: 30150
  derived and/or modified sequence opt5 from anti-influenza_CDR

SEQ ID NO: 45435 - RNA, 39 nt, Artificial Sequence; identical to SEQ ID NO: 30151
  derived and/or modified sequence opt5 from anti-influenza_CDR

SEQ ID NO: 45436 - RNA, 39 nt, Artificial Sequence; identical to SEQ ID NO: 30152
  derived and/or modified sequence opt5 from anti-influenza_CDR

SEQ ID NO: 45437 - RNA, 39 nt, Artificial Sequence
  derived and/or modified sequence opt5 from anti-influenza_CDR
cagagcucccaaucuguggacagcaacaaucagcugucc

SEQ ID NO: 45438 - RNA, 39 nt, Artificial Sequence; identical to SEQ ID NO: 30154
  derived and/or modified sequence opt5 from anti-influenza_CDR

SEQ ID NO: 45439 - RNA, 39 nt, Artificial Sequence
  derived and/or modified sequence opt5 from anti-influenza_CDR
cagagcucccaaucuguguacaacaauaacagacugagc

SEQ ID NO: 45440 - RNA, 39 nt, Artificial Sequence; identical to SEQ ID NO: 30156
  derived and/or modified sequence opt5 from anti-influenza_CDR

SEQ ID NO: 45441 - RNA, 39 nt, Artificial Sequence
  derived and/or modified sequence opt5 from anti-influenza_CDR
ggcgggggauucggcuggagccagaccuacuuuggguau

SEQ ID NO: 45442 - RNA, 42 nt, Artificial Sequence
  derived and/or modified sequence opt5 from anti-influenza_CDR
uggcugggcagaaccuacuaucggagcaagugguacaacgac

SEQ ID NO: 45443 - RNA, 42 nt, Artificial Sequence
  derived and/or modified sequence opt5 from anti-influenza_CDR
ggcgggcuggugggaggcuacgacgaguauuucuuugauuac

SEQ ID NO: 45444 - RNA, 42 nt, Artificial Sequence; identical to SEQ ID NO: 30160
  derived and/or modified sequence opt5 from anti-influenza_CDR

SEQ ID NO: 45445 - RNA, 42 nt, Artificial Sequence
  derived and/or modified sequence opt5 from anti-influenza_CDR
accggcagcuccucugacgugggggccagcaacuccgucucu

SEQ ID NO: 45446 - RNA, 42 nt, Artificial Sequence; identical to SEQ ID NO: 30162
  derived and/or modified sequence opt5 from anti-influenza_CDR

SEQ ID NO: 45447 - RNA, 42 nt, Artificial Sequence
  derived and/or modified sequence opt5 from anti-influenza_CDR
accggcagcuccucuaacaucgggagcgacuacgaugugcac

SEQ ID NO: 45448 - RNA, 42 nt, Artificial Sequence; identical to SEQ ID NO: 30164
  derived and/or modified sequence opt5 from anti-influenza_CDR

SEQ ID NO: 45449 - RNA, 42 nt, Artificial Sequence
  derived and/or modified sequence opt5 from anti-influenza_CDR
gccagcuccaccggcgcugugacaucuagcuacuuccccaac

SEQ ID NO: 45450 - RNA, 42 nt, Artificial Sequence
  derived and/or modified sequence opt5 from anti-influenza_CDR
accggcgggagcuccgacaucggagccucuaacagcgugucc

SEQ ID NO: 45451 - RNA, 42 nt, Artificial Sequence
  derived and/or modified sequence opt5 from anti-influenza_CDR
accggcagcuccucugacgucgggggauacgauuaugugagc

SEQ ID NO: 45452 - RNA, 42 nt, Artificial Sequence; identical to SEQ ID NO: 30168
  derived and/or modified sequence opt5 from anti-influenza_CDR

SEQ ID NO: 45453 - RNA, 42 nt, Artificial Sequence; identical to SEQ ID NO: 30169
  derived and/or modified sequence opt5 from anti-influenza_CDR

SEQ ID NO: 45454 - RNA, 42 nt, Artificial Sequence; identical to SEQ ID NO: 30170
  derived and/or modified sequence opt5 from anti-influenza_CDR

SEQ ID NO: 45455 - RNA, 42 nt, Artificial Sequence; identical to SEQ ID NO: 30171
  derived and/or modified sequence opt5 from anti-influenza_CDR

SEQ ID NO: 45456 - RNA, 42 nt, Artificial Sequence; identical to SEQ ID NO: 30172
  derived and/or modified sequence opt5 from anti-influenza_CDR

SEQ ID NO: 45457 - RNA, 42 nt, Artificial Sequence; identical to SEQ ID NO: 30173
  derived and/or modified sequence opt5 from anti-influenza_CDR

SEQ ID NO: 45458 - RNA, 42 nt, Artificial Sequence; identical to SEQ ID NO: 30174
  derived and/or modified sequence opt5 from anti-influenza_CDR

SEQ ID NO: 45459 - RNA, 42 nt, Artificial Sequence
  derived and/or modified sequence opt5 from anti-influenza_CDR
gccgagagacccaaggugcggggccaggcugggcgcaugaac

SEQ ID NO: 45460 - RNA, 42 nt, Artificial Sequence
  derived and/or modified sequence opt5 from anti-influenza_CDR
ggcagcagacccugggugcgcggggucuccucucggaucagc

SEQ ID NO: 45461 - RNA, 42 nt, Artificial Sequence
  derived and/or modified sequence opt5 from anti-influenza_CDR
aucuggggcguggccgcucccgggaccgccgcggcucagauu

SEQ ID NO: 45462 - RNA, 42 nt, Artificial Sequence; identical to SEQ ID NO: 30178
  derived and/or modified sequence opt5 from anti-influenza_CDR

SEQ ID NO: 45463 - RNA, 42 nt, Artificial Sequence
  derived and/or modified sequence opt5 from anti-influenza_CDR
gccagaggccccgaggggguguggggacggagcaucgacucc

SEQ ID NO: 45464 - RNA, 42 nt, Artificial Sequence
  derived and/or modified sequence opt5 from anti-influenza_CDR
gccagagaccccgauaccccuuucgugcgggcuuuugacagc

SEQ ID NO: 45465 - RNA, 42 nt, Artificial Sequence
  derived and/or modified sequence opt5 from anti-influenza_CDR
accggcagcacauccgacaucgggucuuacaacuaugugagc

SEQ ID NO: 45466 - RNA, 42 nt, Artificial Sequence; identical to SEQ ID NO: 30182
  derived and/or modified sequence opt5 from anti-influenza_CDR

SEQ ID NO: 45467 - RNA, 42 nt, Artificial Sequence; identical to SEQ ID NO: 30183
  derived and/or modified sequence opt5 from anti-influenza_CDR

SEQ ID NO: 45468 - RNA, 42 nt, Artificial Sequence
  derived and/or modified sequence opt5 from anti-influenza_CDR
ggccccggguacagcggauaucacuacggcugguucgacacc

SEQ ID NO: 45469 - RNA, 42 nt, Artificial Sequence; identical to SEQ ID NO: 30185
  derived and/or modified sequence opt5 from anti-influenza_CDR

SEQ ID NO: 45470 - RNA, 45 nt, Artificial Sequence
  derived and/or modified sequence opt5 from anti-influenza_CDR
gccagagcuggcaccacacugacgcgguucaacugguuugacccc

SEQ ID NO: 45471 - RNA, 45 nt, Artificial Sequence
  derived and/or modified sequence opt5 from anti-influenza_CDR
gccagagcuggcaccacagugacgcgguucaacugguuugacccc

SEQ ID NO: 45472 - RNA, 45 nt, Artificial Sequence
  derived and/or modified sequence opt5 from anti-influenza_CDR
gccagaggccagcgguacuauuacgaccgcgaugggauggacgug

SEQ ID NO: 45473 - RNA, 45 nt, Artificial Sequence; identical to SEQ ID NO: 30189
  derived and/or modified sequence opt5 from anti-influenza_CDR

SEQ ID NO: 45474 - RNA, 45 nt, Artificial Sequence; identical to SEQ ID NO: 30190
  derived and/or modified sequence opt5 from anti-influenza_CDR

SEQ ID NO: 45475 - RNA, 45 nt, Artificial Sequence; identical to SEQ ID NO: 30191
  derived and/or modified sequence opt5 from anti-influenza_CDR

SEQ ID NO: 45476 - RNA, 45 nt, Artificial Sequence; identical to SEQ ID NO: 30192
  derived and/or modified sequence opt5 from anti-influenza_CDR

SEQ ID NO: 45477 - RNA, 45 nt, Artificial Sequence; identical to SEQ ID NO: 30193
  derived and/or modified sequence opt5 from anti-influenza_CDR

SEQ ID NO: 45478 - RNA, 45 nt, Artificial Sequence; identical to SEQ ID NO: 30194
  derived and/or modified sequence opt5 from anti-influenza_CDR

SEQ ID NO: 45479 - RNA, 45 nt, Artificial Sequence; identical to SEQ ID NO: 30195
  derived and/or modified sequence opt5 from anti-influenza_CDR

SEQ ID NO: 45480 - RNA, 45 nt, Artificial Sequence; identical to SEQ ID NO: 30196
  derived and/or modified sequence opt5 from anti-influenza_CDR

SEQ ID NO: 45481 - RNA, 45 nt, Artificial Sequence; identical to SEQ ID NO: 30197
  derived and/or modified sequence opt5 from anti-influenza_CDR

SEQ ID NO: 45482 - RNA, 45 nt, Artificial Sequence; identical to SEQ ID NO: 30198
  derived and/or modified sequence opt5 from anti-influenza_CDR

SEQ ID NO: 45483 - RNA, 45 nt, Artificial Sequence
  derived and/or modified sequence opt5 from anti-influenza_CDR
gccagagcucacaccgcccugacacgguuccgcuggcucgacccc

SEQ ID NO: 45484 - RNA, 45 nt, Artificial Sequence; identical to SEQ ID NO: 30200
  derived and/or modified sequence opt5 from anti-influenza_CDR

SEQ ID NO: 45485 - RNA, 45 nt, Artificial Sequence; identical to SEQ ID NO: 30201
  derived and/or modified sequence opt5 from anti-influenza_CDR

SEQ ID NO: 45486 - RNA, 45 nt, Artificial Sequence
  derived and/or modified sequence opt5 from anti-influenza_CDR
gccagacggggcgggggauggcaguacuauuacggcauggacgug

SEQ ID NO: 45487 - RNA, 48 nt, Artificial Sequence; identical to SEQ ID NO: 30203
  derived and/or modified sequence opt5 from anti-influenza_CDR

SEQ ID NO: 45488 - RNA, 48 nt, Artificial Sequence
  derived and/or modified sequence opt5 from anti-influenza_CDR
ggcgggcacaucaccguguucggacugaacauugacgccuacgauauc

SEQ ID NO: 45489 - RNA, 48 nt, Artificial Sequence
  derived and/or modified sequence opt5 from anti-influenza_CDR
ggcgggcacaucaccgaguucggacugaacauugacgccuacgauauc

SEQ ID NO: 45490 - RNA, 48 nt, Artificial Sequence
  derived and/or modified sequence opt5 from anti-influenza_CDR
ggcgggcacaucaccguguucggagucaacauugacgccuuugauauc

SEQ ID NO: 45491 - RNA, 48 nt, Artificial Sequence; identical to SEQ ID NO: 30207
  derived and/or modified sequence opt5 from anti-influenza_CDR

SEQ ID NO: 45492 - RNA, 48 nt, Artificial Sequence; identical to SEQ ID NO: 30208
  derived and/or modified sequence opt5 from anti-influenza_CDR

SEQ ID NO: 45493 - RNA, 48 nt, Artificial Sequence; identical to SEQ ID NO: 30209
  derived and/or modified sequence opt5 from anti-influenza_CDR

SEQ ID NO: 45494 - RNA, 48 nt, Artificial Sequence
  derived and/or modified sequence opt5 from anti-influenza_CDR
gccagagcuggcgugaagaucuucgggcugauugucggagcccucgac

SEQ ID NO: 45495 - RNA, 48 nt, Artificial Sequence; identical to SEQ ID NO: 30211
  derived and/or modified sequence opt5 from anti-influenza_CDR

SEQ ID NO: 45496 - RNA, 48 nt, Artificial Sequence; identical to SEQ ID NO: 30212
  derived and/or modified sequence opt5 from anti-influenza_CDR

SEQ ID NO: 45497 - RNA, 48 nt, Artificial Sequence; identical to SEQ ID NO: 30213
  derived and/or modified sequence opt5 from anti-influenza_CDR

SEQ ID NO: 45498 - RNA, 48 nt, Artificial Sequence; identical to SEQ ID NO: 30214
  derived and/or modified sequence opt5 from anti-influenza_CDR

SEQ ID NO: 45499 - RNA, 48 nt, Artificial Sequence; identical to SEQ ID NO: 30215
  derived and/or modified sequence opt5 from anti-influenza_CDR

SEQ ID NO: 45500 - RNA, 48 nt, Artificial Sequence
  derived and/or modified sequence opt5 from anti-influenza_CDR
cugaucuacugggacgaugacaagagauauagccccucccucaaacgg

SEQ ID NO: 45501 - RNA, 48 nt, Artificial Sequence; identical to SEQ ID NO: 30217
  derived and/or modified sequence opt5 from anti-influenza_CDR

SEQ ID NO: 45502 - RNA, 48 nt, Artificial Sequence
  derived and/or modified sequence opt5 from anti-influenza_CDR
gagaucagccacggcgggagcaccaacuacaaucccucucugaagucc

SEQ ID NO: 45503 - RNA, 48 nt, Artificial Sequence; identical to SEQ ID NO: 30219
  derived and/or modified sequence opt5 from anti-influenza_CDR

SEQ ID NO: 45504 - RNA, 48 nt, Artificial Sequence
  derived and/or modified sequence opt5 from anti-influenza_CDR
cugaucagcugggacgaugagaagcacuacucccccucucuccagagc

SEQ ID NO: 45505 - RNA, 48 nt, Artificial Sequence; identical to SEQ ID NO: 30221
  derived and/or modified sequence opt5 from anti-influenza_CDR

SEQ ID NO: 45506 - RNA, 48 nt, Artificial Sequence
  derived and/or modified sequence opt5 from anti-influenza_CDR
uacaucuaucacagcggcagcaccaacuacaaucccucucugaagucc

SEQ ID NO: 45507 - RNA, 48 nt, Artificial Sequence; identical to SEQ ID NO: 30223
  derived and/or modified sequence opt5 from anti-influenza_CDR

SEQ ID NO: 45508 - RNA, 48 nt, Artificial Sequence
  derived and/or modified sequence opt5 from anti-influenza_CDR
uacaucagcuauuccggcucuaccaaguacaaccccagccugagaucc

SEQ ID NO: 45509 - RNA, 48 nt, Artificial Sequence; identical to SEQ ID NO: 30225
  derived and/or modified sequence opt5 from anti-influenza_CDR

SEQ ID NO: 45510 - RNA, 48 nt, Artificial Sequence; identical to SEQ ID NO: 30226
  derived and/or modified sequence opt5 from anti-influenza_CDR

SEQ ID NO: 45511 - RNA, 48 nt, Artificial Sequence
  derived and/or modified sequence opt5 from anti-influenza_CDR
uucauguacuauagcgccagcaccuacuauaaccccucucugaagucc

SEQ ID NO: 45512 - RNA, 48 nt, Artificial Sequence
  derived and/or modified sequence opt5 from anti-influenza_CDR
uacguguauuacagcggcagcaccacauauaaccccucucugaagucc

SEQ ID NO: 45513 - RNA, 48 nt, Artificial Sequence; identical to SEQ ID NO: 30229
  derived and/or modified sequence opt5 from anti-influenza_CDR

SEQ ID NO: 45514 - RNA, 48 nt, Artificial Sequence; identical to SEQ ID NO: 30230
  derived and/or modified sequence opt5 from anti-influenza_CDR

SEQ ID NO: 45515 - RNA, 48 nt, Artificial Sequence; identical to SEQ ID NO: 30231
  derived and/or modified sequence opt5 from anti-influenza_CDR

SEQ ID NO: 45516 - RNA, 48 nt, Artificial Sequence; identical to SEQ ID NO: 30232
  derived and/or modified sequence opt5 from anti-influenza_CDR

SEQ ID NO: 45517 - RNA, 48 nt, Artificial Sequence; identical to SEQ ID NO: 30233
  derived and/or modified sequence opt5 from anti-influenza_CDR

SEQ ID NO: 45518 - RNA, 48 nt, Artificial Sequence; identical to SEQ ID NO: 30234
  derived and/or modified sequence opt5 from anti-influenza_CDR

SEQ ID NO: 45519 - RNA, 48 nt, Artificial Sequence
  derived and/or modified sequence opt5 from anti-influenza_CDR
uacguguauaacagaggcagcaccaaguacucccccucucugaaaagc

SEQ ID NO: 45520 - RNA, 48 nt, Artificial Sequence; identical to SEQ ID NO: 30236
  derived and/or modified sequence opt5 from anti-influenza_CDR

SEQ ID NO: 45521 - RNA, 48 nt, Artificial Sequence
  derived and/or modified sequence opt5 from anti-influenza_CDR
uaccuguauuacagcggcuccaccaaguauaaccccucucucaaaagc

SEQ ID NO: 45522 - RNA, 48 nt, Artificial Sequence; identical to SEQ ID NO: 30238
  derived and/or modified sequence opt5 from anti-influenza_CDR

SEQ ID NO: 45523 - RNA, 48 nt, Artificial Sequence
  derived and/or modified sequence opt5 from anti-influenza_CDR
cacaucuucgacagcggcagcaccuacuauaaccccucucugaagucc

SEQ ID NO: 45524 - RNA, 48 nt, Artificial Sequence; identical to SEQ ID NO: 30240
  derived and/or modified sequence opt5 from anti-influenza_CDR

SEQ ID NO: 45525 - RNA, 48 nt, Artificial Sequence; identical to SEQ ID NO: 30241
  derived and/or modified sequence opt5 from anti-influenza_CDR

SEQ ID NO: 45526 - RNA, 48 nt, Artificial Sequence
  derived and/or modified sequence opt5 from anti-influenza_CDR
agaagcucccagucucugcuccacagcaacggcuacaauuaucuggac

SEQ ID NO: 45527 - RNA, 48 nt, Artificial Sequence
  derived and/or modified sequence opt5 from anti-influenza_CDR
accaucuaccacagcggcagcacauauuacaaccccucucugaagucc

SEQ ID NO: 45528 - RNA, 48 nt, Artificial Sequence
  derived and/or modified sequence opt5 from anti-influenza_CDR
agaagcucccagucucugcuccacagcaacggccauaucuacuucgac

SEQ ID NO: 45529 - RNA, 48 nt, Artificial Sequence
  derived and/or modified sequence opt5 from anti-influenza_CDR
aucuggggcguggccgcucccagcaccgccuccgcgcagacaucucug

SEQ ID NO: 45530 - RNA, 48 nt, Artificial Sequence
  derived and/or modified sequence opt5 from anti-influenza_CDR
agaagcucccagucucugcucuacaccgacggcuucacauaucugagc

SEQ ID NO: 45531 - RNA, 48 nt, Artificial Sequence
  derived and/or modified sequence opt5 from anti-influenza_CDR
gccaagcccagacuggacuaccucgauuauuuccacgcugccgacagc

SEQ ID NO: 45532 - RNA, 48 nt, Artificial Sequence; identical to SEQ ID NO: 30248
  derived and/or modified sequence opt5 from anti-influenza_CDR

SEQ ID NO: 45533 - RNA, 48 nt, Artificial Sequence
  derived and/or modified sequence opt5 from anti-influenza_CDR
gccaucgcuggcagcggguccgccgacuacgcgucuugggcuaaggga

SEQ ID NO: 45534 - RNA, 48 nt, Artificial Sequence
  derived and/or modified sequence opt5 from anti-influenza_CDR
gccaucgcuggcagcggguccgccgacuacgcgucuugggcuaagagc

SEQ ID NO: 45535 - RNA, 48 nt, Artificial Sequence
  derived and/or modified sequence opt5 from anti-influenza_CDR
gccaucggcgggggaggcagcgcugacuacgccuccugggcgaagucu

SEQ ID NO: 45536 - RNA, 48 nt, Artificial Sequence
  derived and/or modified sequence opt5 from anti-influenza_CDR
agaagcucccagucucugcuccggagcaacggcuacaauuaucuggac

SEQ ID NO: 45537 - RNA, 48 nt, Artificial Sequence; identical to SEQ ID NO: 30253
  derived and/or modified sequence opt5 from anti-influenza_CDR

SEQ ID NO: 45538 - RNA, 51 nt, Artificial Sequence; identical to SEQ ID NO: 30254
  derived and/or modified sequence opt5 from anti-influenza_CDR

SEQ ID NO: 45539 - RNA, 51 nt, Artificial Sequence
  derived and/or modified sequence opt5 from anti-influenza_CDR
gccagagcugagaaccugcucagccccuaccuggccgaaggcuucgacccu

SEQ ID NO: 45540 - RNA, 51 nt, Artificial Sequence; identical to SEQ ID NO: 30256
  derived and/or modified sequence opt5 from anti-influenza_CDR

SEQ ID NO: 45541 - RNA, 51 nt, Artificial Sequence
  derived and/or modified sequence opt5 from anti-influenza_CDR
ggcaccaucccccugcucgggacaacgaacuacgcccagaaguuccaagga

SEQ ID NO: 45542 - RNA, 51 nt, Artificial Sequence
  derived and/or modified sequence opt5 from anti-influenza_CDR
ggcaucauugccguguucaacaccgcuaauuacgcccagaaguuucaaggg

SEQ ID NO: 45543 - RNA, 51 nt, Artificial Sequence; identical to SEQ ID NO: 30259
  derived and/or modified sequence opt5 from anti-influenza_CDR

SEQ ID NO: 45544 - RNA, 51 nt, Artificial Sequence; identical to SEQ ID NO: 30260
  derived and/or modified sequence opt5 from anti-influenza_CDR

SEQ ID NO: 45545 - RNA, 51 nt, Artificial Sequence; identical to SEQ ID NO: 30261
  derived and/or modified sequence opt5 from anti-influenza_CDR

SEQ ID NO: 45546 - RNA, 51 nt, Artificial Sequence
  derived and/or modified sequence opt5 from anti-influenza_CDR
ggcaucauuccccugaucaacgccccuaauuacgcuccgaaguuccagggg

SEQ ID NO: 45547 - RNA, 51 nt, Artificial Sequence; identical to SEQ ID NO: 30263
  derived and/or modified sequence opt5 from anti-influenza_CDR

SEQ ID NO: 45548 - RNA, 51 nt, Artificial Sequence
  derived and/or modified sequence opt5 from anti-influenza_CDR
ggcaucauuccccuguucggggccgcuaaguacgcccagaaauuucaagga

SEQ ID NO: 45549 - RNA, 51 nt, Artificial Sequence
  derived and/or modified sequence opt5 from anti-influenza_CDR
aagagcucccagagagugcuguacucuagcaacaauaaaaacuaucucgcc

SEQ ID NO: 45550 - RNA, 51 nt, Artificial Sequence; identical to SEQ ID NO: 30266
  derived and/or modified sequence opt5 from anti-influenza_CDR

SEQ ID NO: 45551 - RNA, 51 nt, Artificial Sequence; identical to SEQ ID NO: 30267
  derived and/or modified sequence opt5 from anti-influenza_CDR

SEQ ID NO: 45552 - RNA, 51 nt, Artificial Sequence; identical to SEQ ID NO: 30268
  derived and/or modified sequence opt5 from anti-influenza_CDR

SEQ ID NO: 45553 - RNA, 51 nt, Artificial Sequence
  derived and/or modified sequence opt5 from anti-influenza_CDR
guggagggcagcuacagagacuucuggaacaaucagaaccgguuugauccc

SEQ ID NO: 45554 - RNA, 51 nt, Artificial Sequence; identical to SEQ ID NO: 30270
  derived and/or modified sequence opt5 from anti-influenza_CDR

SEQ ID NO: 45555 - RNA, 51 nt, Artificial Sequence
  derived and/or modified sequence opt5 from anti-influenza_CDR
aagagcucccagucugugcuguacagcuccaacaauaaaucucaccucgcc

SEQ ID NO: 45556 - RNA, 51 nt, Artificial Sequence; identical to SEQ ID NO: 30272
  derived and/or modified sequence opt5 from anti-influenza_CDR

SEQ ID NO: 45557 - RNA, 51 nt, Artificial Sequence
  derived and/or modified sequence opt5 from anti-influenza_CDR
ggcaucauucccguguucccuaccccgaacuacgcccagauguuucaaggg

SEQ ID NO: 45558 - RNA, 51 nt, Artificial Sequence; identical to SEQ ID NO: 30274
  derived and/or modified sequence opt5 from anti-influenza_CDR

SEQ ID NO: 45559 - RNA, 51 nt, Artificial Sequence; identical to SEQ ID NO: 30275
  derived and/or modified sequence opt5 from anti-influenza_CDR

SEQ ID NO: 45560 - RNA, 51 nt, Artificial Sequence
  derived and/or modified sequence opt5 from anti-influenza_CDR
agaagcucccagucuaucuuccacaacagcaauaacgagaauuaccuggcc

SEQ ID NO: 45561 - RNA, 51 nt, Artificial Sequence; identical to SEQ ID NO: 30277
  derived and/or modified sequence opt5 from anti-influenza_CDR

SEQ ID NO: 45562 - RNA, 51 nt, Artificial Sequence; identical to SEQ ID NO: 30278
  derived and/or modified sequence opt5 from anti-influenza_CDR

SEQ ID NO: 45563 - RNA, 51 nt, Artificial Sequence; identical to SEQ ID NO: 30279
  derived and/or modified sequence opt5 from anti-influenza_CDR

SEQ ID NO: 45564 - RNA, 51 nt, Artificial Sequence
  derived and/or modified sequence opt5 from anti-influenza_CDR
aacaucaagcaggacggcagagagaaauacuauguggauagccugcggggg

SEQ ID NO: 45565 - RNA, 51 nt, Artificial Sequence
  derived and/or modified sequence opt5 from anti-influenza_CDR
ggcaucauugccaucuucgggacccccaaguacgcucagaaauuucaagga

SEQ ID NO: 45566 - RNA, 51 nt, Artificial Sequence
  derived and/or modified sequence opt5 from anti-influenza_CDR
aagagcucccagucuauccugaacagcuccaauaacaaaaauuaccucgcc

SEQ ID NO: 45567 - RNA, 51 nt, Artificial Sequence; identical to SEQ ID NO: 30283
  derived and/or modified sequence opt5 from anti-influenza_CDR

SEQ ID NO: 45568 - RNA, 51 nt, Artificial Sequence; identical to SEQ ID NO: 30284
  derived and/or modified sequence opt5 from anti-influenza_CDR

SEQ ID NO: 45569 - RNA, 51 nt, Artificial Sequence
  derived and/or modified sequence opt5 from anti-influenza_CDR
ggcaucauugccaucuuccacacccccaaguacgcucagaaauuucaaggg

SEQ ID NO: 45570 - RNA, 51 nt, Artificial Sequence
  derived and/or modified sequence opt5 from anti-influenza_CDR
ggcaucagccccauguucgggaccacaacguacgcccagaaguuucaagga

SEQ ID NO: 45571 - RNA, 51 nt, Artificial Sequence
  derived and/or modified sequence opt5 from anti-influenza_CDR
aagagcucccagucugugcuguacagcuccaacaauaaaaacuaucucgcc

SEQ ID NO: 45572 - RNA, 51 nt, Artificial Sequence
  derived and/or modified sequence opt5 from anti-influenza_CDR
ggcaucauucccaucuucgggaccacaaaguacgccccuaaauuucaggga

SEQ ID NO: 45573 - RNA, 51 nt, Artificial Sequence; identical to SEQ ID NO: 30289
  derived and/or modified sequence opt5 from anti-influenza_CDR

SEQ ID NO: 45574 - RNA, 51 nt, Artificial Sequence
  derived and/or modified sequence opt5 from anti-influenza_CDR
ggcaucauggggauguucggaaccacaaacuacgcccagaaguuucaaggc

SEQ ID NO: 45575 - RNA, 51 nt, Artificial Sequence
  derived and/or modified sequence opt5 from anti-influenza_CDR
ggcaucauugggauguucggaagcaccaacuacgcccagaauuuucaaggc

SEQ ID NO: 45576 - RNA, 51 nt, Artificial Sequence; identical to SEQ ID NO: 30292
  derived and/or modified sequence opt5 from anti-influenza_CDR

SEQ ID NO: 45577 - RNA, 51 nt, Artificial Sequence
  derived and/or modified sequence opt5 from anti-influenza_CDR
gccaucagcuccucuggcgacagcaccuacuaugcugauuccgugaagggg

SEQ ID NO: 45578 - RNA, 51 nt, Artificial Sequence
  derived and/or modified sequence opt5 from anti-influenza_CDR
agcaucuccucuagcuccucuuacauuuauuacguggacagcgucaagggc

SEQ ID NO: 45579 - RNA, 51 nt, Artificial Sequence; identical to SEQ ID NO: 30295
  derived and/or modified sequence opt5 from anti-influenza_CDR

SEQ ID NO: 45580 - RNA, 51 nt, Artificial Sequence; identical to SEQ ID NO: 30296
  derived and/or modified sequence opt5 from anti-influenza_CDR

SEQ ID NO: 45581 - RNA, 51 nt, Artificial Sequence
  derived and/or modified sequence opt5 from anti-influenza_CDR
ggcaucauugccaucuucgggaccgcuaacuacgcccagaaguuucaagga

SEQ ID NO: 45582 - RNA, 51 nt, Artificial Sequence
  derived and/or modified sequence opt5 from anti-influenza_CDR
ggcaucauucccaucuucgggaccacaaacuacgcccagaaguuucaagga

SEQ ID NO: 45583 - RNA, 51 nt, Artificial Sequence; identical to SEQ ID NO: 30299
  derived and/or modified sequence opt5 from anti-influenza_CDR

SEQ ID NO: 45584 - RNA, 51 nt, Artificial Sequence
  derived and/or modified sequence opt5 from anti-influenza_CDR
ggcaucauugggauguucggaaccgccaacuacgcucagaaguuucaaggc

SEQ ID NO: 45585 - RNA, 51 nt, Artificial Sequence; identical to SEQ ID NO: 30301
  derived and/or modified sequence opt5 from anti-influenza_CDR

SEQ ID NO: 45586 - RNA, 51 nt, Artificial Sequence
  derived and/or modified sequence opt5 from anti-influenza_CDR
ggcauccuggggguguucggaagccccuccuacgcccagaaguuucaaggc

SEQ ID NO: 45587 - RNA, 51 nt, Artificial Sequence
  derived and/or modified sequence opt5 from anti-influenza_CDR
ggcaucuucgggauguuuggaaccgccaacuacgcucagaaguuccaaggc

SEQ ID NO: 45588 - RNA, 51 nt, Artificial Sequence; identical to SEQ ID NO: 30304
  derived and/or modified sequence opt5 from anti-influenza_CDR

SEQ ID NO: 45589 - RNA, 51 nt, Artificial Sequence; identical to SEQ ID NO: 30305
  derived and/or modified sequence opt5 from anti-influenza_CDR

SEQ ID NO: 45590 - RNA, 51 nt, Artificial Sequence
  derived and/or modified sequence opt5 from anti-influenza_CDR
ggcaucagcggguccggagagucuaccuacuaugccgacagcgugaagggc

SEQ ID NO: 45591 - RNA, 51 nt, Artificial Sequence; identical to SEQ ID NO: 30307
  derived and/or modified sequence opt5 from anti-influenza_CDR

SEQ ID NO: 45592 - RNA, 51 nt, Artificial Sequence
  derived and/or modified sequence opt5 from anti-influenza_CDR
ggcagcaucuccuacucugggagcaccuauuaccaccccucccugaagucu

SEQ ID NO: 45593 - RNA, 51 nt, Artificial Sequence
  derived and/or modified sequence opt5 from anti-influenza_CDR
accagaggccggcccaucgggcgcaacugggagccuagagacaaggauuac

SEQ ID NO: 45594 - RNA, 51 nt, Artificial Sequence; identical to SEQ ID NO: 30310
  derived and/or modified sequence opt5 from anti-influenza_CDR

SEQ ID NO: 45595 - RNA, 51 nt, Artificial Sequence; identical to SEQ ID NO: 30311
  derived and/or modified sequence opt5 from anti-influenza_CDR

SEQ ID NO: 45596 - RNA, 51 nt, Artificial Sequence; identical to SEQ ID NO: 30312
  derived and/or modified sequence opt5 from anti-influenza_CDR

SEQ ID NO: 45597 - RNA, 51 nt, Artificial Sequence; identical to SEQ ID NO: 30313
  derived and/or modified sequence opt5 from anti-influenza_CDR

SEQ ID NO: 45598 - RNA, 51 nt, Artificial Sequence; identical to SEQ ID NO: 30314
  derived and/or modified sequence opt5 from anti-influenza_CDR

SEQ ID NO: 45599 - RNA, 51 nt, Artificial Sequence; identical to SEQ ID NO: 30315
  derived and/or modified sequence opt5 from anti-influenza_CDR

SEQ ID NO: 45600 - RNA, 51 nt, Artificial Sequence; identical to SEQ ID NO: 30316
  derived and/or modified sequence opt5 from anti-influenza_CDR

SEQ ID NO: 45601 - RNA, 51 nt, Artificial Sequence; identical to SEQ ID NO: 30317
  derived and/or modified sequence opt5 from anti-influenza_CDR

SEQ ID NO: 45602 - RNA, 51 nt, Artificial Sequence
  derived and/or modified sequence opt5 from anti-influenza_CDR
augauguaccccggcagcuccgacaccaucuauucuccuagcuuccagggg

SEQ ID NO: 45603 - RNA, 51 nt, Artificial Sequence; identical to SEQ ID NO: 30319
  derived and/or modified sequence opt5 from anti-influenza_CDR

SEQ ID NO: 45604 - RNA, 51 nt, Artificial Sequence; identical to SEQ ID NO: 30320
  derived and/or modified sequence opt5 from anti-influenza_CDR

SEQ ID NO: 45605 - RNA, 51 nt, Artificial Sequence; identical to SEQ ID NO: 30321
  derived and/or modified sequence opt5 from anti-influenza_CDR

SEQ ID NO: 45606 - RNA, 51 nt, Artificial Sequence; identical to SEQ ID NO: 30322
  derived and/or modified sequence opt5 from anti-influenza_CDR

SEQ ID NO: 45607 - RNA, 51 nt, Artificial Sequence; identical to SEQ ID NO: 30323
  derived and/or modified sequence opt5 from anti-influenza_CDR

SEQ ID NO: 45608 - RNA, 51 nt, Artificial Sequence; identical to SEQ ID NO: 30324
  derived and/or modified sequence opt5 from anti-influenza_CDR

SEQ ID NO: 45609 - RNA, 51 nt, Artificial Sequence
  derived and/or modified sequence opt5 from anti-influenza_CDR
aucauuagcugggacuccggcagaaucggguacgccgauucugugcgggga

SEQ ID NO: 45610 - RNA, 51 nt, Artificial Sequence
  derived and/or modified sequence opt5 from anti-influenza_CDR
cacggcgggguguacuauuacggaagcgccuccucuggcugguucgacccc

SEQ ID NO: 45611 - RNA, 54 nt, Artificial Sequence
  derived and/or modified sequence opt5 from anti-influenza_CDR
agaaccuacuaucggagcaagugguacaacgacuaugccgaguccgugaaaucu

SEQ ID NO: 45612 - RNA, 54 nt, Artificial Sequence
  derived and/or modified sequence opt5 from anti-influenza_CDR
agaaccuacuaucggagcaagugguacuaugacuacgccgaguccgugaaaucu

SEQ ID NO: 45613 - RNA, 54 nt, Artificial Sequence
  derived and/or modified sequence opt5 from anti-influenza_CDR
agaaccuacuaucggagcaagugguacaacgacuaugccguguccgucaaaucu

SEQ ID NO: 45614 - RNA, 54 nt, Artificial Sequence
  derived and/or modified sequence opt5 from anti-influenza_CDR
agaaccuacuaucggagcaagugguacaacgacuaugccgauuuccugaaacgc

SEQ ID NO: 45615 - RNA, 54 nt, Artificial Sequence
  derived and/or modified sequence opt5 from anti-influenza_CDR
agaaccuacuaucggagcggcugguacaacgacuaugccgaguccgugaagucu

SEQ ID NO: 45616 - RNA, 54 nt, Artificial Sequence
  derived and/or modified sequence opt5 from anti-influenza_CDR
gccagacugggcgggaacaaggacuacggagauuaucucugguacuucgaccug

SEQ ID NO: 45617 - RNA, 54 nt, Artificial Sequence
  derived and/or modified sequence opt5 from anti-influenza_CDR
gccaaggacaccgcugaucacggcgacuacguggaucugggguucuuugacgcc

SEQ ID NO: 45618 - RNA, 54 nt, Artificial Sequence
  derived and/or modified sequence opt5 from anti-influenza_CDR
gccagaagcggcaucuucgacugguccgcuccccugguggaggccuuugauauu

SEQ ID NO: 45619 - RNA, 54 nt, Artificial Sequence
  derived and/or modified sequence opt5 from anti-influenza_CDR
gccagacacgcuagcugcuccgcccggucuuguuacuggggccccguggacuau

SEQ ID NO: 45620 - RNA, 54 nt, Artificial Sequence; identical to SEQ ID NO: 30336
  derived and/or modified sequence opt5 from anti-influenza_CDR

SEQ ID NO: 45621 - RNA, 54 nt, Artificial Sequence; identical to SEQ ID NO: 30337
  derived and/or modified sequence opt5 from anti-influenza_CDR

SEQ ID NO: 45622 - RNA, 54 nt, Artificial Sequence; identical to SEQ ID NO: 30338
  derived and/or modified sequence opt5 from anti-influenza_CDR

SEQ ID NO: 45623 - RNA, 54 nt, Artificial Sequence
  derived and/or modified sequence opt5 from anti-influenza_CDR
cacgugagcgucucccauggcgggagaaccaagucuaaccccagcguuaugucc

SEQ ID NO: 45624 - RNA, 54 nt, Artificial Sequence; identical to SEQ ID NO: 30340
  derived and/or modified sequence opt5 from anti-influenza_CDR

SEQ ID NO: 45625 - RNA, 54 nt, Artificial Sequence; identical to SEQ ID NO: 30341
  derived and/or modified sequence opt5 from anti-influenza_CDR

SEQ ID NO: 45626 - RNA, 54 nt, Artificial Sequence
  derived and/or modified sequence opt5 from anti-influenza_CDR
gccgugcccggcccugucuucgggaucuuuccgcccuggagcuacuucgacaac

SEQ ID NO: 45627 - RNA, 54 nt, Artificial Sequence
  derived and/or modified sequence opt5 from anti-influenza_CDR
ggcgggaucauucccaucuucggagccgcuaacuacgcccagaaguuucaaggc

SEQ ID NO: 45628 - RNA, 54 nt, Artificial Sequence; identical to SEQ ID NO: 30344
  derived and/or modified sequence opt5 from anti-influenza_CDR

SEQ ID NO: 45629 - RNA, 54 nt, Artificial Sequence
  derived and/or modified sequence opt5 from anti-influenza_CDR
ggcuggaucaaccccaauuucgggggaacccacuacgccagaaaguuucagggc

SEQ ID NO: 45630 - RNA, 54 nt, Artificial Sequence
  derived and/or modified sequence opt5 from anti-influenza_CDR
gugagauggcgggccgcugccgucaucauggaccaguucuacaagauggauguu

SEQ ID NO: 45631 - RNA, 54 nt, Artificial Sequence
  derived and/or modified sequence opt5 from anti-influenza_CDR
gccgugcccggcccuaucuucgggauuuuuccgcccuggagcuacuucgaccac

SEQ ID NO: 45632 - RNA, 54 nt, Artificial Sequence
  derived and/or modified sequence opt5 from anti-influenza_CDR
gccgcuagcaccgccacauccggcacguacuaugcgaugagacccuucgacuuu

SEQ ID NO: 45633 - RNA, 57 nt, Artificial Sequence
  derived and/or modified sequence opt5 from anti-influenza_CDR
gccagaggcaagcggcccggguacugcagcggaggcguguguuccucugacuauugg

SEQ ID NO: 45634 - RNA, 57 nt, Artificial Sequence; identical to SEQ ID NO: 30350
  derived and/or modified sequence opt5 from anti-influenza_CDR

SEQ ID NO: 45635 - RNA, 57 nt, Artificial Sequence
  derived and/or modified sequence opt5 from anti-influenza_CDR
ggcagcgggggauacggcggguucgacuauuuuggaaagcugagaaccugggauuuc

SEQ ID NO: 45636 - RNA, 57 nt, Artificial Sequence
  derived and/or modified sequence opt5 from anti-influenza_CDR
uucaucagaacccggcccuggggcgggacagccgacacggcugccagcgugaaggga

SEQ ID NO: 45637 - RNA, 57 nt, Artificial Sequence; identical to SEQ ID NO: 30353
  derived and/or modified sequence opt5 from anti-influenza_CDR

SEQ ID NO: 45638 - RNA, 57 nt, Artificial Sequence; identical to SEQ ID NO: 30354
  derived and/or modified sequence opt5 from anti-influenza_CDR

SEQ ID NO: 45639 - RNA, 57 nt, Artificial Sequence
  derived and/or modified sequence opt5 from anti-influenza_CDR
gccgugcccggcccuaucuucgggauuuuuccgcccuggagcuacuucgaccacugg

SEQ ID NO: 45640 - RNA, 57 nt, Artificial Sequence
  derived and/or modified sequence opt5 from anti-influenza_CDR
gccagagcuaugauccagggcguggucacccuguaccuccggcccggggacuauugg

SEQ ID NO: 45641 - RNA, 57 nt, Artificial Sequence; identical to SEQ ID NO: 30357
  derived and/or modified sequence opt5 from anti-influenza_CDR

SEQ ID NO: 45642 - RNA, 57 nt, Artificial Sequence; identical to SEQ ID NO: 30358
  derived and/or modified sequence opt5 from anti-influenza_CDR

SEQ ID NO: 45643 - RNA, 57 nt, Artificial Sequence
  derived and/or modified sequence opt5 from anti-influenza_CDR
uacugcgccagaggccgggugaacagcggguaugacuggggacccaauuucgauucc

SEQ ID NO: 45644 - RNA, 57 nt, Artificial Sequence; identical to SEQ ID NO: 30360
  derived and/or modified sequence opt5 from anti-influenza_CDR

SEQ ID NO: 45645 - RNA, 57 nt, Artificial Sequence
  derived and/or modified sequence opt5 from anti-influenza_CDR
agaaucaagagcaacaccgacggcgggacaacggauuacgccgcucccgugaaagga

SEQ ID NO: 45646 - RNA, 57 nt, Artificial Sequence
  derived and/or modified sequence opt5 from anti-influenza_CDR
cugagacuccagggcgagguggucguucccccuagccaauccaacugguucgacccg

SEQ ID NO: 45647 - RNA, 60 nt, Artificial Sequence; identical to SEQ ID NO: 30363
  derived and/or modified sequence opt5 from anti-influenza_CDR

SEQ ID NO: 45648 - RNA, 60 nt, Artificial Sequence
  derived and/or modified sequence opt5 from anti-influenza_CDR
gccagagcuggcggggacagcuccggauacuauggcgcccuggggcgguucuuucagcac

SEQ ID NO: 45649 - RNA, 60 nt, Artificial Sequence; identical to SEQ ID NO: 30365
  derived and/or modified sequence opt5 from anti-influenza_CDR

SEQ ID NO: 45650 - RNA, 60 nt, Artificial Sequence
  derived and/or modified sequence opt5 from anti-influenza_CDR
ggcagcggguccucugacagaagcgauuacgacccccacuauuacuauuaccuggaugug

SEQ ID NO: 45651 - RNA, 60 nt, Artificial Sequence; identical to SEQ ID NO: 30367
  derived and/or modified sequence opt5 from anti-influenza_CDR

SEQ ID NO: 45652 - RNA, 60 nt, Artificial Sequence
  derived and/or modified sequence opt5 from anti-influenza_CDR
ggcaccagccacguguccagauacuucgacuggcugcccccuacaaacugguuugauccg

SEQ ID NO: 45653 - RNA, 60 nt, Artificial Sequence; identical to SEQ ID NO: 30369
  derived and/or modified sequence opt5 from anti-influenza_CDR

SEQ ID NO: 45654 - RNA, 60 nt, Artificial Sequence
  derived and/or modified sequence opt5 from anti-influenza_CDR
ggcaccgaccccgauacagagguguacugcagagccgggaacugugcugccuucgacuuu

SEQ ID NO: 45655 - RNA, 60 nt, Artificial Sequence
  derived and/or modified sequence opt5 from anti-influenza_CDR
agaggcgggcacagcuucggauacggcuccgggggagacacccauucugaguuugauagc

SEQ ID NO: 45656 - RNA, 60 nt, Artificial Sequence; identical to SEQ ID NO: 30372
  derived and/or modified sequence opt5 from anti-influenza_CDR

SEQ ID NO: 45657 - RNA, 60 nt, Artificial Sequence
  derived and/or modified sequence opt5 from anti-influenza_CDR
gacagcagacugcggucccuccuguacuucgaguggcuuucucagggcuauuuuaacccc

SEQ ID NO: 45658 - RNA, 60 nt, Artificial Sequence; identical to SEQ ID NO: 30374
  derived and/or modified sequence opt5 from anti-influenza_CDR

SEQ ID NO: 45659 - RNA, 63 nt, Artificial Sequence
  derived and/or modified sequence opt5 from anti-influenza_CDR
accacaggcgggacgaccacaugcaccgccgcuggauguggcgggggaugcuguacaugcugu

SEQ ID NO: 45660 - RNA, 63 nt, Artificial Sequence
  derived and/or modified sequence opt5 from anti-influenza_CDR
gccagagcugccgacgagagcguggaaucccugaccaucaaggcguuccggacaaacuaccac

SEQ ID NO: 45661 - RNA, 63 nt, Artificial Sequence
  derived and/or modified sequence opt5 from anti-influenza_CDR
gccagaaugccccuggcuaacuacgaccuccugaccggccuuuauaucggggccuucgaucug

SEQ ID NO: 45662 - RNA, 63 nt, Artificial Sequence; identical to SEQ ID NO: 30378
  derived and/or modified sequence opt5 from anti-influenza_CDR

SEQ ID NO: 45663 - RNA, 63 nt, Artificial Sequence; identical to SEQ ID NO: 30379
  derived and/or modified sequence opt5 from anti-influenza_CDR

SEQ ID NO: 45664 - RNA, 66 nt, Artificial Sequence
  derived and/or modified sequence opt5 from anti-influenza_CDR
gccaaggaccccagacugcggcaccuccuguacuucccuuuuaccagcaugaucuauuucgauuac

SEQ ID NO: 45665 - RNA, 66 nt, Artificial Sequence
  derived and/or modified sequence opt5 from anti-influenza_CDR
gccaaggacagccagcugagaucccuccuguacuucgaguggcuuucucaaggcuauuuugauccc

SEQ ID NO: 45666 - RNA, 66 nt, Artificial Sequence
  derived and/or modified sequence opt5 from anti-influenza_CDR
gccaaggacagccagcugagaucccuccuguacuucgaguggcuuucucaaggcuauuuugauuac

SEQ ID NO: 45667 - RNA, 66 nt, Artificial Sequence
  derived and/or modified sequence opt5 from anti-influenza_CDR
gccaaggacagccagcugagaucccuccuguacuucgaguggcuuucucaaggcuauuuugaaccc

SEQ ID NO: 45668 - RNA, 66 nt, Artificial Sequence
  derived and/or modified sequence opt5 from anti-influenza_CDR
gccaaggagagaccccugcggcuccugcgcuacuucgacuggcuuagcggcggggcuaacgauuau

SEQ ID NO: 45669 - RNA, 66 nt, Artificial Sequence
  derived and/or modified sequence opt5 from anti-influenza_CDR
gccagagacgugcacaacuacgauuuccugaccggcuauccccuccaucuguacgggauggacguc

SEQ ID NO: 45670 - RNA, 66 nt, Artificial Sequence
  derived and/or modified sequence opt5 from anti-influenza_CDR
gccagagacggccgggagggguacuucuauggaagcggcuccuuuuacaaccugaaggggcucaau

SEQ ID NO: 45671 - RNA, 66 nt, Artificial Sequence
  derived and/or modified sequence opt5 from anti-influenza_CDR
agcaccgacagaggccacgugcugcgguacuucggguggaugcuccccggagaugccuuugacguc

SEQ ID NO: 45672 - RNA, 66 nt, Artificial Sequence
  derived and/or modified sequence opt5 from anti-influenza_CDR
cugaacuacuaugacagaagcggcuaccacucccccgaugggccuucuaauaacugguucgacccg

SEQ ID NO: 45673 - RNA, 66 nt, Artificial Sequence
  derived and/or modified sequence opt5 from anti-influenza_CDR
gccagagugccccgggaccgccugcucacccuguacuaugagagcuccacauacggcuucgauuau

SEQ ID NO: 45674 - RNA, 66 nt, Artificial Sequence
  derived and/or modified sequence opt5 from anti-influenza_CDR
gccagaaaguggggccggaugaccguguucggggucgcuacagaccagcuguacuauuuugauuac

SEQ ID NO: 45675 - RNA, 66 nt, Artificial Sequence; identical to SEQ ID NO: 30391
  derived and/or modified sequence opt5 from anti-influenza_CDR

SEQ ID NO: 45676 - RNA, 69 nt, Artificial Sequence
  derived and/or modified sequence opt5 from anti-influenza_CDR
gccagaaaccugcccgacaucgcuguggucaccgccguucaggaugcgacaccugugugguucgacccg

SEQ ID NO: 45677 - RNA, 69 nt, Artificial Sequence
  derived and/or modified sequence opt5 from anti-influenza_CDR
gacggccccuacagcgaugacuucagauccggguaugccgcucgguaccgcuauuuuggaauggaugug

SEQ ID NO: 45678 - RNA, 72 nt, Artificial Sequence
  derived and/or modified sequence opt5 from anti-influenza_CDR
ggcagagagcugcuccggcugcagcacuuccuuaccgacagccaauccgaacgcagagauugcuuugacccc

SEQ ID NO: 45679 - RNA, 72 nt, Artificial Sequence
  derived and/or modified sequence opt5 from anti-influenza_CDR
augagccugcucaccgagguggaaacacccacgagaaacgaguggggcugccgguguaaugacuccucugau

SEQ ID NO: 45680 - RNA, 72 nt, Artificial Sequence
  derived and/or modified sequence opt5 from anti-influenza_CDR
augagccugcucaccgagguggaaacacccacgaagaacgagugggaaugcagauguaaugacuccucugau

SEQ ID NO: 45681 - RNA, 72 nt, Artificial Sequence
  derived and/or modified sequence opt5 from anti-influenza_CDR
augagccugcucaccgagguggaaacacccaucagaaacgagugggaaugccgguguaaugacuccucugau

SEQ ID NO: 45682 - RNA, 72 nt, Artificial Sequence; identical to SEQ ID NO: 30398
  derived and/or modified sequence opt5 from anti-influenza_CDR

SEQ ID NO: 45683 - RNA, 72 nt, Artificial Sequence
  derived and/or modified sequence opt5 from anti-influenza_CDR
augagccugcucaccgagguggaaacacccaucagauccgaguggggcugccgguguaacgacucuagcgau

SEQ ID NO: 45684 - RNA, 72 nt, Artificial Sequence
  derived and/or modified sequence opt5 from anti-influenza_CDR
augagcuuccugcccgagguggaaaccccuaucagaaacgaguggggcugccgguguaaugacuccucugau

SEQ ID NO: 45685 - RNA, 72 nt, Artificial Sequence
  derived and/or modified sequence opt5 from anti-influenza_CDR
augagccugcucaccgagguggaaacacccaucagaaacgaguggggcugccgguguaaugacuccucuaac

SEQ ID NO: 45686 - RNA, 72 nt, Artificial Sequence
  derived and/or modified sequence opt5 from anti-influenza_CDR
augagccugcucaccgagguggaaacacccaucagaaaggaguggggcugccgguguaacgacuccucugau

SEQ ID NO: 45687 - RNA, 72 nt, Artificial Sequence
  derived and/or modified sequence opt5 from anti-influenza_CDR
augagcuuccugaccgagguggaaacacccaucagaaacgaguggggcugccgguguaaugacuccucugau

SEQ ID NO: 45688 - RNA, 72 nt, Artificial Sequence
  derived and/or modified sequence opt5 from anti-influenza_CDR
augagccugcccaccgagguggaaacaccuaucagauccgaguggggcugccgguguaacgacucuagcgau

SEQ ID NO: 45689 - RNA, 72 nt, Artificial Sequence
  derived and/or modified sequence opt5 from anti-influenza_CDR
augagccugcuccccgagguggaaaccccuaucagaaacgaguggggcugccgguguaaugacuccucugau

SEQ ID NO: 45690 - RNA, 72 nt, Artificial Sequence
  derived and/or modified sequence opt5 from anti-influenza_CDR
augagccugcuccccgagguggaaaccccuaucagaaacggcugggggugccgguguaaugacuccucugau

SEQ ID NO: 45691 - RNA, 72 nt, Artificial Sequence
  derived and/or modified sequence opt5 from anti-influenza_CDR
augagccugcucaccgagguggaaacacccacgagaaacggcugggagugccgguguuccgggucuagcgac

SEQ ID NO: 45692 - RNA, 72 nt, Artificial Sequence
  derived and/or modified sequence opt5 from anti-influenza_CDR
augagccugcucaccgagguggaaacacccaucagaaacgagugggaauaccggugcaaugacuccucugau

SEQ ID NO: 45693 - RNA, 72 nt, Artificial Sequence
  derived and/or modified sequence opt5 from anti-influenza_CDR
augagccugcucaccgagguggaaacacccaucagaaacgagugggaauaccggugcuccgacucuagcgau

SEQ ID NO: 45694 - RNA, 72 nt, Artificial Sequence
  derived and/or modified sequence opt5 from anti-influenza_CDR
augagccugcucaccgagguggaaacacccacgagaaacggcugggagugccgguacuccgacucuagcgau

SEQ ID NO: 45695 - RNA, 72 nt, Artificial Sequence
  derived and/or modified sequence opt5 from anti-influenza_CDR
augagcuuccugaccgagguggaaacacucacgagaaacggcugggagugccgguguuccgacucuagcgau

SEQ ID NO: 45696 - RNA, 72 nt, Artificial Sequence
  derived and/or modified sequence opt5 from anti-influenza_CDR
augagccugcucaccgagguggaaacacugacgagaaacggcugggagugcaagugucgggacuccucugau

SEQ ID NO: 45697 - RNA, 72 nt, Artificial Sequence
  derived and/or modified sequence opt5 from anti-influenza_CDR
augagccugcucaccgagguggaaacacccaucagaaacgaguggggcugccgguguaaugacuccucugau

SEQ ID NO: 45698 - RNA, 72 nt, Artificial Sequence
  derived and/or modified sequence opt5 from anti-influenza_CDR
augagccugcucaccgagguggaaacacccaucagauccgaguggggcugccgguguaacgacucuggggau

SEQ ID NO: 45699 - RNA, 72 nt, Artificial Sequence
  derived and/or modified sequence opt5 from anti-influenza_CDR
augagccugcucaccgagguggaaacacccaucagaaacgagugggaaugccgguguaauggcuccucugac

SEQ ID NO: 45700 - RNA, 72 nt, Artificial Sequence
  derived and/or modified sequence opt5 from anti-influenza_CDR
augagccugcccaccgagguggaaacaccuaucagaaacgaguggggcugccgguguaaugacuccucugau

SEQ ID NO: 45701 - RNA, 72 nt, Artificial Sequence
  derived and/or modified sequence opt5 from anti-influenza_CDR
augagccugcucaccgagguggaaacacccaucagaaacgaguggggcugccgguguaauggguccucugac

SEQ ID NO: 45702 - RNA, 72 nt, Artificial Sequence
  derived and/or modified sequence opt5 from anti-influenza_CDR
augagccugcucaccgagguggacacacugacgagaaacggcugggggugccgguguuccgauucuagcgac

SEQ ID NO: 45703 - RNA, 72 nt, Artificial Sequence
  derived and/or modified sequence opt5 from anti-influenza_CDR
augagccugcucaccgagguggaaacacugacgaagaacggcugggggugcagauguuccgacucuagcgau

SEQ ID NO: 45704 - RNA, 72 nt, Artificial Sequence
  derived and/or modified sequence opt5 from anti-influenza_CDR
augagccugcucaccgagguggaaacacccacgagaaacggcugggagugcaaguguuccgacucuagcgau

SEQ ID NO: 45705 - RNA, 72 nt, Artificial Sequence
  derived and/or modified sequence opt5 from anti-influenza_CDR
augagccugcucaccgagguggaaacacacacgagaaacggcugggagugcaaguguuccgacucuagcgau

SEQ ID NO: 45706 - RNA, 72 nt, Artificial Sequence
  derived and/or modified sequence opt5 from anti-influenza_CDR
augagccugcucaccgaggugaagacacccacgagaaacggcugggaaugcaaauguuccgacucuagcgau

SEQ ID NO: 45707 - RNA, 72 nt, Artificial Sequence
  derived and/or modified sequence opt5 from anti-influenza_CDR
augagccugcucaccgagguggaaacacugacgagaaacggcugggggugccgguguuccgacucuagcgau

SEQ ID NO: 45708 - RNA, 72 nt, Artificial Sequence
  derived and/or modified sequence opt5 from anti-influenza_CDR
augagccugcucaccgagguggaaacacccacgagagacggcugggagugcaaguguuccgauucuagcgac

SEQ ID NO: 45709 - RNA, 72 nt, Artificial Sequence
  derived and/or modified sequence opt5 from anti-influenza_CDR
augagccugcucaccgagguggaaacacccacgagaaacggcugggggugccgguguuccgacucuagcgau

SEQ ID NO: 45710 - RNA, 72 nt, Artificial Sequence
  derived and/or modified sequence opt5 from anti-influenza_CDR
augagccugcucaccgagguggaaacacccacgagaaacggcugggagugcaaguguaaugacuccucugau

SEQ ID NO: 45711 - RNA, 72 nt, Artificial Sequence
  derived and/or modified sequence opt5 from anti-influenza_CDR
augagccugcucaccgagguggaaacacugacgagaaacggcugggagugcaaguguuccgacucuagcgau

SEQ ID NO: 45712 - RNA, 72 nt, Artificial Sequence; identical to SEQ ID NO: 30428
  derived and/or modified sequence opt5 from anti-influenza_CDR

SEQ ID NO: 45713 - RNA, 72 nt, Artificial Sequence
  derived and/or modified sequence opt5 from anti-influenza_CDR
augagcuuccugaccgagguggaaacacccaucagaaacgaguggggcugccgguguaauggguccucugac

SEQ ID NO: 45714 - RNA, 72 nt, Artificial Sequence
  derived and/or modified sequence opt5 from anti-influenza_CDR
augagccugcucaccgagguggaaacacccacgagaaacggcugggagugccgguguaaugacuccucugau

SEQ ID NO: 45715 - RNA, 72 nt, Artificial Sequence
  derived and/or modified sequence opt5 from anti-influenza_CDR
augagccugcucaccgagguggaaacacccaucagaaagggcugggagugcaacuguuccgacucuagcgau

SEQ ID NO: 45716 - RNA, 72 nt, Artificial Sequence
  derived and/or modified sequence opt5 from anti-influenza_CDR
augagccugcucaccgagguggaaacacccacgagaaacgagugggaaugccgguguuccgacucuagcgau

SEQ ID NO: 45717 - RNA, 72 nt, Artificial Sequence
  derived and/or modified sequence opt5 from anti-influenza_CDR
augagccugcucaccggcguggagacacacacgagaaacggguggggaugcaaguguuccgacucuagcgau

SEQ ID NO: 45718 - RNA, 72 nt, Artificial Sequence
  derived and/or modified sequence opt5 from anti-influenza_CDR
augagccugcuccccgagguggaaacccacacaagaaacggcugggggugccgguguuccgacucuagcgau

SEQ ID NO: 45719 - RNA, 72 nt, Artificial Sequence
  derived and/or modified sequence opt5 from anti-influenza_CDR
accgacggccccuacagcgaugacuucagauccggguaugccgcucgguaccgcuauuuuggaauggaugug

SEQ ID NO: 45720 - RNA, 75 nt, Artificial Sequence
  derived and/or modified sequence opt5 from anti-influenza_CDR
gccaagcacaugagccugcagcaaguggucuccgcuggcugggagagagccgaccucguuggggaugcguucgac

SEQ ID NO: 45721 - RNA, 75 nt, Artificial Sequence
  derived and/or modified sequence opt5 from anti-influenza_CDR
gccaagcaccugagcaugcagcaaguggucuccgcuggcugggagagagccgaccucguuggggaugcguucgac

SEQ ID NO: 45722 - RNA, 75 nt, Artificial Sequence
  derived and/or modified sequence opt5 from anti-influenza_CDR
gccaagcacgcuagccugcagcaaguggucuccgccggcugggagagagcggaccucguuggggaugcuuucgac

SEQ ID NO: 45723 - RNA, 75 nt, Artificial Sequence
  derived and/or modified sequence opt5 from anti-influenza_CDR
gccaagcacagcucccugcagcaaguggucucugcuggcugggagagagccgaccucguuggggaugcguucgac

SEQ ID NO: 45724 - RNA, 75 nt, Artificial Sequence
  derived and/or modified sequence opt5 from anti-influenza_CDR
gccaagcaccugagccuccagcaaguggucuccgcuggcugggagagagccgaccugguuggggaugcguucgac

SEQ ID NO: 45725 - RNA, 75 nt, Artificial Sequence
  derived and/or modified sequence opt5 from anti-influenza_CDR
gccaagcacaugagcaugcagcaaguggucuccgcuggcugggagagagccgaccugguuggggaugcguucgac

SEQ ID NO: 45726 - RNA, 75 nt, Artificial Sequence; identical to SEQ ID NO: 30442
  derived and/or modified sequence opt5 from anti-influenza_CDR

SEQ ID NO: 45727 - RNA, 75 nt, Artificial Sequence
  derived and/or modified sequence opt5 from anti-influenza_CDR
accacagacggccccuacagcgaugacuucagauccggguaugccgcucgguaccgcuauuuuggaauggaugug

SEQ ID NO: 45728 - RNA, 75 nt, Artificial Sequence
  derived and/or modified sequence opt5 from anti-influenza_CDR
accgacggccccuacagcgaugacuucagauccggguaugccgcucgguaccgcuauuuuggaauggaugugugg

SEQ ID NO: 45729 - RNA, 78 nt, Artificial Sequence
  derived and/or modified sequence opt5 from anti-influenza_CDR
gacauccagaugacccaaagccccuccucucugagcgccuccgugggcgauagagucacaauuacgugccggucuagc

SEQ ID NO: 45730 - RNA, 78 nt, Artificial Sequence
  derived and/or modified sequence opt5 from anti-influenza_CDR
gccaccggcagagcugccacagggagcgcguccugcacgggaggcgggaccuacuggacauauuguaccugcacaacc

SEQ ID NO: 45731 - RNA, 81 nt, Artificial Sequence
  derived and/or modified sequence opt5 from anti-influenza_CDR
ggcuacauccccgaggccccuagagacgggcaggcuuaugugcggaaggauggagaauggguccugcucagcaccuuccug

SEQ ID NO: 45732 - RNA, 90 nt, Artificial Sequence
  derived and/or modified sequence opt5 from anti-influenza_CDR
caggugcaacugcucgagaccggcgggggacuggucaagcccggccagagccuuaaacuguccugcgccgcuucuggguucacauuuacg

SEQ ID NO: 45733 - RNA, 96 nt, Artificial Sequence
  derived and/or modified sequence opt5 from anti-influenza_CDR
agauucaccaucagccgggacaacuccaagaauacacuguaccuccagaugaacucucugcgcgccgaggauacggcuguguauuacugcgccaaa

SEQ ID NO: 45734 - RNA, 96 nt, Artificial Sequence
  derived and/or modified sequence opt5 from anti-influenza_CDR
ggcgugcccagcagauucuccgggucuggaagcggcaccgacuuuacacugacgaucuccucucuccagccugaggauuucgccaccuacuauugc

SEQ ID NO: 45735 - RNA, 15 nt, Artificial Sequence
  derived and/or modified sequence opt5 from anti-OX40_HeavyChain_CDR1
agcuacuccaugaac

SEQ ID NO: 45736 - RNA, 15 nt, Artificial Sequence
  derived and/or modified sequence opt5 from anti-OX40_HeavyChain_CDR1
gacuacgccaugcac

SEQ ID NO: 45737 - RNA, 15 nt, Artificial Sequence
  derived and/or modified sequence opt5 from anti-OX40_HeavyChain_CDR1
gacagcuacaugucc

SEQ ID NO: 45738 - RNA, 15 nt, Artificial Sequence
  derived and/or modified sequence opt5 from anti-OX40_HeavyChain_CDR1
gacgccuacaugagc

SEQ ID NO: 45739 - RNA, 15 nt, Artificial Sequence
  derived and/or modified sequence opt5 from anti-OX40_HeavyChain_CDR1
gagagcuacaugucc

SEQ ID NO: 45740 - RNA, 15 nt, Artificial Sequence
  derived and/or modified sequence opt5 from anti-OX40_HeavyChain_CDR1
agcggcuacuggaac

SEQ ID NO: 45741 - RNA, 21 nt, Artificial Sequence
  derived and/or modified sequence opt5 from anti-OX40_LightChain_CDR2
uacaccagcagacugcacucc

SEQ ID NO: 45742 - RNA, 21 nt, Artificial Sequence
  derived and/or modified sequence opt5 from anti-OX40_LightChain_CDR2
gccgcuagcucccugcagucu

SEQ ID NO: 45743 - RNA, 21 nt, Artificial Sequence
  derived and/or modified sequence opt5 from anti-OX40_LightChain_CDR2
gacgccagcaacagagcuacc

SEQ ID NO: 45744 - RNA, 21 nt, Artificial Sequence
  derived and/or modified sequence opt5 from anti-OX40_LightChain_CDR2
uacaccagcagacugcggucc

SEQ ID NO: 45745 - RNA, 24 nt, Artificial Sequence
  derived and/or modified sequence opt5 from anti-OX40_LightChain_CDR3
cagcaaagaagcaacuggcccacc

SEQ ID NO: 45746 - RNA, 24 nt, Artificial Sequence
  derived and/or modified sequence opt5 from anti-OX40_HeavyChain_CDR3
gcccccagaugguacuucagcgug

SEQ ID NO: 45747 - RNA, 24 nt, Artificial Sequence
  derived and/or modified sequence opt5 from anti-OX40_HeavyChain_CDR3
gcccccagaugguacuucagcgcu

SEQ ID NO: 45748 - RNA, 24 nt, Artificial Sequence
  derived and/or modified sequence opt5 from anti-OX40_HeavyChain_CDR3
gcccccagaugguacuucgcugug

SEQ ID NO: 45749 - RNA, 27 nt, Artificial Sequence
  derived and/or modified sequence opt5 from anti-OX40_LightChain_CDR3
cagcaaggcaacacccugcccuggaca

SEQ ID NO: 45750 - RNA, 27 nt, Artificial Sequence
  derived and/or modified sequence opt5 from anti-OX40_HeavyChain_CDR3
gagagcggcugguaccuguucgacuau

SEQ ID NO: 45751 - RNA, 27 nt, Artificial Sequence
  derived and/or modified sequence opt5 from anti-OX40_LightChain_CDR3
cagcaauacaacagcuaucccccuacc

SEQ ID NO: 45752 - RNA, 27 nt, Artificial Sequence
  derived and/or modified sequence opt5 from anti-OX40_LightChain_CDR3
cagcaaggccacacccugcccccuaca

SEQ ID NO: 45753 - RNA, 27 nt, Artificial Sequence
  derived and/or modified sequence opt5 from anti-OX40_LightChain_CDR3
cagcaaggccacacccugcccgccaca

SEQ ID NO: 45754 - RNA, 27 nt, Artificial Sequence
  derived and/or modified sequence opt5 from anti-OX40_LightChain_CDR3
cagcaaggccacaccgccccucccaca

SEQ ID NO: 45755 - RNA, 27 nt, Artificial Sequence
  derived and/or modified sequence opt5 from anti-OX40_LightChain_CDR3
cagcaaggcgccacccugcccccuaca

SEQ ID NO: 45756 - RNA, 27 nt, Artificial Sequence
  derived and/or modified sequence opt5 from anti-OX40_LightChain_CDR3
cagcaaggccacgcccugcccccuacc

SEQ ID NO: 45757 - RNA, 27 nt, Artificial Sequence
  derived and/or modified sequence opt5 from anti-OX40_LightChain_CDR3
cagcaagcccacacccugcccccuaca

SEQ ID NO: 45758 - RNA, 27 nt, Artificial Sequence
  derived and/or modified sequence opt5 from anti-OX40_LightChain_CDR3
cagcaaggccacacccuggcccccaca

SEQ ID NO: 45759 - RNA, 27 nt, Artificial Sequence
  derived and/or modified sequence opt5 from anti-OX40_LightChain_CDR3
caggccggccacacccugcccccuaca

SEQ ID NO: 45760 - RNA, 30 nt, Artificial Sequence; identical to SEQ ID NO: 30476
  derived and/or modified sequence opt5 from anti-OX40_HeavyChain_CDR1

SEQ ID NO: 45761 - RNA, 30 nt, Artificial Sequence; identical to SEQ ID NO: 30477
  derived and/or modified sequence opt5 from anti-OX40_HeavyChain_CDR3

SEQ ID NO: 45762 - RNA, 33 nt, Artificial Sequence; identical to SEQ ID NO: 30478
  derived and/or modified sequence opt5 from anti-OX40_LightChain_CDR1

SEQ ID NO: 45763 - RNA, 33 nt, Artificial Sequence; identical to SEQ ID NO: 30479
  derived and/or modified sequence opt5 from anti-OX40_LightChain_CDR1

SEQ ID NO: 45764 - RNA, 33 nt, Artificial Sequence; identical to SEQ ID NO: 45282
  derived and/or modified sequence opt5 from anti-OX40_LightChain_CDR1

SEQ ID NO: 45765 - RNA, 39 nt, Artificial Sequence; identical to SEQ ID NO: 30481
  derived and/or modified sequence opt5 from anti-OX40_HeavyChain_CDR3

SEQ ID NO: 45766 - RNA, 39 nt, Artificial Sequence; identical to SEQ ID NO: 30482
  derived and/or modified sequence opt5 from anti-OX40_HeavyChain_CDR3

SEQ ID NO: 45767 - RNA, 39 nt, Artificial Sequence; identical to SEQ ID NO: 30483
  derived and/or modified sequence opt5 from anti-OX40_HeavyChain_CDR3

SEQ ID NO: 45768 - RNA, 45 nt, Artificial Sequence; identical to SEQ ID NO: 30484
  derived and/or modified sequence opt5 from anti-OX40_HeavyChain_CDR3

SEQ ID NO: 45769 - RNA, 48 nt, Artificial Sequence; identical to SEQ ID NO: 30485
  derived and/or modified sequence opt5 from anti-OX40_HeavyChain_CDR2

SEQ ID NO: 45770 - RNA, 48 nt, Artificial Sequence; identical to SEQ ID NO: 30486
  derived and/or modified sequence opt5 from anti-OX40_HeavyChain_CDR2

SEQ ID NO: 45771 - RNA, 48 nt, Artificial Sequence
  derived and/or modified sequence opt5 from anti-OX40_HeavyChain_CDR2
uacaucagcuauagcggcauuaccuaccacaaccccucucugaagucc

SEQ ID NO: 45772 - RNA, 51 nt, Artificial Sequence; identical to SEQ ID NO: 30488
  derived and/or modified sequence opt5 from anti-OX40_HeavyChain_CDR2

SEQ ID NO: 45773 - RNA, 51 nt, Artificial Sequence
  derived and/or modified sequence opt5 from anti-OX40_HeavyChain_CDR2
uacaucagcuccucuagcuccaccauugacuaugccgauucugugaagggc

SEQ ID NO: 45774 - RNA, 51 nt, Artificial Sequence
  derived and/or modified sequence opt5 from anti-OX40_HeavyChain_CDR2
ggcaucagcuggaacuccgggucuauuggauacgccgacagcgugaagggc

SEQ ID NO: 45775 - RNA, 51 nt, Artificial Sequence; identical to SEQ ID NO: 30491
  derived and/or modified sequence opt5 from anti-OX40_HeavyChain_CDR2

SEQ ID NO: 45776 - RNA, 51 nt, Artificial Sequence; identical to SEQ ID NO: 30492
  derived and/or modified sequence opt5 from anti-OX40_HeavyChain_CDR2

SEQ ID NO: 45777 - RNA, 51 nt, Artificial Sequence; identical to SEQ ID NO: 30493
  derived and/or modified sequence opt5 from anti-OX40_HeavyChain_CDR2

SEQ ID NO: 45778 - RNA, 51 nt, Artificial Sequence; identical to SEQ ID NO: 30494
  derived and/or modified sequence opt5 from anti-OX40_HeavyChain_CDR2

SEQ ID NO: 45779 - RNA, 51 nt, Artificial Sequence; identical to SEQ ID NO: 30495
  derived and/or modified sequence opt5 from anti-OX40_HeavyChain_CDR2

SEQ ID NO: 45780 - RNA, 51 nt, Artificial Sequence; identical to SEQ ID NO: 30496
  derived and/or modified sequence opt5 from anti-OX40_HeavyChain_CDR2

SEQ ID NO: 45781 - RNA, 309 nt, Artificial Sequence
  derived and/or modified sequence opt5 from Ig_LightChain_kappa_constant_domain
accguggccgcucccagcgucuucaucuuuccuccguccgacgagcagcugaagucuggcacagccagcguugugugccuccugaacaauuucuaccccagagaagcgaaagugcaauggaaggucgauaacgcccuucaguccggaaauucucaggagagcgugacggaacaggacuccaaagauucuaccuauagccuguccagcacacucacccugucuaaggcugacuacgagaaacacaagguuuaugccugugaagugacacaucaagggcuuuccagcccugucaccaagucuuuuaaccgg

SEQ ID NO: 45782 - RNA, 309 nt, Artificial Sequence
  derived and/or modified sequence opt5 from Ig_LightChain_kappa_constant_domain
accguggccgcucccagcgucuucaucuuuccuccguccgacgagcagcugaagucuggcacagccagcguugugugccuccugaacaauuucuaccccagagaagcgaaagugcaauggaaggucgauaacgcccuucaguccggaaauucucaggagagcgugacggaacaggacuccaaagauucuaccuauagccuguccaacacacucacccugagcaaggcugacuacgagaaacacaagguuuaugccugugaagugacacaucaagggcuuucuuccccugucaccaagagcuuuaaucgg

SEQ ID NO: 45783 - RNA, 312 nt, Artificial Sequence
  derived and/or modified sequence opt5 from Ig_LightChain_lambda_constant_domain
cccaaggccgcuccuagcgugacccuguucccgcccuccucugaggaacuccaggccaacaaggcgacacuggucugccuuaucagcgacuuuuacccuggcgcuguuacgguggccuggaaggccgauuccucucccgugaaagcuggggucgagaccacaaccccuagcaagcaauccaauaacaaauaugccgcuucuagcuaccugucccucacacccgaacaguggaaaagccacagaucuuauuccugucaggugacccaugagggaagcacaguugaaaagaccguggccccuacggagugcucu

SEQ ID NO: 45784 - RNA, 312 nt, Artificial Sequence
  derived and/or modified sequence opt5 from Ig_LightChain_lambda_constant_domain
cccaaggccgcuccuagcgugacccuguucccgcccuccucugaggaacuccaggccaacaaggcgacacuggucugccuuaucagcgacuuuuacccuggcgcuguuacgguggccuggaaggccgauuccucucccgugaaagcuggggucgagaccacaaccccuagcaagcaauccaauaacaaauaugccgcuucuagcuaccugucccucacacccgaacaguggaaaagccacagaucuuauuccugucaggugacccaugagggaagcacaguugaaaagaccguggccccugcggagugcucu

SEQ ID NO: 45785 - RNA, 312 nt, Artificial Sequence
  derived and/or modified sequence opt5 from Ig_LightChain_lambda_constant_domain
cccaaggccgcuccuagcgugacccuguucccgcccuccucugaggaacuccaggccaacaaagcgacacuggucugccuuaucagcgacuuuuacccuggcgcuguuacgguggccuggaaggccgauuccucucccgugaaagcuggggucgagaccacaaccccuagcaagcaauccaauaacaaauaugccgcuucuagcuaccugucccucacacccgaacaguggaaaagccacaagucuuauuccugucaggugacccaugagggaagcacaguugaaaagaccguggccccuacggagugcucu

SEQ ID NO: 45786 - RNA, 312 nt, Artificial Sequence
  derived and/or modified sequence opt5 from Ig_LightChain_lambda_constant_domain
cccaaggccgcuccuagcgugacccuguucccgcccuccucugaggaacuccaggccaacaaagcgacacuggucugccuuaucagcgacuuuuacccuggcgcuguuacgguggccuggaaggccgauuccucucccgugaaagcuggggucgagaccacaaccccuagcaagcaauccaauaacaaauaugccgcuucuagcuaccugucccucacacccgaacaguggaaaagccacaagucuuauuccugucaggugacccaugagggaagcacaguugaaaagaccguggccccugcggagugcucu

SEQ ID NO: 45787 - RNA, 282 nt, Artificial Sequence
  derived and/or modified sequence opt5 from IgG1_HeavyChain_CH1_constant_domain
agcgccuccaccaagggccccucuguguucccucuggcuccgagcuccaaaucuacaagcgggggaacggccgcgcucggcugccuggucaaggacuacuuucccgagccuguuaccguguccuggaacucuggggugcacacauuccccgcuguccuucagagcuccggacuguauagccucucuuccgugguuaccgugccuucuagcucccugggcacacaaaccuacaucuguaaugucaaccauaaacccagcaauacaaagguggauaaaaagguu

SEQ ID NO: 45788 - RNA, 270 nt, Artificial Sequence
  derived and/or modified sequence opt5 from IgG1_HeavyChain_CH1_constant_domain
agcggccccuccguguucccucuggccccgucuagcaaguccaccucugggggaacagcugcccucggcugccuggucaaagacuacuuucccgagccuguuacggugagcuggaacuccggggugcacaccuuccccgcgguccuucagucuagcggacuguauucccucagcucugugguuacagugccuuccagcucucugggcacccaaacauacaucuguaaugucaaccauaagcccuccaauaccaaaguggauaagaaaguu

SEQ ID NO: 45789 - RNA, 270 nt, Artificial Sequence
  derived and/or modified sequence opt5 from IgG1_HeavyChain_CH1_constant_domain
agcggccccuccguguucccucuggccccgucuagcaaguccaccucugggggaacagcugcccucggcugccuggucaaagacuacuuucccgagccuguuacggugagcuggaacuccggggugcacaccuuccccgcgguccuucagucuagcggacuguauucccucagcucugugguuacagugccuuccagcucucugggcacccaaacauacaucuguaaugucaaccauaagcccuccaauaccaaaguggauaagaaagcu

SEQ ID NO: 45790 - RNA, 270 nt, Artificial Sequence
  derived and/or modified sequence opt5 from IgG1_HeavyChain_CH1_constant_domain
agcggccccuccguguucccucuggccccgucuagcaaguccaccucugggggaacagcugcccucggcugccuggucaaagacuacuuucccgagccuguuacggugagcuggaacuccggggugcacaccuuccccgcgguccuucagucuagcggacuguauucccucagcucugugguuacagugccuuccagcucucugggcacccaaacauacaucuguaaugucaaccauaagcccuccaauaccaaaguggauaagagaguu

SEQ ID NO: 45791 - RNA, 270 nt, Artificial Sequence
  derived and/or modified sequence opt5 from IgG1_HeavyChain_CH1_constant_domain
agcggccccuccguguucccucuggccccgucuagcaaguccaccucugggggaacagcugcccucggcugccuggucaaagacuacuuucccgagccuguuacggugagcuggaacuccggggugcacaccuuccccgcgguccuucagucuagcggacuguauucccucagcucugugguuacagugccuuccagcucucugggcacccaaacauacaucuguaaugucaaccauaagcccuccaauaccaaaguggauaagagagcu

SEQ ID NO: 45792 - RNA, 270 nt, Artificial Sequence
  derived and/or modified sequence opt5 from IgG1_HeavyChain_CH1_constant_domain
agcggccccuccgugcugccucucgccccgucuagcaaguccaccucugggggaacagcugcccugggcugccuugucaaagacuacuuccccgagccuguuacggugagcuggaacuccggggugcacaccuuucccgcgguccugcagucuagcggacucuauucccugagcucugugguuacagugccuuccagcucucuuggcacccaaacauacaucuguaaugucaaccauaagcccuccaauaccaaaguggauaagaaaguu

SEQ ID NO: 45793 - RNA, 270 nt, Artificial Sequence
  derived and/or modified sequence opt5 from IgG1_HeavyChain_CH1_constant_domain
agcggccccuccgugcugccucucgccccgucuagcaaguccaccucugggggaacagcugcccugggcugccuugucaaagacuacuuccccgagccuguuacggugagcuggaacuccggggugcacaccuuucccgcgguccugcagucuagcggacucuauucccugagcucugugguuacagugccuuccagcucucuuggcacccaaacauacaucuguaaugucaaccauaagcccuccaauaccaaaguggauaagaaagcu

SEQ ID NO: 45794 - RNA, 270 nt, Artificial Sequence
  derived and/or modified sequence opt5 from IgG1_HeavyChain_CH1_constant_domain
agcggccccuccgugcugccucucgccccgucuagcaaguccaccucugggggaacagcugcccugggcugccuugucaaagacuacuuccccgagccuguuacggugagcuggaacuccggggugcacaccuuucccgcgguccugcagucuagcggacucuauucccugagcucugugguuacagugccuuccagcucucuuggcacccaaacauacaucuguaaugucaaccauaagcccuccaauaccaaaguggauaagagaguu

SEQ ID NO: 45795 - RNA, 270 nt, Artificial Sequence
  derived and/or modified sequence opt5 from IgG1_HeavyChain_CH1_constant_domain
agcggccccuccgugcugccucucgccccgucuagcaaguccaccucugggggaacagcugcccugggcugccuugucaaagacuacuuccccgagccuguuacggugagcuggaacuccggggugcacaccuuucccgcgguccugcagucuagcggacucuauucccugagcucugugguuacagugccuuccagcucucuuggcacccaaacauacaucuguaaugucaaccauaagcccuccaauaccaaaguggauaagagagcu

SEQ ID NO: 45796 - RNA, 282 nt, Artificial Sequence
  derived and/or modified sequence opt5 from IgG1_HeavyChain_CH1_constant_domain
agcgccuccaccaagggccccucuguguucccucuggcuccgagcuccaaaucuacaagcgggggaacggccgcgcucggcugccuggucaaggacuacuuucccgagccuguuaccguguccuggaacucuggggugcacacauuccccgcuguccuucagagcuccggacuguauagccucucuuccgugguuaccgugccuucuagcucccugggcacacaaaccuacaucuguaaugucaaccauaaacccagcaauacaaagguggauaaaaaggcc

SEQ ID NO: 45797 - RNA, 282 nt, Artificial Sequence
  derived and/or modified sequence opt5 from IgG1_HeavyChain_CH1_constant_domain
agcgccuccaccaagggccccucuguguucccucuggcuccgagcuccaaaucuacaagcgggggaacggccgcgcucggcugccuggucaaggacuacuuucccgagccuguuaccguguccuggaacucuggggugcacacauuccccgcuguccuucagagcuccggacuguauagccucucuuccgugguuaccgugccuucuagcucccugggcacacaaaccuacaucuguaaugucaaccauaaacccagcaauacaaagguggauaaaagaguu

SEQ ID NO: 45798 - RNA, 282 nt, Artificial Sequence
  derived and/or modified sequence opt5 from IgG1_HeavyChain_CH1_constant_domain
agcgccuccaccaagggccccucuguguucccucuggcuccgagcuccaaaucuacaagcgggggaacggccgcgcucggcugccuggucaaggacuacuuucccgagccuguuaccguguccuggaacucuggggugcacacauuccccgcuguccuucagagcuccggacuguauagccucucuuccgugguuaccgugccuucuagcucccugggcacacaaaccuacaucuguaaugucaaccauaaacccagcaauacaaagguggauaaaagagcc

SEQ ID NO: 45799 - RNA, 282 nt, Artificial Sequence
  derived and/or modified sequence opt5 from IgG1_HeavyChain_CH1_constant_domain
agcgccuccaccaagggccccucugugcugccucucgcuccgagcuccaaaucuacaagcgggggaacggccgcgcugggcugccuugucaaggacuacuuccccgagccuguuaccguguccuggaacucuggggugcacacauuucccgcuguccugcagagcuccggacucuauagccugucuuccgugguuaccgugccuucuagcucccuuggcacacaaaccuacaucuguaaugucaaccauaaacccagcaauacaaagguggauaaaaagguu

SEQ ID NO: 45800 - RNA, 282 nt, Artificial Sequence
  derived and/or modified sequence opt5 from IgG1_HeavyChain_CH1_constant_domain
agcgccuccaccaagggccccucugugcugccucucgcuccgagcuccaaaucuacaagcgggggaacggccgcgcugggcugccuugucaaggacuacuuccccgagccuguuaccguguccuggaacucuggggugcacacauuucccgcuguccugcagagcuccggacucuauagccugucuuccgugguuaccgugccuucuagcucccuuggcacacaaaccuacaucuguaaugucaaccauaaacccagcaauacaaagguggauaaaaaggcc

SEQ ID NO: 45801 - RNA, 282 nt, Artificial Sequence
  derived and/or modified sequence opt5 from IgG1_HeavyChain_CH1_constant_domain
agcgccuccaccaagggccccucugugcugccucucgcuccgagcuccaaaucuacaagcgggggaacggccgcgcugggcugccuugucaaggacuacuuccccgagccuguuaccguguccuggaacucuggggugcacacauuucccgcuguccugcagagcuccggacucuauagccugucuuccgugguuaccgugccuucuagcucccuuggcacacaaaccuacaucuguaaugucaaccauaaacccagcaauacaaagguggauaaaagaguu

SEQ ID NO: 45802 - RNA, 282 nt, Artificial Sequence
  derived and/or modified sequence opt5 from IgG1_HeavyChain_CH1_constant_domain
agcgccuccaccaagggccccucugugcugccucucgcuccgagcuccaaaucuacaagcgggggaacggccgcgcugggcugccuugucaaggacuacuuccccgagccuguuaccguguccuggaacucuggggugcacacauuucccgcuguccugcagagcuccggacucuauagccugucuuccgugguuaccgugccuucuagcucccuuggcacacaaaccuacaucuguaaugucaaccauaaacccagcaauacaaagguggauaaaagagcc

SEQ ID NO: 45803 - RNA, 330 nt, Artificial Sequence
  derived and/or modified sequence opt5 from IgG1_HeavyChain_CH2_constant_domain
gcccccgagcugcucggcgggccuagcguguuccuguuuccgcccaagccuaaagacacccuuaugaucuccagaacacccgaagucacgugcguugugguggaugucucucacgaggacccugaagugaaguucaacugguacguugauggaguggagguccauaaugcuaaaaccaagccccgggaggaacaguauaacagcacauaccgcgugguuuccgugcugaccguccuccaccaagacuggcugaauggcaaagaguauaaguguaaggugucuaacaaagcccuuccugcgccgauugaaaagacaaucagcaaagcuaag

SEQ ID NO: 45804 - RNA, 330 nt, Artificial Sequence
  derived and/or modified sequence opt5 from IgG1_HeavyChain_CH2_constant_domain
gcccccgagcugcucggcgggccuagcguguuccuguuuccgcccaagccuaaagacacccuuaugaucuccagaacacccgaagucacgugcguugugguggaugucucucacgaggacccugaagugaaguucaacguuuacguggauggagucgaggugcauaaugcuaaaaccaagccccgggaggaacaguauaacagcacauaccgcguuguguccguccugaccgugcuccaccaagacuggcugaauggcaaagaguauaaguguaaggugucuaacaaagcccuuccugcgccgauugaaaagacaaucagcaaagcuaag

SEQ ID NO: 45805 - RNA, 330 nt, Artificial Sequence
  derived and/or modified sequence opt5 from IgG1_HeavyChain_CH2_constant_domain
gcccccgagcugcucggcgggccuagcguguuccuguuuccgcccaagccuaaagacacccuuaugaucuccagaacacccgaagucacgugcguugugguggaugucucucacgaggacccugaagugaaguucaacguuuacguggauggagucgaggugcauaaugcuaaaaccaagccccgggaggaacaguaugccagcacauaccgcguuguguccguccugaccgugcuccaccaagacuggcugaacggcaaagaguauaaguguaaggugucuaauaaagcgcuuccugcuccgauugaaaagacaaucagcaaagccaag

SEQ ID NO: 45806 - RNA, 330 nt, Artificial Sequence
  derived and/or modified sequence opt5 from IgG1_HeavyChain_CH2_constant_domain
gcccccgagcugcucggcgggccuagcguguuccuguuuccgcccaagccuaaagacacccuuaugaucuccagaacacccgaagucacgugcguugugguggaugucucucacgaggacccugaagugaaguucaacugguacguugauggaguggagguccauaaugcuaaaaccaagccccgggaggaacaguaugccagcacauaccgcgugguuuccgugcugaccguccuccaccaagacuggcugaacggcaaagaguauaaguguaaggugucuaauaaagcgcuuccugcuccgauugaaaagacaaucagcaaagccaag

SEQ ID NO: 45807 - RNA, 330 nt, Artificial Sequence
  derived and/or modified sequence opt5 from IgG1_HeavyChain_CH2_constant_domain
gcccccgagcugcucggcgcuccuagcguguuccuguuuccgcccaagccuaaagacacccuuaugaucuccagaacacccgaagucacgugcguugugguggaugucucucacgaggacccugaagugaaguucaacguuuacguggauggggucgaggugcauaaugccaaaaccaagccccgggaggaacaguauaacagcacauaccgcguuguguccguccugaccgugcuccaccaagacuggcugaauggaaaagaguauaaguguaaggugucuaacaaagcgcuuccugcuccgauugaaaagacaaucagcaaagccaag

SEQ ID NO: 45808 - RNA, 330 nt, Artificial Sequence
  derived and/or modified sequence opt5 from IgG1_HeavyChain_CH2_constant_domain
gcccccgagcugcucggcgcuccuagcguguuccuguuuccgcccaagccuaaagacacccuuaugaucuccagaacacccgaagucacgugcguugugguggaugucucucacgaggacccugaagugaaguucaacguuuacguggauggggucgaggugcauaaugccaaaaccaagccccgggaggaacaguaugcgagcacauaccgcguuguguccguccugaccgugcuccaccaagacuggcugaacggaaaagaguauaaguguaaggugucuaauaaagcccuuccugcuccgauugaaaagacaaucagcaaagccaag

SEQ ID NO: 45809 - RNA, 330 nt, Artificial Sequence
  derived and/or modified sequence opt5 from IgG1_HeavyChain_CH2_constant_domain
gcccccgagcugcucggcgcuccuagcguguuccuguuuccgcccaagccuaaagacacccuuaugaucuccagaacacccgaagucacgugcguugugguggaugucucucacgaggacccugaagugaaguucaacugguacguugaugggguggagguccauaaugccaaaaccaagccccgggaggaacaguauaacagcacauaccgcgugguuuccgugcugaccguccuccaccaagacuggcugaauggaaaagaguauaaguguaaggugucuaacaaagcgcuuccugcuccgauugaaaagacaaucagcaaagccaag

SEQ ID NO: 45810 - RNA, 330 nt, Artificial Sequence
  derived and/or modified sequence opt5 from IgG1_HeavyChain_CH2_constant_domain
gcccccgagcugcucggcgcuccuagcguguuccuguuuccgcccaagccuaaagacacccuuaugaucuccagaacacccgaagucacgugcguugugguggaugucucucacgaggacccugaagugaaguucaacugguacguugaugggguggagguccauaaugccaaaaccaagccccgggaggaacaguaugcgagcacauaccgcgugguuuccgugcugaccguccuccaccaagacuggcugaacggaaaagaguauaaguguaaggugucuaauaaagcccuuccugcuccgauugaaaagacaaucagcaaagccaag

SEQ ID NO: 45811 - RNA, 330 nt, Artificial Sequence
  derived and/or modified sequence opt5 from IgG1_HeavyChain_CH2_constant_domain
gcccccgagcuggcuggcgggccuagcguguuccucuuuccgcccaagccuaaagacacccugaugaucuccagaacacccgaagucacgugcguugugguggaugucucucacgaggacccugaagugaaguucaacguuuacguggauggagucgaggugcauaaugccaaaaccaagccccgggaggaacaguauaacagcacauaccgcguuguguccguccuuaccgugcugcaccaagacuggcucaauggcaaagaguauaaguguaaggugucuaacaaagcgcugccugcuccgauugaaaagacaaucagcaaagccaag

SEQ ID NO: 45812 - RNA, 330 nt, Artificial Sequence
  derived and/or modified sequence opt5 from IgG1_HeavyChain_CH2_constant_domain
gcccccgagcuggcuggcgggccuagcguguuccucuuuccgcccaagccuaaagacacccugaugaucuccagaacacccgaagucacgugcguugugguggaugucucucacgaggacccugaagugaaguucaacguuuacguggauggagucgaggugcauaaugccaaaaccaagccccgggaggaacaguaugcgagcacauaccgcguuguguccguccuuaccgugcugcaccaagacuggcucaacggcaaagaguauaaguguaaggugucuaauaaagcucugccugccccgauugaaaagacaaucagcaaagccaag

SEQ ID NO: 45813 - RNA, 330 nt, Artificial Sequence
  derived and/or modified sequence opt5 from IgG1_HeavyChain_CH2_constant_domain
gcccccgagcuggcuggcgggccuagcguguuccucuuuccgcccaagccuaaagacacccugaugaucuccagaacacccgaagucacgugcguugugguggaugucucucacgaggacccugaagugaaguucaacugguacguugauggaguggagguccauaaugccaaaaccaagccccgggaggaacaguauaacagcacauaccgcgugguuuccgugcuuaccguccugcaccaagacuggcucaauggcaaagaguauaaguguaaggugucuaacaaagcgcugccugcuccgauugaaaagacaaucagcaaagccaag

SEQ ID NO: 45814 - RNA, 330 nt, Artificial Sequence
  derived and/or modified sequence opt5 from IgG1_HeavyChain_CH2_constant_domain
gcccccgagcuggcuggcgggccuagcguguuccucuuuccgcccaagccuaaagacacccugaugaucuccagaacacccgaagucacgugcguugugguggaugucucucacgaggacccugaagugaaguucaacugguacguugauggaguggagguccauaaugccaaaaccaagccccgggaggaacaguaugcgagcacauaccgcgugguuuccgugcuuaccguccugcaccaagacuggcucaacggcaaagaguauaaguguaaggugucuaauaaagcucugccugccccgauugaaaagacaaucagcaaagccaag

SEQ ID NO: 45815 - RNA, 330 nt, Artificial Sequence
  derived and/or modified sequence opt5 from IgG1_HeavyChain_CH2_constant_domain
gcccccgagcuggcuggcgccccuagcguguuccucuuuccgcccaagccuaaagacacccugaugaucuccagaacacccgaagucacgugcguugugguggaugucucucacgaggacccugaagugaaguucaacguuuacguggauggggucgaggugcauaaugcgaaaaccaagccccgggaggaacaguauaacagcacauaccgcguuguguccguccuuaccgugcugcaccaagacuggcucaauggaaaagaguauaaguguaaggugucuaacaaagcucugccugccccgauugaaaagacaaucagcaaagccaag

SEQ ID NO: 45816 - RNA, 330 nt, Artificial Sequence
  derived and/or modified sequence opt5 from IgG1_HeavyChain_CH2_constant_domain
gcccccgagcuggcuggcgccccuagcguguuccucuuuccgcccaagccuaaagacacccugaugaucuccagaacacccgaagucacgugcguugugguggaugucucucacgaggacccugaagugaaguucaacguuuacguggauggggucgaggugcauaaugcgaaaaccaagccccgggaggaacaguaugcuagcacauaccgcguuguguccguccuuaccgugcugcaccaagacuggcucaacggaaaagaguauaaguguaaggugucuaauaaagcccugccugccccgauugaaaagacaaucagcaaagcuaag

SEQ ID NO: 45817 - RNA, 330 nt, Artificial Sequence
  derived and/or modified sequence opt5 from IgG1_HeavyChain_CH2_constant_domain
gcccccgagcuggcuggcgccccuagcguguuccucuuuccgcccaagccuaaagacacccugaugaucuccagaacacccgaagucacgugcguugugguggaugucucucacgaggacccugaagugaaguucaacugguacguugaugggguggagguccauaaugcgaaaaccaagccccgggaggaacaguauaacagcacauaccgcgugguuuccgugcuuaccguccugcaccaagacuggcucaauggaaaagaguauaaguguaaggugucuaacaaagcucugccugccccgauugaaaagacaaucagcaaagccaag

SEQ ID NO: 45818 - RNA, 330 nt, Artificial Sequence
  derived and/or modified sequence opt5 from IgG1_HeavyChain_CH2_constant_domain
gcccccgagcuggcuggcgccccuagcguguuccucuuuccgcccaagccuaaagacacccugaugaucuccagaacacccgaagucacgugcguugugguggaugucucucacgaggacccugaagugaaguucaacugguacguugaugggguggagguccauaaugcgaaaaccaagccccgggaggaacaguaugcuagcacauaccgcgugguuuccgugcuuaccguccugcaccaagacuggcucaacggaaaagaguauaaguguaaggugucuaauaaagcccugccugccccgauugaaaagacaaucagcaaagcuaag

SEQ ID NO: 45819 - RNA, 330 nt, Artificial Sequence
  derived and/or modified sequence opt5 from IgG1_HeavyChain_CH2_constant_domain
gcccccgaggcucugggcgggccuagcguguuccucuuuccgcccaagccuaaagacacccugaugaucuccagaacacccgaagucacgugcguugugguggaugucucucacgaggacccugaagugaaguucaacguuuacguggauggagucgaggugcauaaugccaaaaccaagccccgggaggaacaguauaacagcacauaccgcguuguguccguccuuaccgugcugcaccaagacuggcucaauggcaaagaguauaaguguaaggugucuaacaaagcgcugccugcuccgauugaaaagacaaucagcaaagccaag

SEQ ID NO: 45820 - RNA, 330 nt, Artificial Sequence
  derived and/or modified sequence opt5 from IgG1_HeavyChain_CH2_constant_domain
gcccccgaggcucugggcgggccuagcguguuccucuuuccgcccaagccuaaagacacccugaugaucuccagaacacccgaagucacgugcguugugguggaugucucucacgaggacccugaagugaaguucaacguuuacguggauggagucgaggugcauaaugccaaaaccaagccccgggaggaacaguaugcgagcacauaccgcguuguguccguccuuaccgugcugcaccaagacuggcucaacggcaaagaguauaaguguaaggugucuaauaaagcucugccugccccgauugaaaagacaaucagcaaagccaag

SEQ ID NO: 45821 - RNA, 330 nt, Artificial Sequence
  derived and/or modified sequence opt5 from IgG1_HeavyChain_CH2_constant_domain
gcccccgaggcucugggcgggccuagcguguuccucuuuccgcccaagccuaaagacacccugaugaucuccagaacacccgaagucacgugcguugugguggaugucucucacgaggacccugaagugaaguucaacugguacguugauggaguggagguccauaaugccaaaaccaagccccgggaggaacaguauaacagcacauaccgcgugguuuccgugcuuaccguccugcaccaagacuggcucaauggcaaagaguauaaguguaaggugucuaacaaagcgcugccugcuccgauugaaaagacaaucagcaaagccaag

SEQ ID NO: 45822 - RNA, 330 nt, Artificial Sequence
  derived and/or modified sequence opt5 from IgG1_HeavyChain_CH2_constant_domain
gcccccgaggcucugggcgggccuagcguguuccucuuuccgcccaagccuaaagacacccugaugaucuccagaacacccgaagucacgugcguugugguggaugucucucacgaggacccugaagugaaguucaacugguacguugauggaguggagguccauaaugccaaaaccaagccccgggaggaacaguaugcgagcacauaccgcgugguuuccgugcuuaccguccugcaccaagacuggcucaacggcaaagaguauaaguguaaggugucuaauaaagcucugccugccccgauugaaaagacaaucagcaaagccaag

SEQ ID NO: 45823 - RNA, 330 nt, Artificial Sequence
  derived and/or modified sequence opt5 from IgG1_HeavyChain_CH2_constant_domain
gcccccgaggcucugggcgccccuagcguguuccucuuuccgcccaagccuaaagacacccugaugaucuccagaacacccgaagucacgugcguugugguggaugucucucacgaggacccugaagugaaguucaacguuuacguggauggggucgaggugcauaaugcgaaaaccaagccccgggaggaacaguauaacagcacauaccgcguuguguccguccuuaccgugcugcaccaagacuggcucaauggaaaagaguauaaguguaaggugucuaacaaagcucugccugccccgauugaaaagacaaucagcaaagccaag

SEQ ID NO: 45824 - RNA, 330 nt, Artificial Sequence
  derived and/or modified sequence opt5 from IgG1_HeavyChain_CH2_constant_domain
gcccccgaggcucugggcgccccuagcguguuccucuuuccgcccaagccuaaagacacccugaugaucuccagaacacccgaagucacgugcguugugguggaugucucucacgaggacccugaagugaaguucaacguuuacguggauggggucgaggugcauaaugcgaaaaccaagccccgggaggaacaguaugcuagcacauaccgcguuguguccguccuuaccgugcugcaccaagacuggcucaacggaaaagaguauaaguguaaggugucuaauaaagcccugccugccccgauugaaaagacaaucagcaaagcuaag

SEQ ID NO: 45825 - RNA, 330 nt, Artificial Sequence
  derived and/or modified sequence opt5 from IgG1_HeavyChain_CH2_constant_domain
gcccccgaggcucugggcgccccuagcguguuccucuuuccgcccaagccuaaagacacccugaugaucuccagaacacccgaagucacgugcguugugguggaugucucucacgaggacccugaagugaaguucaacugguacguugaugggguggagguccauaaugcgaaaaccaagccccgggaggaacaguauaacagcacauaccgcgugguuuccgugcuuaccguccugcaccaagacuggcucaauggaaaagaguauaaguguaaggugucuaacaaagcucugccugccccgauugaaaagacaaucagcaaagccaag

SEQ ID NO: 45826 - RNA, 330 nt, Artificial Sequence
  derived and/or modified sequence opt5 from IgG1_HeavyChain_CH2_constant_domain
gcccccgaggcucugggcgccccuagcguguuccucuuuccgcccaagccuaaagacacccugaugaucuccagaacacccgaagucacgugcguugugguggaugucucucacgaggacccugaagugaaguucaacugguacguugaugggguggagguccauaaugcgaaaaccaagccccgggaggaacaguaugcuagcacauaccgcgugguuuccgugcuuaccguccugcaccaagacuggcucaacggaaaagaguauaaguguaaggugucuaauaaagcccugccugccccgauugaaaagacaaucagcaaagcuaag

SEQ ID NO: 45827 - RNA, 330 nt, Artificial Sequence
  derived and/or modified sequence opt5 from IgG1_HeavyChain_CH2_constant_domain
gcccccgaggcugccggcgggccuagcguguuccuguuuccgcccaagccuaaagacacccucaugaucuccagaacacccgaagucacgugcguugugguggaugucucucacgaggacccugaagugaaguucaacguuuacguggauggagucgaggugcauaaugcgaaaaccaagccccgggaggaacaguauaacagcacauaccgcguuguguccguccugaccgugcuucaccaagacuggcugaauggcaaagaguauaaguguaaggugucuaacaaagcucucccugccccgauugaaaagacaaucagcaaagccaag

SEQ ID NO: 45828 - RNA, 330 nt, Artificial Sequence
  derived and/or modified sequence opt5 from IgG1_HeavyChain_CH2_constant_domain
gcccccgaggcugccggcgggccuagcguguuccuguuuccgcccaagccuaaagacacccucaugaucuccagaacacccgaagucacgugcguugugguggaugucucucacgaggacccugaagugaaguucaacguuuacguggauggagucgaggugcauaaugcgaaaaccaagccccgggaggaacaguaugcuagcacauaccgcguuguguccguccugaccgugcuucaccaagacuggcugaacggcaaagaguauaaguguaaggugucuaauaaagcccucccugccccgauugaaaagacaaucagcaaagcuaag

SEQ ID NO: 45829 - RNA, 330 nt, Artificial Sequence
  derived and/or modified sequence opt5 from IgG1_HeavyChain_CH2_constant_domain
gcccccgaggcugccggcgggccuagcguguuccuguuuccgcccaagccuaaagacacccucaugaucuccagaacacccgaagucacgugcguugugguggaugucucucacgaggacccugaagugaaguucaacugguacguugauggaguggagguccauaaugcgaaaaccaagccccgggaggaacaguauaacagcacauaccgcgugguuuccgugcugaccguccuucaccaagacuggcugaauggcaaagaguauaaguguaaggugucuaacaaagcucucccugccccgauugaaaagacaaucagcaaagccaag

SEQ ID NO: 45830 - RNA, 330 nt, Artificial Sequence
  derived and/or modified sequence opt5 from IgG1_HeavyChain_CH2_constant_domain
gcccccgaggcugccggcgggccuagcguguuccuguuuccgcccaagccuaaagacacccucaugaucuccagaacacccgaagucacgugcguugugguggaugucucucacgaggacccugaagugaaguucaacugguacguugauggaguggagguccauaaugcgaaaaccaagccccgggaggaacaguaugcuagcacauaccgcgugguuuccgugcugaccguccuucaccaagacuggcugaacggcaaagaguauaaguguaaggugucuaauaaagcccucccugccccgauugaaaagacaaucagcaaagcuaag

SEQ ID NO: 45831 - RNA, 330 nt, Artificial Sequence
  derived and/or modified sequence opt5 from IgG1_HeavyChain_CH2_constant_domain
gcccccgaggcugccggcgcgccuagcguguuccuguuuccgcccaagccuaaagacacccucaugaucuccagaacacccgaagucacgugcguugugguggaugucucucacgaggacccugaagugaaguucaacguuuacguggauggggucgaggugcauaaugcuaaaaccaagccccgggaggaacaguauaacagcacauaccgcguuguguccguccugaccgugcuucaccaagacuggcugaauggaaaagaguauaaguguaaggugucuaacaaagcccucccugccccgauugaaaagacaaucagcaaagcuaag

SEQ ID NO: 45832 - RNA, 330 nt, Artificial Sequence
  derived and/or modified sequence opt5 from IgG1_HeavyChain_CH2_constant_domain
gcccccgaggcugccggcgcgccuagcguguuccuguuuccgcccaagccuaaagacacccucaugaucuccagaacacccgaagucacgugcguugugguggaugucucucacgaggacccugaagugaaguucaacguuuacguggauggggucgaggugcauaaugcuaaaaccaagccccgggaggaacaguaugccagcacauaccgcguuguguccguccugaccgugcuucaccaagacuggcugaacggaaaagaguauaaguguaaggugucuaauaaagcccucccugcuccgauugaaaagacaaucagcaaagccaag

SEQ ID NO: 45833 - RNA, 330 nt, Artificial Sequence
  derived and/or modified sequence opt5 from IgG1_HeavyChain_CH2_constant_domain
gcccccgaggcugccggcgcgccuagcguguuccuguuuccgcccaagccuaaagacacccucaugaucuccagaacacccgaagucacgugcguugugguggaugucucucacgaggacccugaagugaaguucaacugguacguugaugggguggagguccauaaugcuaaaaccaagccccgggaggaacaguauaacagcacauaccgcgugguuuccgugcugaccguccuucaccaagacuggcugaauggaaaagaguauaaguguaaggugucuaacaaagcccucccugccccgauugaaaagacaaucagcaaagcuaag

SEQ ID NO: 45834 - RNA, 330 nt, Artificial Sequence
  derived and/or modified sequence opt5 from IgG1_HeavyChain_CH2_constant_domain
gcccccgaggcugccggcgcgccuagcguguuccuguuuccgcccaagccuaaagacacccucaugaucuccagaacacccgaagucacgugcguugugguggaugucucucacgaggacccugaagugaaguucaacugguacguugaugggguggagguccauaaugcuaaaaccaagccccgggaggaacaguaugccagcacauaccgcgugguuuccgugcugaccguccuucaccaagacuggcugaacggaaaagaguauaaguguaaggugucuaauaaagcccucccugcuccgauugaaaagacaaucagcaaagccaag

SEQ ID NO: 45835 - RNA, 318 nt, Artificial Sequence
  derived and/or modified sequence opt5 from IgG1_HeavyChain_CH3_constant_domain
ggccagcccagagagccucaaguguacacccugccgcccagccgggaagagaugacaaagaaccaggucucccucacgugccugguuaaaggguucuauccuucugacaucgccguggaaugggagagcaauggacagcccgaaaacaauuacaagaccacaccucccgugcuugauuccgacggcagcuuuuuccuguauucuaaacucaccgucgauaagucccgcuggcagcaagggaacguguuuucuuguagcguuaugcacgaggcucugcauaaucacuacacacagaaaucccuuagccugucuccugga

SEQ ID NO: 45836 - RNA, 318 nt, Artificial Sequence
  derived and/or modified sequence opt5 from IgG1_HeavyChain_CH3_constant_domain
ggccagcccagagagccucaaguguacacccugccgcccagccgggaggaacucacaaagaaccaggucucccugacgugccuuguuaaaggguucuauccuucugacaucgcuguggaaugggagagcaauggacagcccgaaaacaauuacaagaccacaccucccgugcuggauuccgacggcagcuuuuuccucuauucuaaacugaccgucgauaagucccgcuggcagcaagggaacguguuuucuuguagcguuaugcacgaggcccuucauaaucacuacacacagaaaucccugagccucucuccugga

SEQ ID NO: 45837 - RNA, 318 nt, Artificial Sequence
  derived and/or modified sequence opt5 from IgG1_HeavyChain_CH3_constant_domain
ggccagcccagagagccucaaguguacacccugccgcccagccgggacgaaaugacaaagaaccaggucucccucacgugccugguuaaaggguucuauccuucugauaucgccguggagugggaaagcaauggacagcccgagaacaauuacaagaccacaccucccgugcuugacuccgauggcagcuuuuuccuguauucuaaacucaccgucgacaagucccgcuggcagcaagggaacguguuuucuuguagcguuaugcacgaagcucugcauaaucacuacacacagaaaucccuuagccugucuccugga

SEQ ID NO: 45838 - RNA, 318 nt, Artificial Sequence
  derived and/or modified sequence opt5 from IgG1_HeavyChain_CH3_constant_domain
ggccagcccagagagccucaaguguacacccugccgcccagccgggacgaacucacaaagaaccaggucucccugacgugccuuguuaaaggguucuauccuucugauaucgcuguggagugggaaagcaauggacagcccgagaacaauuacaagaccacaccucccgugcuggacuccgauggcagcuuuuuccucuauucuaaacugaccgucgacaagucccgcuggcagcaagggaacguguuuucuuguagcguuaugcacgaagcccuucauaaucacuacacacagaaaucccugagccucucuccugga

SEQ ID NO: 45839 - RNA, 297 nt, Artificial Sequence
  derived and/or modified sequence opt5 from IgG2_HeavyChain_CH1_constant_domain
agcgccuccaccaagggccccucuguguucccucuggcuccgugcagcagauccacaucugagagcacggccgcgcucgggugucuggucaaagacuacuuucccgaaccuguuaccguguccuggaacucuggagcucuuacaagcggcgugcacaccuuccccgccguccugcaguccagcgggcucuacucucuguccagcgugguuacagugccuucuuccaauuuuggaacccaaacauauaccugcaacgucgaucauaagcccagcaauacgaaaguggacaagaccguu

SEQ ID NO: 45840 - RNA, 297 nt, Artificial Sequence
  derived and/or modified sequence opt5 from IgG2_HeavyChain_CH1_constant_domain
agcgccuccaccaagggccccucuguguucccucuggcuccgugcagcagauccacaucugagagcacggccgcgcucgggugucuggucaaagacuacuuucccgaaccuguuaccguguccuggaacucuggagcucuuacaagcggcgugcacaccuuccccgccguccugcaguccagcgggcucuauucucuguccagcgugguuacagugaccucuuccaauuuuggaacacaaaccuacacgugcaacgucgaucauaagccuagcaauaccaaaguggacaagacaguu

SEQ ID NO: 45841 - RNA, 327 nt, Artificial Sequence
  derived and/or modified sequence opt5 from IgG2_HeavyChain_CH2_constant_domain
gcucccccuguggccggcccgagcgucuuccuguuucccccuaagcccaaagacacccucaugaucuccagaacaccugagguuacgugcgugguggucgaugugucucacgaagaccccgagguucaguucaacugguacguggauggggucgaagugcauaaugccaagaccaaaccucgggaggaacaauuuaacagcacauuccgcguuguguccguccugaccguggugcaccaggacuggcuuaauggaaaggaguauaaauguaaggucucuaacaagggccugccggcgcccauugagaaaacaaucagcaagaccaaa

SEQ ID NO: 45842 - RNA, 327 nt, Artificial Sequence
  derived and/or modified sequence opt5 from IgG2_HeavyChain_CH2_constant_domain
gcucccccuguggccggcccgagcgucuuccuguuucccccuaagcccaaagacacccucaugaucuccagaacaccugagguuacgugcgugguggucgaugugucucacgaagaccccgagguucaguucaacugguacguggauggggucgaagugcauaaugccaagaccaaaccucgggaggaacaauuuaacagcacauuccgcguuguguccguccugaccguggugcaccaggacuggcuuaauggaaaggaguauaaauguaaggucucuaacaagggccugccggcgagcauugagaaaacaaucuccaagaccaaa

SEQ ID NO: 45843 - RNA, 327 nt, Artificial Sequence
  derived and/or modified sequence opt5 from IgG2_HeavyChain_CH2_constant_domain
gcucccccuguggccggcccgagcgucuuccuguuucccccuaagcccaaagacacccucaugaucuccagaacaccugagguuacgugcgugguggucgaugugucucacgaagaccccgagguucaguucaacugguacguggauggggucgaagugcauaaugccaagaccaaaccucgggaggaacaauuuaacagcacauuccgcguuguguccguccugaccguggugcaccaggacuggcuuaauggaaaggaguauaaauguaaggucucuaacaagggccugccgagccccauugagaaaacaaucuccaagaccaaa

SEQ ID NO: 45844 - RNA, 327 nt, Artificial Sequence
  derived and/or modified sequence opt5 from IgG2_HeavyChain_CH2_constant_domain
gcucccccuguggccggcccgagcgucuuccuguuucccccuaagcccaaagacacccucaugaucuccagaacaccugagguuacgugcgugguggucgaugugucucacgaagaccccgagguucaguucaacugguacguggauggggucgaagugcauaaugccaagaccaaaccucgggaggaacaauuuaacagcacauuccgcguuguguccguccugaccguggugcaccaggacuggcuuaauggaaaggaguauaaauguaaggucucuaacaagggccugccgagcuccauugagaaaacaaucucuaagaccaaa

SEQ ID NO: 45845 - RNA, 327 nt, Artificial Sequence
  derived and/or modified sequence opt5 from IgG2_HeavyChain_CH2_constant_domain
gcucccccuguggccggcccgagcgucuuccuguuucccccuaagcccaaagacacccucaugaucuccagaacaccugagguuacgugcgugguggucgaugugucucacgaagaccccgagguucaguucaacugguacguggaugggauggaaguccauaaugccaagaccaaaccucgggaggaacaauuuaacagcacauuccgcgugguuuccgugcugaccgucgugcaccaggacuggcuuaauggaaaggaguauaaauguaaggugucuaacaagggccugccggcgcccauugagaaaacaaucagcaagaccaaa

SEQ ID NO: 45846 - RNA, 327 nt, Artificial Sequence
  derived and/or modified sequence opt5 from IgG2_HeavyChain_CH2_constant_domain
gcucccccuguggccggcccgagcgucuuccuguuucccccuaagcccaaagacacccucaugaucuccagaacaccugagguuacgugcgugguggucgaugugucucacgaagaccccgagguucaguucaacugguacguggaugggauggaaguccauaaugccaagaccaaaccucgggaggaacaauuuaacagcacauuccgcgugguuuccgugcugaccgucgugcaccaggacuggcuuaauggaaaggaguauaaauguaaggugucuaacaagggccugccggcgagcauugagaaaacaaucuccaagaccaaa

SEQ ID NO: 45847 - RNA, 327 nt, Artificial Sequence
  derived and/or modified sequence opt5 from IgG2_HeavyChain_CH2_constant_domain
gcucccccuguggccggcccgagcgucuuccuguuucccccuaagcccaaagacacccucaugaucuccagaacaccugagguuacgugcgugguggucgaugugucucacgaagaccccgagguucaguucaacugguacguggaugggauggaaguccauaaugccaagaccaaaccucgggaggaacaauuuaacagcacauuccgcgugguuuccgugcugaccgucgugcaccaggacuggcuuaauggaaaggaguauaaauguaaggugucuaacaagggccugccgagccccauugagaaaacaaucuccaagaccaaa

SEQ ID NO: 45848 - RNA, 327 nt, Artificial Sequence
  derived and/or modified sequence opt5 from IgG2_HeavyChain_CH2_constant_domain
gcucccccuguggccggcccgagcgucuuccuguuucccccuaagcccaaagacacccucaugaucuccagaacaccugagguuacgugcgugguggucgaugugucucacgaagaccccgagguucaguucaacugguacguggaugggauggaaguccauaaugccaagaccaaaccucgggaggaacaauuuaacagcacauuccgcgugguuuccgugcugaccgucgugcaccaggacuggcuuaauggaaaggaguauaaauguaaggugucuaacaagggccugccgagcuccauugagaaaacaaucucuaagaccaaa

SEQ ID NO: 45849 - RNA, 318 nt, Artificial Sequence
  derived and/or modified sequence opt5 from IgG2_HeavyChain_CH3_constant_domain
ggccagcccagagagccucaaguguacacccugccgcccagccgggaagagaugacaaagaaccaggucucccucacgugccugguuaaaggguucuauccuucugacaucgccguggaaugggagagcaauggacagcccgaaaacaauuacaagaccacaccucccaugcuugauuccgacggcagcuuuuuccuguauucuaaacucaccguggauaagucccgcuggcagcaagggaacgucuuuucuuguagcgugaugcacgaggcucugcauaaucacuacacacagaaaucccuuagccugucuccugga

SEQ ID NO: 45850 - RNA, 297 nt, Artificial Sequence
  derived and/or modified sequence opt5 from IgG4_HeavyChain_CH1_constant_domain
agcgccuccaccaagggccccucuguguucccucuggcuccgugcagcagauccacaucugagagcacggccgcgcucgggugucuggucaaagacuacuuucccgaaccuguuaccguguccuggaacucuggagcucuuacaagcggcgugcacaccuuccccgccguccugcaguccagcgggcucuacucucuguccagcgugguuacagugccuucuuccagccuuggaaccaagacauauaccugcaaugucgaucauaaacccucuaacacgaagguggacaaacggguu

SEQ ID NO: 45851 - RNA, 330 nt, Artificial Sequence
  derived and/or modified sequence opt5 from IgG4_HeavyChain_CH2_constant_domain
gcccccgaguuccugggcgggccuagcguguuucucuucccgcccaagccuaaagacacccugaugaucuccagaacacccgaagucacgugcguugugguggaugucucucaggaggacccugaagugcaauuuaacugguacguugauggaguggagguccacaaugcuaagaccaaaccccgggaagaacaguucaacagcacauaucgcgugguuuccgugcuuaccguccugcaucaggacuggcucaauggcaaggaguacaaauguaaggugucuaacaaggggcugccuagcuccauugagaaaacaaucucuaaggccaaa

SEQ ID NO: 45852 - RNA, 318 nt, Artificial Sequence
  derived and/or modified sequence opt5 from IgG4_HeavyChain_CH3_constant_domain
ggccagcccagagagccucaaguguacacccugccgcccagccaggaagagaugacaaagaaccaggucucccucacgugccugguuaaaggguucuauccuucugacaucgccguggaaugggagagcaauggacagcccgaaaacaauuacaagaccacaccucccgugcuugauuccgacggcagcuuuuuccuguauucucggcucaccgucgauaaaucccgcuggcaagaggggaacguguuuucuuguagcguuaugcacgaggcucugcauaaucacuacacacagaagucccuuagccugucucucgga

SEQ ID NO: 45853 - RNA, 1347 nt, Artificial Sequence
  derived and/or modified sequence opt6 from AAB-003_gamma1-Chain
gaaguacaacuauuagaaagcggaggaggacuaguacaaccaggaggcucacuacgauuauccugcgcagcaucaggauuuacuuucucaaacuacggaaugucauggguaagacaagcaccaggaaaaggauuagaauggguagcaucaauacgaagcggaggaggaagaacauauuauuccgacaacguaaaaggacguuucacaaucucacgagauaacucaaaaaacacacuauaucuacaaaugaacucacuaagagcagaagacacagcugucuauuacugcgucagauacgaccauuacucaggcucaucagacuacuggggucagggaacacuuguuaccguaucaucagcauccacaaaaggaccauccguauucccucuagcccccucaucuaaaaguacaucaggaggaacagcagcauuaggaugccuaguuaaagauuacuucccagaaccaguaacaguauccuggaacucaggagcauuaacaucaggaguacacaccuuccccgcaguauuacaaucaucaggauuauauucacuaucaucaguaguaacugucccuagcuccucucuaggaacacaaacuuacauuugcaauguaaaccacaaaccaucaaacacaaaagucgacaaaaaaguagaaccuaaauccugcgauaaaacacauacaugucccccuugcccagccccagaggcagccggagcuccauccgucuuuuuauucccaccaaaaccaaaagauacucuaaugauaucaagaacccccgaaguaacaugcguaguuguagauguaucccaugaagacccugaaguaaaauucaauugguacguagacggaguugaaguacauaacgcaaaaacaaaaccucgagaggaacaauacaacucaacauacagaguaguauccguauuaacaguauuacaccaagacuggcuaaacggcaaagaauacaaauguaaaguauccaacaaagcacuaccagcaccaauugaaaaaacuauuucaaaagcaaaaggacaacccagagaaccccaaguauacacacuuccaccuucccgagaagaaaugacuaaaaaucaaguaucccuaacaugcuuaguaaaaggauucuacccaucagauauagcaguagaaugggaaagcaacggacaaccagaaaacaacuauaaaacaacccccccaguauuagauucagacggauccuucuucuuauauucaaaacuaacgguagacaaaucaagauggcaacaaggaaacguauuuucauguucaguaaugcaugaagcacuacauaaccacuauacacaaaaaucauuaucauuaagcccaggaaaa

SEQ ID NO: 45854 - RNA, 1329 nt, Artificial Sequence
  derived and/or modified sequence opt6 from Abagovomab_HeavyChain
caaguaaaacuacaagaauccggagccgaauuagcaagaccaggcgcaucagucaaauuaucuugcaaagcaucaggauacacuuuuacaaacuacuggaugcaauggguaaaacaaagaccuggacaaggacuagacuggauaggagcaauauacccaggagacggaaauacaagauacacacauaaauucaaagguaaagcaacacuaaccgcugauaaaucuucaucaacagcauacaugcaauuaucaucacuagcauccgaagacagcggaguauauuacugugcaagaggagaaggaaacuaugcaugguuugcauauuggggccaagguacaaccgucaccguaucaucagcaaaaacaacaccacccucaguuuacccccucgccccgggauccgcagcacaaacaaauucaaugguaaccuuagguugcuuaguuaaaggauacuucccagaaccaguaacagucaccuggaacucaggaucacuuuccuccgguguacacacauucccugccguacuacaaucugaccucuacacacuaucaucaucuguaacaguaccauccuccacauggccaucagaaacaguaacaugcaauguagcacauccugcaucuuccacaaaaguagacaaaaaaauaguaccaagagauuguggcugcaaacccugcauaugcaccguaccagaaguaucaucaguauucauauucccaccaaaaccaaaagacguacuaacaauaacucuaacaccaaaagucacauguguuguaguagacauaucaaaagacgauccagaaguccaauucuccugguuuguagaugauguagaaguacauacagcacaaacacaaccaagagaagagcaauucaacucaacauucagaucaguaucagaacuaccaauaaugcaucaagacugguuaaaugguaaagaauucaaaugcagagucaacucagcagcauuuccagcuccuauagaaaaaacaauauccaaaacuaaaggaagaccaaaagcaccacaaguauacacaauacccccaccaaaagaacaaauggcaaaagacaaaguaucacuaacauguaugauaaccgacuuuuuuccagaagacauaacaguugaauggcaguggaauggacaaccagcagaaaacuacaaaaauacacaacccauaauggauacagacggauccuacuucgucuauucaaaauuaaacguacaaaaauccaauugggaagcagggaauaccuucacuuguucaguucuacaugaaggacuucauaaucaucacacagaaaaaucacuaucacacucaccaggcaaa

SEQ ID NO: 45855 - RNA, 642 nt, Artificial Sequence
  derived and/or modified sequence opt6 from Abagovomab_LightChain
gauauagaauuaacacaaucucccgcaucacuaucagcaucaguaggagaaacaguaaccauaacaugccaagcaucagaaaacauauacucauacuuagcauggcaccaacaaaaacaaggaaaaucaccacaacuacuaguuuacaacgcaaaaacacuagcaggaggaguauccucaagauucucaggaucaggaucaggaacacacuucagcuuaaaaauaaaaucccuacaacccgaagacuucggcauauacuacugccaacaccacuacggaauacuaccaacauucggaggaggaacaaaacuagaaauaaaaagagcagacgcagcaccaacuguaagcauauucccaccauccucagaacaauuaacaucuggaggagcaucaguaguaugcuucuuaaacaacuuuuacccaaaagacauaaacguaaaauggaaaauagauggaucagaaagacaaaacggaguacuaaacucauggaccgaccaagacucaaaagacucaacauacucaaugucaucaacacuaacacuaacaaaagacgaauacgaaagacacaacucauacacaugcgaagccacacacaaaacauccacaucaccaauaguaaaaucauuuaacagaaacgaaugc

SEQ ID NO: 45856 - RNA, 1350 nt, Artificial Sequence
  derived and/or modified sequence opt6 from Abciximab_HeavyChain
gaaguacaacuacaacaaucaggcgccgaacuuguaaaaccaggcgccucagucaaacuaucauguaccgcuucaggauucaacauuaaagauacuuauguacacuggguaaaacaacgaccagaacaaggauuagaauggauaggacgaauagaccccgcaaacggauacaccaaauacgaccccaaauuucaaggaaaagcaaccauaacagcagauacauccucaaacacugcauauuuacaauuaucaucccucacaucugaagauacagcaguauauuauugcguaagaccauuauacgacuauuacgcaauggacuauuggggacaaggaacaucaguaacugucucaagcgcuaaaacaacugcaccaucagucuacccacuagccccagucugcggcgacacaacagguuccucagucacacuaggaugcuuaguaaagggauacuuccccgaaccaguaacccuuacuuggaacucaggaucacucuccagcggaguacauacauucccagcaguguugcaaagugauuuauacacacuauccuccucaguaaccguaacaucaucaacauggccaucacaauccauaacaugcaacguugcccaccccgcaucaaguacaaaaguagauaaaaaaauagaaccaagaccaaaaucaugugauaaaacacacacauguccaccaugcccagcaccugaacuauuaggaggaccuucaguuuuucuauucccaccaaaaccaaaagacacacuaaugauaucaagaacacccgaaguaacaugugucguuguagacguaucacacgaagacccugaaguaaaauucaacugguauguagauggcguagaaguacacaacgcuaaaacaaaacccagagaagaacaauauaacuccacauaccgugucguaagcguacuaacaguauuacaccaagacuggcuaaauggaaaagaauacaaauguaaaguaucaaacaaagcccucccagcaccaauagaaaaaacaauaucuaaagcaaaaggccaaccaagagaaccacaaguauacacauuaccaccuuccagagaugaacuaacaaaaaaccaaguuucacuaacaugccuaguaaaaggcuucuaccccucugacaucgcaguagaaugggaaucaaauggacaaccugaaaacaacuacaaaacaacaccuccaguacucgauucagaugguuccuuuuuccuauacucaaaguuaacaguagacaaaucaagauggcaacaaggaaacguauucuccuguucaguaaugcacgaagcauuacacaaucacuacacacaaaaaagccuauccuuaucaccaggaaaa

SEQ ID NO: 45857 - RNA, 642 nt, Artificial Sequence
  derived and/or modified sequence opt6 from Abciximab_LightChain
gacauauuaaugacacaaucacccucaucaaugucaguaagcuuaggugauacaguaucaauaacaugccacgcaucacaaggaauaucaucaaacauaggauggcuccaacaaaaaccaggaaaaucauucaugggauuaauauacuacggaacaaaccuaguagacggaguaccauccagauucuccggaucaggauccggcgcagacuacucacuaacaauaucaucacuagacucagaagacuucgcagacuacuacugcguacaauacgcacaacuaccauacacauucggaggaggaacaaaacuagaaauaaaaagagcagaugcagcaccaacaguaagcauauucccaccaucaucagaacaacuaacaucaggaggagcaucaguaguaugcuuccuaaacaacuucuacccuaaagacauaaacguaaaauggaaaauagacggaucagaaagacaaaauggcguacuaaacucauggaccgaccaagacucaaaagacuccacauacucaaugucauccacacuaacacuaacuaaagacgaauacgaaagacacaacucauacacaugcgaagcaacacacaaaacaucaacauccccaauaguaaaaucauucaacagaaacgaaugc

SEQ ID NO: 45858 - RNA, 1341 nt, Artificial Sequence
  derived and/or modified sequence opt6 from Abituzumab_HeavyChain1
caaguacaacuacaacaaucaggaggcgaauuagcaaaaccaggcgcaaguguaaaaguauccugcaaagcauccggauauacauucucaucauuuuggaugcacuggguucgacaagcaccaggacaaggcuuagaauggauagguuacaucaacccaagauccggcuauacagaauacaacgaaauauucagagauaaagcaacuaugaccacagacacuucaacaucuacagcauacauggaacuaucaucauuacgaucagaagacacagccguauacuacugcgcaucauucuuaggaagaggagcaauggacuacuggggacaagguaccacagucacaguauccuccgcaucuacaaaaggaccauccguauucccacuagcacccugcucacgaucaaccucagaaucaacagcagcauuaggaugccuaguaaaagacuacuuccccgaaccgguuacaguaucauggaauucaggagcacuaacaucaggaguacauacauuuccugcuguacuacaaucauccggauuauauucacuaucaucaguaguaacagugccaucaucaaacuuuggcacacaaacauacacauguaacguugaccauaaaccuucaaauacaaaaguugacaaaacaguagaacccaaaucaucagacaaaacucauacaugcccaccauguccagcacccccagucgcaggaccaucuguauuccuauucccaccaaaacccaaagacacacuaaugauaucaagaacaccagaaguaacuugcguaguaguagacgucagucacgaagacccugaaguccaauucaacugguacguagacggaguagaaguacacaaugcaaaaacaaaaccuagagaagaacaagcacaaucaacauuccgaguagucucaguccuaacaguaguacaucaagacuggcuaaacggaaaagaauauaaaugcaaaguuucaaauaaaggacuaccagcacccauagaaaaaacaauauccaaaacaaaaggacaaccuagagaaccacaaguauacacccuaccacccucaagagaagaaaugacaaaaaaccaaguaucuuuaacaugucuaguaaaaggcuucuauccauccgacaucgcaguugaaugggaauccaauggccaacccgaaaauaacuauaaaacuacaccaccaaugcuagauuccgacgggucauucuuucuauacucaaaacuaacaguagauaaaucaagauggcaacaaggaaacguauuuucauguuccgucaugcacgaagcuuuacacaaccacuacacccaaaaaucacucucauuaucacccggaaaa

SEQ ID NO: 45859 - RNA, 642 nt, Artificial Sequence
  derived and/or modified sequence opt6 from Abituzumab_LightChain1
gacauacaaaugacacaaucccccucuucacuaucagcaucaguaggagacagaguaacaauaaccuguagagcaucacaagacauaucaaacuaccuagcaugguaccaacaaaaaccaggaaaagcaccaaaacuauuaauauacuacacaucaaaaauccacucaggaguaccaucaagauucucaggaucaggaucaggaacagacuacacauucacaauaucaucacuacaaccagaagacauagcaacauacuacugccaacaaggaaacacauucccauacacauucggacaaggaacaaaaguagaaauaaaaagaacagucgcagcaccauccguauucauauucccaccaucagacgaacaauuaaaaucaggaacagcaucaguagucugccuauuaaacaacuucuacccaagagaagcaaaaguacaauggaaaguagacaacgcacuucaaucaggaaacucucaagaaucaguaacagaacaagacucaaaagacucaacauacucauuauccucaacacuaacccuauccaaagcagacuacgaaaaacacaaaguauaugcaugcgaaguaacacaccaaggacuaucaucaccaguaaccaaaucauucaacagaggcgaaugc

SEQ ID NO: 45860 - RNA, 1332 nt, Artificial Sequence
  derived and/or modified sequence opt6 from Abrilumab_HeavyChain1
caaguacaauuaguacaaucaggagccgaaguuaaaaaaccaggagccagugucaaaguaucaugcaaaguauccggcuacacucuauccgacuuaucuauacauugggucagacaagccccuggcaaaggacuagaauggaugggaggcuuugauccacaagacggagaaaccauauacgcucaaaaauuccaaggucgaguaacaaugaccgaagauaccucaacagacacagcuuacauggaacuaagcucccuaaaauccgaagacacagcaguuuacuauugcgcaacaggcucaucaucaucaugguuugaccccuggggacaaggaaccuuaguaacaguaucaucagcaucaacaaaaggcccaucagucuucccacuagccccaugcucucgaucuacaucagaaucuacagcagcacuaggauguuuaguaaaagauuacuucccagaaccaguaacaguaagcuggaauucaggagcacuaacaucaggaguucauacauuuccagcagucuuacaaucaaguggacuauauucacuaaguuccguaguaacaguaccauccagcaacuuuggcacacaaacuuacaccuguaacguagaccauaaaccaaguaauacuaaaguagauaaaacagucgaaagaaaaugcugcguagaaugcccaccaugcccagcaccaccagucgcaggcccaucaguuuuccucuuuccaccaaaaccaaaagacacucuaaugaucucaagaacaccagaaguuaccuguguaguaguagauguaucccacgaagauccagaaguacaauucaauugguacguagauggaguagagguacacaaugcaaaaacaaaaccuagagaagaacaauuuaacucaaccuuuagaguaguaucaguuuuaacuguaguacaucaagacugguuaaacggaaaagaauauaaaugcaaaguaucaaacaaaggauuaccagcaccaauagaaaaaacaauaucaaaaacaaaaggacaaccaagagaaccccaaguauacacacucccuccaucaagagaagaaaugacuaaaaaccaagucucacuaacaugccuaguaaaaggauuuuauccaagcgacauagcaguagaaugggaaaguaacggccaaccagaaaauaauuauaaaacaacaccaccaaugcuagacuccgauggaucuuucuucuuauacucaaaauuaacaguagacaaaucaagauggcaacaaggaaacguauuuucaugcagcguaaugcacgaagcuuuacacaaccacuauacucaaaaaucacuaucccucucaccaggaaaa

SEQ ID NO: 45861 - RNA, 642 nt, Artificial Sequence
  derived and/or modified sequence opt6 from Abrilumab_LightChain1
gacauacaaaugacacaaucacccucaucaguaucagcaucaguaggagaccgcguaacaauaacaugccgagcaucacaaggaauauccucaugguuagcaugguaccaacaaaaaccaggaaaagccccaaaacuauuaauauacggagcaucaaacuuagaaucaggaguaccaucaagauucucaggcucaggaucaggaacagacuucacauuaaccauaucaucacuacaaccagaagacuuugcaaauuacuacugccaacaagcaaacucauuccccuggacauucggacaaggaacaaaagucgaaauaaaaagaacaguagcagcaccaucaguauucauauucccaccaucagacgaacaacuaaaaucaggaacagcauccguaguaugccuacuaaacaacuucuacccaagagaagccaaaguccaauggaaaguagauaacgcacuacaaagcggaaacucacaagaaucaguaacagaacaagacucaaaagacucaacauacucacuaucaucaacauuaacccuaucaaaagcagacuacgaaaaacacaaaguauacgcaugcgaaguaacacaccaaggauuaucaucaccaguaacaaaaucauucaacagaggcgaaugc

SEQ ID NO: 45862 - RNA, 639 nt, Artificial Sequence
  derived and/or modified sequence opt6 from Abrilumab_LightChain1_variant2
caaauaguccucacacaaucaccagcaauaaugucagcaucaccaggagaaaaagucacaauaacaugcuccgcaucauccucaguauccuauaugaacugguuccaacaaaaaccaggaacaucaccaaaacuauggauauacucaacaucaaacuuagcaucaggaguaccagcaagauucucaggaucaggaucaggaaccucauacucacuaacaauaucaagaauggaagcagaagacgcagcaacauacuacugccaacaaagaucaucauacccaaauacauucggaggaggaacaaaauuagaaauaaaaagagcagacgcagcaccaacaguaucaauauucccaccaucaucagaacaauuaacaucaggaggagcaucaguaguaugcuuccucaacaacuucuacccaaaagacauaaacguaaaauggaaaauagacggaucagaaagacaaaacggaguccuaaauucauggacagaccaagacucaaaagacucaacauauucaaugucaucaacacuaacacuaacaaaagacgaauaugaaagacacaacucauacacaugcgaagcaacacauaaaacaucaacauccccaauaguaaaaucauucaacagaaacgaaugc

SEQ ID NO: 45863 - RNA, 1347 nt, Artificial Sequence
  derived and/or modified sequence opt6 from Actoxumab_HeavyChain1
gaaguacaacuuguacagucaggagccgaagucaaaaaaucaggugaaucacucaaaaucuccugcaaaggaucaggauacucauucacaucauacuggauuggauggguaagacaaaugcccggcaaaggauuagaauggaugggaauauuuuacccuggagacuccucaacacgcuacucaccaucuuuccaaggacaaguaacaauauccgcugacaaauccguaaauacagcauaucuccaauggucaucacuaaaagcaucagacacagcaauguacuauugcgcaagaagaagaaacuggggaaacgcauucgacauauggggacaaggaacaauggucacaguuucaucagcaucgacaaaaggaccaucugucuucccacuagcaccaucaucaaaaucaacuucuggaggaacagccgcucucggcuguuuaguaaaagacuauuuuccagaaccuguaacagucaguuggaacucaggagcauuaacaucaggaguacacacauuuccagccguuuuacaaucauccggacuuuacucauugucaucaguaguaacaguaccaucauccucauuaggcacacaaacauacauaugcaacguaaaucacaaacccucaaauacaaaagucgacaaaagaguagaaccaaaaucaugcgacaaaacacauacuuguccaccauguccagcaccagaauuacuaggaggucccucugucuuuuuauuuccaccaaaaccaaaagacacacuaaugauaucucguacuccagaaguaacaugugucguaguagacguaucucacgaagacccugaaguuaaauuuaacugguacgucgacggcguagagguacacaacgccaaaacuaaaccaagagaagaacaauauaacucaacauaccgaguaguaucaguuuuaacuguacuacaccaagacugguuaaaugguaaagaauauaaaugcaaaguaucaaauaaagcauuaccagcaccaauagaaaaaaccauaucuaaagcaaaaggacaaccaagagaaccacaaguauauacccuucccccaucacgagaagaaaugacaaaaaaccaaguaucacuaacaugcuuaguuaaaggcuucuaucccucagauauagcaguagaaugggaaucaaauggccaaccagaaaauaauuauaaaaccacccccccaguacuagacucagacggaucuuuuuuucuauacuccaaacuaacaguagauaaaucaagauggcaacaaggcaauguuuuuucuugcucaguaaugcaugaagcuuuacauaaccacuacacccaaaaaucacuuucauuaucuccaggcaaa

SEQ ID NO: 45864 - RNA, 645 nt, Artificial Sequence
  derived and/or modified sequence opt6 from Actoxumab_LightChain1
gaaauaguacuaacacaaucaccaggcacacuaucacuauccccaggagaaagagcaacucuaucuuguagagcaucacaaucaguaucaucaucauaccuagcaugguaccaacaaaaaccaggacaagcaccaagauuacuaauauacggagcaucaucaagagcaacaggaaucccagacagauucuccggaucaggaucaggaacagacuucacccuaacaauaagcagacuagaaccagaagacuucgcaguauacuacugccaacaauacggaucaucaacauggacauucggacaaggaacaaaaguagaaaucaaacgcacaguagccgcaccauccguauucauauucccacccucagacgaacaacuaaaaucaggaacagcaucaguaguauguuuauuaaacaacuucuacccacgagaagccaaaguacaauggaaaguagacaacgcacuacaaucaggaaacucacaagaaucaguaacagaacaagacucaaaagacucaacauacucacucucaucuacauuaacacuaucaaaagcagauuacgaaaaacacaaaguauaugcaugcgaaguuacacaccaaggauuaucuuccccaguaacaaaaucauucaacagaggagaaugc

SEQ ID NO: 45865 - RNA, 672 nt, Artificial Sequence
  derived and/or modified sequence opt6 from Adalimumab_HeavyChain
gaaguacaacuaguagaaucaggaggcggauuaguccaacccggaagaucacuaagauuaucaugugcagcaucaggauucacauucgaugacuacgcaaugcauuggguaagacaagcaccaggaaaaggacuagaauggguaucagcaauaacauggaacucaggacacauagacuacgcagacucaguagaaggaagauuuacaauaucaagagacaacgcaaaaaacucacuauaucuacaaaugaauucauuacgagcagaagacacagcaguauacuacugcgcaaaaguaucauaccuaucaacagcaucaucauuagacuauuggggacaaggaacacuuguuacaguaaguucagcaucaacaaaaggaccaucaguauucccacuagcaccaucaucaaaaaguacaagcggaggaacagcagcacuaggaugccuuguaaaagacuacuucccagaaccaguaacaguaucauggaacuccggagcacuaacaagcggaguacacacauucccagcuguacuacaaucaucaggauuauacucacuaucaucaguaguaacaguaccaucaucauccuuaggaacacaaacauauauaugcaauguaaaccacaaaccaucaaacacaaaaguagacaaaaaaguagaaccaaaaucaugc

SEQ ID NO: 45866 - RNA, 642 nt, Artificial Sequence
  derived and/or modified sequence opt6 from Adalimumab_LightChain
gauauacaaaugacacaaucacccuccucacuaucagccucaguaggagacagaguaacuauaacauguagagcaucacaaggaauccgaaacuacuuagcaugguaccaacaaaaaccaggaaaagcaccaaaauuacuaauauacgcagcaucaacauuacaaucaggaguaccaucaagauucucaggaucaggaucaggaacagacuucacacuaacaauaucaucacuacaacccgaagacguagcaacauauuacugccaaagauacaacagagcaccauacacauucggacaaggaacaaaaguagaaauaaaacgaacugucgcagcaccauccguauucauauucccacccucugacgaacaauuaaaaucaggaacagcaucagucguaugccuacuaaauaacuucuacccacgagaagcaaaaguucaauggaaagucgacaacgcauuacaaucuggaaacucacaagaaucaguaacagaacaagacucaaaagacucaacauacucccuaucaucaacucuaacauuaucaaaagcagacuacgaaaaacacaaaguauacgcaugcgaaguaacccaccaaggacuauccucaccaguaacaaaaucauuuaacagaggcgaaugc

SEQ ID NO: 45867 - RNA, 1359 nt, Artificial Sequence
  derived and/or modified sequence opt6 from Aducanumab_HeavyChain1
caaguucaacucguagaaucaggaggcggaguaguacagccaggaagaucccucagacuuucaugcgcugcauccggauuugcauuuuccucauacggaaugcacuggguacgacaagcaccaggcaaaggacucgaauggguagccguaauuugguucgacggaaccaaaaaauacuauacagauuccguuaaaggaagauuuacaauaucuagagacaacucuaaaaacacacuauauuuacaaaugaacacacuaagagccgaagauacagcaguauacuacugugcacgagaucgaggaauaggagcgagaagagguccauauuacauggauguaugggguaaaggaaccaccgucacaguauccucagcauccacuaaaggaccaucaguauuuccccucgcccccagcucaaaaucaacaucaggagguacugcagcacuaggaugccuaguaaaagacuauuuuccagaaccaguuacaguaucauggaauucaggcgcauuaacauccggaguacauacauuuccagcaguacuucaaucuucaggauuauauagucuaucuucaguaguaacagucccuucaucgucccuugguacucaaacauacauaugcaacguaaaccacaaaccaucaaacacaaaaguagacaaacgaguugaaccaaaauccugugacaaaacacauacaugcccaccaugucccgcacccgaacuacuaggcggaccaucaguauuucuauuuccaccaaaaccgaaagacacauuaaugauaucacgcacaccagaaguaaccugcguaguaguagauguuagucacgaagauccagaaguaaaauucaacugguauguugaugguguagaaguucauaaugcaaaaacaaaaccaagagaagaacaauacaauucaacauauagaguaguaucaguccuaaccguauuacaucaagacuggcucaacggaaaagaauacaaaugcaaagucuccaacaaagcacuaccagccccaauagaaaaaacaauaucaaaagcuaaaggccaaccgagagaaccacaaguauauacucuaccaccaucacgagaagaaaugacaaaaaaccaaguuucacuuaccugcuuaguaaaaggauucuacccaucagacauagcaguugaaugggaaucaaacggacaaccagaaaauaauuacaaaaccacaccuccaguacuagauucagacggauccuuuuuccuauauucaaaacuaacagucgacaaauccagauggcaacaagguaaugucuucucauguucaguaaugcacgaagcauuacacaaccauuacacacaaaaaagcuuaucccuaucaccagga

SEQ ID NO: 45868 - RNA, 642 nt, Artificial Sequence
  derived and/or modified sequence opt6 from Aducanumab_LightChain1
gacauacaaaugacacaaucaccaucaucccuaagcgcaucaguaggcgaccgaguaacaauaacaugccgcgcaucacaaucaauaucaucauaccuaaacugguaccaacaaaaaccaggaaaagcacccaaacuacuaauauacgccgcaucaucauuacaaucaggaguaccaagcagauucucaggaucaggaucaggaacagacuucacacuaaccauaucaucacuacaaccagaagacuucgcaacauacuacugccaacaaucauacucaacaccacuaacauucggaggcggaacaaaaguagaaauaaaaagaacaguagccgcaccauccguauucauauucccaccaucagacgaacaacuaaaaucaggaacagcaucaguaguaugcuuacuaaacaacuucuacccaagagaagccaaaguccaauggaaaguugacaacgcacuacaaucaggaaacucacaagaaucaguaaccgaacaagacucaaaagacucaacauacucauuauccuccacacuaaccuuaucaaaagcagacuacgaaaaacacaaaguauacgccugcgaagucacccaccaaggacuaucaucacccguaaccaaaucauucaauagaggagaaugc

SEQ ID NO: 45869 - RNA, 1359 nt, Artificial Sequence
  derived and/or modified sequence opt6 from Afasevikumab_HeavyChain1
gaaguacaacuaguagaaucuggaggaggacuaguacaaccaggaagaucauuacgauuauccugcgcagcaucuggauuuacauuugacgacuacgccaugcauugggucagacaagcaccaggaaaaggucuagaaugggucucaggaauaaacuggagcucgggaggaauagguuaugcagacucuguaaaaggaagauucacaauaaguagagauaacgcaaaaaauucauuauauuuacaaaugaacucccuaagagcugaagacacagccuuauacuauugugcuagagauaucgguggauuuggugaauucuauuggaacuuuggacuauggggacguggaacacuaguaacuguaucauccgcaaguacaaaaggaccuucaguuuucccauuagcacccucaagcaagucaacaucaggaggcacagcagcacuaggaugcuuaguuaaagacuauuucccugaaccuguaacaguuucauggaauagcggagcacuaacuagcggaguacacacguuccccgccguucuacaaucaucaggacuuuacucacuaucaucaguugucacuguaccuaguuccucauuaggaacacaaacauacauaugcaauguaaaccauaaaccaucaaacaccaaaguagauaaaagaguagaaccaaaauccugugauaaaacacauacuugcccaccuuguccagcaccagaacuauuaggaggaccaucaguauuuuuauuuccaccuaaaccuaaagauacauuaaugauaucaagaacaccagaaguaacauguguaguaguagauguuucccacgaggauccagaaguuaaauuuaacugguacguagauggaguagaaguacacaacgcgaaaacaaaaccaagagaagaacaauauaauucaacauacagaguuguuucaguccuaacaguauuacaccaagauuggcucaauggaaaagaauauaaaugcaaaguaucaaacaaagcccuaccagccccaauagaaaaaacaauaucuaaagcuaaaggacaaccuagagaaccacaaguuuauacauuacccccaaguagagaagaaaugacaaaaaaccaaguaucauuaacaugucucguaaagggauuuuauccaagugacauagccguugaaugggaaucaaauggucaaccagaaaacaacuauaaaacuacaccacccguucuagauucagauggaucauucuuuuuauauaguaaacuaacaguagauaaaucuagauggcaacaaggaaauguauuuagcuguucuguaaugcaugaagcucuacacaaucauuacacacaaaaaucacuuagucuaucaccaggaaaa

SEQ ID NO: 45870 - RNA, 645 nt, Artificial Sequence
  derived and/or modified sequence opt6 from Afasevikumab_LightChain1
gaaauaguacuaacccaaucaccagcaacacuaucccuaucaccaggagaaagagcaacacuaucaugccgagcaucacaaucaguaagaucauaccuagcaugguaucaacaaaaaccaggacaagcaccaagacuacuaauauacgacgcauccaacagagccacaggaauaccagcaagauucucaggaagcggaucaggaacagacuuuacacuaacaauaucaucacuagaaccagaagacuucgcaguauacuacugccaacaaagaucaaacuggccaccagcaacauucggaggaggaacaaaaguagaaauaaaaagaacaguagcagcaccaucaguauucaucuucccaccaucagacgaacaauuaaaauccggaaccgcaucaguaguaugcuuacuaaauaacuucuacccacgagaagcaaaaguacaauggaaaguagacaacgcacuacaaucaggaaacucacaagaaucaguaacagaacaagacucaaaagacucaacauacucacuaucaucaacauuaacacuaucaaaagcagacuacgaaaaacacaaaguauacgcaugcgaaguaacacaccaaggauuaucaucuccaguaacaaaaucauucaauagaggagaaugc

SEQ ID NO: 45871 - RNA, 1293 nt, Artificial Sequence
  derived and/or modified sequence opt6 from Aflibercept_Fusion_protein1
ucugacacaggaagaccauuuguagaaauguacucagaaauaccagaaauaauacacaugaccgaaggaagagaacuugucaucccaugcagaguaacaucaccaaauauaacaguaacacuaaaaaaauuuccacuagacacacuaaucccagacggaaaaagaauaauaugggacucaagaaaaggauuuauaauaucaaaugccacauacaaagaaauaggacuacuaacuugcgaagcaacaguaaauggacauuuauauaaaacaaacuaucuaacacauagacaaacaaauaccauaauagacguaguucuaucccccucucacggaauagaauuaucaguaggagaaaaacucguauuaaacugcacagcacgaaccgaacuaaauguaggaauagacuucaauugggaauauccaucaucaaaacaucaacacaaaaaacuagucaacagagaucuaaaaacccaaucaggcucagaaaugaaaaaauuccuauccacauuaacaauagauggcgucacccguucagaucaaggacuauacacaugcgcugccucaucaggccuaaugacaaaaaaaaauucaaccuucguaagaguccaugaaaaagauaaaacccacacauguccacccugcccagcaccagaacuacuaggaggaccaucaguuuucuuauucccaccaaaaccaaaagacaccuuaaugaucucacgcacaccagaaguaacaugcguaguuguagacguaucacaugaagauccugaaguaaaauuuaauugguacguagauggaguagaaguacacaacgcaaaaacaaaaccaagagaagaacaauacaacuccacauacagaguagucaguguauuaaccguccuacaccaagacuggcuaaacggaaaagaauacaaaugcaaaguaagcaauaaagcacuuccagccccuauugaaaaaacaauauccaaagcaaaaggacaaccaagagaaccacaaguuuacacacuaccuccaucuagagacgaacucacaaaaaaccaggucucccucaccugccuaguaaaaggauucuaccccucagacauagcaguagaaugggaauccaacggacaaccagaaaauaauuacaaaacuacuccaccaguauuagacucugauggaucauucuuccucuauaguaaacuuaccguagauaaaucaagauggcaacaaggaaacgucuucagcuguagcguaaugcacgaagccuuacacaaucacuacacacaaaaaagccuauccuuaucaccagga

SEQ ID NO: 45872 - RNA, 1332 nt, Artificial Sequence
  derived and/or modified sequence opt6 from Afutuzuab_HeavyChain1
caaguucaauuaguacaaucaggagccgaagucaaaaaaccaggaucaucaguaaaaguauccugcaaagcaucuggauacgccuuuaguuacucauggauuaauuggguaagacaagcuccaggacaaggauuagaaugggguagaauauuucccggagauggcgacaccgauuacaacggaaaauucaaaggaagaguaacaauaacagcagacaaaucaacaucuacggcauaugaacuaucuucgcuaagaucugaagacacagcuguauauuauugugcaagaaacguuuucgacggauacugguuaguauacuggggccaaggaacacuaguaacagucucuucagcaucaacaaaaggaccaucuguauucccauuagcaccaucuagcaaaucuacaucgggaggaacugcagcacuaggauguuuaguuaaagauuacuuucccgaaccaguaacagucucauggaauucaggagcccuaacaagcggaguacauacauuuccagcaguauuacaaucaucaggauuauacuccuuauccagcguaguaacaguaccaucaucaucuuuaggcacacaaacauauauauguaacgucaaccauaaaccaucaaauacaaaaguugauaaaaaagucgaaccuaaaucaugugauaaaacucacacauguccaccaugcccagcaccagaauuacuaggaggaccuuccgucuucuuauuuccuccaaaacccaaagacacauuaaucucacguacaccagaaguaacaugcguaguagucgauguaucucacgaagacccagaaguuaaauuuaacugguauguugacggaguagaaguacauaaugcaaaaaccaaaccaagagaagaacaauauaauucaacuuacagaguaguaucaguacuaacuguacuccaccaagauuggcuuaacggaaaagaauacaaauguaaagucucaaauaaagcacuaccugcaccaauagaaaaaacuauaucuaaagccaaaggccaaccuagagaaccacaaguauauacacuuccccccuccagagaugaauuaacaaaaaaucaaguuagccuaacauguuuaguaaaaggauuuuauccaucagauauagcaguagaaugggaaaguaauggucaaccagaaaauaauuauaaaacaacaccuccaguauuagauucagacggaucauucuuucucuauuccaaauuaaccguagauaaaucucgauggcaacaaggaaacguauuuucaugcagcguacacgaagcauuacacaaucacuacacucaaaaaucuuuaagucucucaccagga

SEQ ID NO: 45873 - RNA, 651 nt, Artificial Sequence
  derived and/or modified sequence opt6 from Afutuzuab_LightChain1
gacauaguaacccaaacaccacuaucacuaccaguaacaccaggagaaccagcaucaauaucaugcagaucaucaaaaucacuacuacacucuaacggaauaacauaccuauauugguaccuccaaaaacccggacaaagcccacaacuacuaauauaccaauccaaucuaguaucaggaguaccagacagauucucaggaucaggaucaggaacagacuucacacuaaaaauaucaagaguagaagccgaagacguaggaguauacuacugugcacaaaaccuagaauuaccauacacauucggaggaggaacaaaaguagaaauaaaaagaacaguagcagcaccaucaguauucauauucccaccaucagacgaacaacuaaaauccggaacagcaucaguaguaugcuuacuaaacaacuucuacccacgcgaagcaaaaguacaauggaaagucgacaacgcauuacaauccggaaacucacaagaaucaguaacagaacaagacucaaaagacucaacauacucacuaucaucaacacuaacauuaagcaaagcagacuacgaaaaacacaaaguauaugcaugcgaaguuacacaccaaggauuauccucaccaguaacaaaaucauucaacagaggagaaugu

SEQ ID NO: 45874 - RNA, 1347 nt, Artificial Sequence
  derived and/or modified sequence opt6 from Afutuzumab_HeavyChain1
caaguacaauugguucaauccggugcugaaguaaaaaaaccaggauccagcguaaaaguaucauguaaagcaagcggcuacgcuuucuccuauucauggauuaacuggguaagacaagcacccggccaagguuuagaauggaugggaagaauauucccaggcgauggugacacagauuacaacggaaaauucaaaggaagaguaacaauaacugcugacaaaucaacauccacagcauauauggaacucucaucacuuagaucugaagacacagcagucuacuauugugccagaaacguauucgauggauauugguuaguuuacuggggacaaggcacauuaguaaccguaucaucagcaucaacaaaagguccaucaguuuuuccauuagccccauccucuaaaucaacaucaggaggaacagcagcacuaggaugucuaguuaaagauuacuuuccagaacccguaacagucagcuggaacucuggagcccuaacuucaggaguucacacauuuccagcaguacuacaaucuucaggucuauacucacucucaucaguaguuaccguacccucaucaucacuagguacacaaacauacauauguaacguaaaccacaaaccauccaacacaaaaguagauaaaaaaguagaaccaaaauccugugacaaaacacauacaugcccuccaugcccugcuccagaacuacuaggagguccaucaguauucuuauucccaccaaaaccaaaagauacacuaaugauaucaagaacuccagaaguaacauguguaguugucgauguuagccacgaagauccagaaguaaaauucaacugguacguagauggaguagaaguacacaacgcaaaaacuaaaccaagagaagaacaauauaacucaacauaccgcguaguauccguacuuacaguacuacaccaagauugguuaaacgguaaagaauauaaaugcaaagucucaaauaaagcauuaccagcaccaaucgaaaaaacaauaucaaaagccaaaggacaaccuagagaaccacaaguauauacucuaccuccaucaagagacgaauuaacaaaaaaccaaguaucacuaacaugccuugucaagggauuuuauccaucagacauagcagucgaaugggaaucaaauggacaaccagaaaacaauuacaaaacuacaccaccaguuuuagacagugauggcucauucuucuuauacucaaaacuaacaguagacaaaagccgauggcaacaagguaacguuuucucauguucugucaugcaugaagcccuacacaaccacuacacacaaaaaucauuaucccuguccccaggaaaa

SEQ ID NO: 45875 - RNA, 657 nt, Artificial Sequence
  derived and/or modified sequence opt6 from Afutuzumab_LightChain1
gacauaguaaugacacaaaccccauuaucacuaccagucaccccaggagaaccagcaucaauaucuuguagaucaucaaaaucacuccuacacucaaacggaauaacauaccuauacugguaucuacaaaaaccaggacaaucaccacaacuacuaauauaccaaaugucaaaccuaguaucaggaguaccagacagauuuucaggaucaggaucaggcacagacuucacauuaaaaauaucaagaguagaagcagaagacguaggaguauacuacugcgcacaaaacuuagaacuaccauacacauucggaggaggaaccaaaguagaaauaaaaagaacagucgcagcaccaucaguauucauauuuccaccauccgacgaacaacuaaaaucaggaacagcaucaguagucugccuacuaaacaacuucuacccaagagaagcaaaaguccaauggaaaguagacaaugcacuacaaucaggaaauucacaagaauccguaacagaacaagacagcaaagacucaacauacucacuaucaucaacacuaacuuuaucaaaagcagacuacgaaaaacacaaaguauacgcaugcgaagucacacaccaaggacuauccucaccuguaacaaaaucauucaacagaggagaaugc

SEQ ID NO: 45876 - RNA, 684 nt, Artificial Sequence
  derived and/or modified sequence opt6 from Alacizumab_pegol_HeavyChain1
gaaguacaacuaguagaaucaggaggaggauuaguacaaccaggcgguagucuaagacuaucaugcgcagcaucaggauucacauucucaucauauggaaugucauggguacgacaagcaccaggaaaaggacuagaauggguagcaacaauaacaucaggaggaagcuacacuuacuauguagauagcguaaaaggaagauuuacaauuucaagagacaacgcaaaaaacacauuauauuuacaaaugaauucauuaagagcagaagauacagcuguauauuacuguguaagaauaggagaagaugcacuagacuauuggggacaaggaacauuaguaacugucucaagcgcaucaacaaaaggaccaucaguauuuccauuagccccaaguagcaaaucaacaucaggaggaacagcagcauuaggauguuuaguaaaagauuacuuuccagaaccaguaaccguaucauggaacucaggagcacuaacaucagguguacauacauuuccagcaguauuacaaucauccggauuauauucauuaucaaguguaguaacaguaccaaguucaucacuaggaacacaaacauauauauguaauguaaaucacaaaccaucaaauacaaaagucgauaaaaaaguagaaccaaaaucaugugauaaaacacauacaugugcagca

SEQ ID NO: 45877 - RNA, 642 nt, Artificial Sequence
  derived and/or modified sequence opt6 from Alacizumab_pegol_LightChain1
gacauacaaaugacacaaucaccauccagcuuauccgcauccguaggagacagaguaacaauaacaugcagagcaagccaagacauagcagguucacuaaacuggcuacaacaaaaaccaggcaaagcaauaaaaagauuaauauaugcaacaagcucacuagacucaggaguacccaaaagauucuccggaucaagaucaggaucagauuacacauuaacaauaagcucacuacaaccagaagacuucgccacauacuacugccuacaauacggaucauucccaccaacauucggacaaggaaccaaaguagaaauaaaaagaacaguagcagcaccaucaguauucauauucccaccaucagacgaacaacuaaaaucuggaacagcaucaguaguaugcuuacuaaacaacuucuacccaagagaagcaaaaguacaauggaaagucgacaacgcacuacaaucaggaaacucacaagaauccguaacagaacaagacucaaaagacucaacauacucacuaucauccacacuaacacuaucaaaagcagacuacgaaaaacacaaaguauacgcaugcgaaguaacacaccaaggacuaagcucaccaguaacaaaauccuucaacagaggagaaugc

SEQ ID NO: 45878 - RNA, 1353 nt, Artificial Sequence
  derived and/or modified sequence opt6 from Alemtuzumab_HeavyChain
caaguacaacuacaagaaucagguccaggucuaguuagaccaucucaaaccuuauccuuaacaugcacaguaaguggauucaccuucacagacuucuacaugaacuggguacgacaaccuccuggaagaggacucgaauggauaggauucauuagagauaaagcaaaaggauacacaacagaauacaacccaucaguaaaaggucgaguaacaaugcuaguagacacauccaaaaaucaguucuccuuaagacuaucaucaguaacagccgcagacacagcagucuacuacugugcucgcgaaggacacacagccgccccauuugacuacuggggacaaggaucccuaguaaccguaucuucagccucaacaaaaggaccaucugucuucccacuagcaccuucaagcaaaucuacaucuggaggaacagcagcccuagguugucuaguaaaagacuacuucccagaaccaguaacaguaucuuggaacucuggcgcauuaacuucaggaguacauacauucccugcuguacuacaaucaucaggauuauauucauuaucaucuguaguaacaguacccucaucaucauuaggcacacaaacauauauauguaauguaaaccacaaaccauccaauaccaaagucgauaaaaaaguugaaccaaagucaugcgacaaaacacauacauguccaccaugcccagcaccagaacuacuaggaggaccauccguauuuuuauucccacccaaaccaaaagacacccuaaugauaucaagaaccccagaaguaacaugcguaguugucgacguaucacacgaagacccagaaguaaaauucaacugguauguagauggaguugaaguacacaaugcaaaaacaaaaccaagagaagaacaauacaacucaacauacagaguagucucaguacuaaccguacuacaucaagacugguuaaauggaaaagaauacaaauguaaaguaucaaauaaagcacuaccagcaccaauagaaaaaacuauauccaaagcaaaaggacaaccaagagaaccucaagucuacacacuaccaccaucaagagacgaacuaacaaaaaaccaaguaucacuuaccugccuuguuaaaggcuucuacccaagugauauagcaguagaaugggaaucaaauggacaaccagaaaacaacuacaaaaccacaccuccaguacuagacucagacgguucauucuuccucuacucuaaauuaaccguagauaaaucacguuggcaacaaggaaacguauucaguugcuccguuaugcacgaagcacuacacaaccacuacacccaaaaaucacucucacuaucaccaggaaaa

SEQ ID NO: 45879 - RNA, 657 nt, Artificial Sequence
  derived and/or modified sequence opt6 from Alemtuzumab_HeavyChain_variant_1bey_H
caaguacaauuacaagaaucaggaccaggcuuaguaagaccaucccaaacauuaucccuaacauguacaguaucaggcuuuacuuucacagacuucuacaugaacuggguaagacaaccuccaggaagaggacuagaauggauaggauuuauaagagacaaagcaaaaggauacacaacugaauauaacccaucaguaaaaggaagaguuacaaugcuaguagacacuucaaaaaaccaauucucacuaagacuaucaucaguaacagcagcagauacagcaguauacuacugcgcaagagaaggacacacagcagcuccauucgacuacuggggacaaggaucacuaguaacaguauccucagcaucaacaaaaggaccaucaguauuuccauuagcaccauccucaaaaucaacaucaggaggaacagccgcacuaggaugccuaguaaaagauuacuucccagaaccaguaacagucucauggaacucuggagcacuaacauccgguguacacacauuuccagcaguacuacaaucaucaggacuauauucauuaucaucaguaguaacaguucccucaucaucacuaggaacacaaacauacauauguaacguaaaccacaaaccuucaaacacaaaaguagacaaaaaagua

SEQ ID NO: 45880 - RNA, 660 nt, Artificial Sequence
  derived and/or modified sequence opt6 from Alemtuzumab_HeavyChain_variant_1ce1_H
caaguacaauuacaagaauccggaccaggacuaguaagaccaucacaaacacuaucauuaacaugcacaguauccggauucacauucacagacuuuuauaugaacuggguaagacaaccaccaggaagaggacuagaauggauaggauucaucagagauaaagcaaaaggauacacaacagaauacaacccaucaguaaaagguagaguaacaaugcuaguagacaccucaaaaaaccaauucucacucagacuauccucaguaacagcagcagacaccgcaguauauuacugcgcacgagaaggacacacagcagcaccauucgacuacuggggacaaggauccuuaguaacaguaucuucagcaucaacaaaaggaccaucuguauuuccauuagcaccaucaucuaaaucaacaucaggaggaacagcagcacuaggaugccuaguaaaagacuauuuuccagaaccaguaacagucucauggaacucaggagcauuaacauccggaguacacacauucccagcaguauuacaaucaucaggccuauacucauuaucaucaguaguaacaguaccauccuccucacuaggaacacaaacauacauaugcaacguaaaccacaaaccaucaaacacaaaaguagacaaaaaaguagaa

SEQ ID NO: 45881 - RNA, 1311 nt, Artificial Sequence
  derived and/or modified sequence opt6 from Alemtuzumab_HeavyChain_variant_8005_H
caagugcaauuacaagaaucaggaccaggacucgucagaccaucacaaacauuaucacuaaccugcacuguuucaggauucacauuuacagacuucuacaugaauuggguaagacaaccaccaggcagaggcuuagaauggauaggauucauaagagacaaagcaaaaggauacaccacagaauacaacccaucaguaaaaggaagaguuacaauguuaguagacacaucuaaaaaucaauuuucacuacgucucucaucagucacagcugcagacaccgcaguauacuauugcgcaagagaaggacacacggcagcaccauucgauuauuggggccaaggaucacuaguaacaguaaguucugcaucaaccaaaggaccaucugucuuuccacuagccccaucaucaaaaucaacuucaggcggaacagcagcacuagguugcuuaguaaaagacuacuucccagaaccaguaaccguaucuuggaacucaggagcacuuacaucaggaguacacacuuucccagcuguacuacaaucaucaggccuuuacucacugucuucaguaguaaccguaccuucaucaucauuaggcacacaaacauacauaugcaacguaaaccacaaaccaucaaacacaaaaguagacaaaaaaguagaagcacccgaacuacuaggaggaccaucaguauuucucuuuccacccaaaccaaaagacacacucaugauuucaagaaccccagaaguaaccuguguaguaguugauguuucccacgaagauccggaaguuaaauuuaacugguacguagacggcguugaaguucauaaugcaaaaaccaaaccaagagaagaacaauauaacucaacuuauagaguaguaucaguucuuacaguacuacaucaagauugguuaaauggaaaagaauauaaaugcaaaguaucaaacaaagcauuaccagcaccaauagaaaaaacaauaucuaaagcaaaaggacaaccaagagaaccacaaguauacacauuaccaccaucccgagacgaauuaacaaaaaaccaaguaucauuaacaugccuaguaaaaggauuuuauccaucagauauagcaguagaaugggaaucuaacggucaaccagaaaacaacuauaaaacuacuccaccagucuuagacucagacggaucuuuuuuccuuuauucaaaauuaaccguagacaaaucacgauggcaacaaggaaacguauucuccuguucuguaaugcaugaagccuuacauaaucauuacacacaaaaaucacuaucuuuaucaccaggaaaa

SEQ ID NO: 45882 - RNA, 633 nt, Artificial Sequence
  derived and/or modified sequence opt6 from Alemtuzumab_LightChain
gacauacaaaugacacaaucaccaucaucacuaucagcaucaguaggagauagaguaacaaucacaugcaaagcaucacaaaacauagacaaauaucuaaacugguaccaacaaaaaccaggaaaagcacccaaacuccucauauacaacacaaacaaccuacaaaccggaguaccaucacgauucucaggaucaggaucaggaacagacuuuacauucacaauaucaucauuacaaccugaagacauagcaacauauuacugccuacaacauauaucaagaccaagaacauucggacaaggaacaaaaguagaaauaaaaagaacaguagcagcaccaucaguauucauauucccacccucagacgaacaacuaaaaucaggaacagcaucaguaguaugccuacuaaacaacuucuacccaagagaagcaaaaguacaauggaaaguagacaacgcacuacaauccggaaacucccaagaaucaguaacagaacaagacucaaaagacucaacauacucccuaagcucaacacuaacauuaucaaaagcagacuacgaaaaacacaaaguauacgcaugcgaaguaacccaccaaggacucucaucacccguaacaaaauccuucaaccga

SEQ ID NO: 45883 - RNA, 642 nt, Artificial Sequence
  derived and/or modified sequence opt6 from Alemtuzumab_LightChain_variant_8005_L
gacauacaaaugacacaauccccaucaucacuauccgcaucaguaggagacagaguaacaauaacaugcaaagcaucacaaaacauagacaaauaccuaaacugguaccaacaaaaaccaggaaaagcaccaaaacuacuaaucuacaacacaaacaaccuacaaacaggaguacccucaagauucucaggaucaggaucaggaacagacuuuacauucacaauaucaucacuacaaccagaagacauagcaacauacuacugccuacaacauauaucacgcccaagaacauucggacaaggaacaaaaguagaaauaaaaagaacaguagcagcaccaucaguauucauauucccaccaucagacgaacaacuaaaaucaggaacagcaucagucguaugccuacuaaacaacuucuacccaagagaagcaaaaguacaauggaaaguagauaacgcacuacaauccggaaacucacaagaaucaguaacagaacaagacuccaaagacucaacauacucauuaucauccacacuaacacuaucaaaagcagacuacgaaaaacacaaaguauacgcaugcgaaguaacacaccaaggacuaucaucaccaguaaccaaaucauucaacagaggcgaaugc

SEQ ID NO: 45884 - RNA, 1341 nt, Artificial Sequence
  derived and/or modified sequence opt6 from Alirocumab_HeavyChain1
gaaguacaauuaguagaauccggcggcggacuaguucaaccaggaggaucacuaagacuaucaugugcagccucaggauucaccuucaacaauuacgcaaugaauuggguaagacaagcaccaggaaaaggccuagacugggucaguaccauaagugguucuggaggaacaaccaacuacgcagauagcguaaaaggaagauuuaucaucucaagggacucaucaaaacacacauuauacuuacaaaugaacucacuaagagcagaagacacagcaguauauuacugugcaaaagacucaaauuggggaaauuuugaucuauggggaagaggcaccuuaguaacaguaucaucagcaucuaccaaaggaccauccguauucccacuagcaccauccucaaaaucaaccucaggaggaacagcagcccuaggaugcuuagucaaagacuauuuccccgaaccaguuacaguauccuggaauucaggcgcauuaacaucagguguacacaccuucccagcaguauuacaaucaucagguuuauacucacuaaguuccguaguaacaguaccaucaucaucauuaggcacucaaacauacaucuguaacguaaaccauaaaccaucaaacacaaaaguagacaaaaaaguagaaccaaaaaguugcgacaaaacacacacaugcccacccuguccagcuccagaacuacuaggaggaccaucaguuuuucuauuucccccaaaaccaaaagacacacuaaugauauccagaacaccagaaguaacuugugucguaguagacguaucacacgaagauccagaagucaaauucaauugguacgucgacgguguagaagugcauaacgcaaaaaccaaaccaagagaagagcaauacaauuccacauauagaguuguauccguccuaacaguucuccaccaagauuggcuuaacggaaaagaauacaaauguaaaguaucaaacaaagccuuacccgcacccauagaaaaaaccaucuccaaagcaaaaggacaaccaagagaaccacaaguauauacacucccacccucaagagacgaacuaacuaaaaaucaaguaucacuuaccugucuaguaaaagguuucuacccaucugauauagcaguagaaugggaaucuaauggacaaccagaaaacaacuacaaaacaacaccaccaguacuagacuccgacggcagcuucuucuuauacucaaaacuaacaguagacaaaucaagauggcaacaaggaaacguauuuucauguucaguaaugcaugaagcucuacacaaucacuauacccaaaaaucauuaucuuuaagcccaggc

SEQ ID NO: 45885 - RNA, 660 nt, Artificial Sequence
  derived and/or modified sequence opt6 from Alirocumab_LightChain1
gauauaguaaugacacaaucaccagacucacuagccguaagccuaggcgaaagagcaacaauaaacugcaaaucaagccaaucaguacuauaucgaucaaauaaccgaaacuuccuaggaugguaccaacaaaaaccaggacaaccaccaaaccuacuaauauacugggcaagcacaagagaaagcggaguaccagacagauucucaggaucaggaucaggaacagacuucacacuaacaauaucaucacuacaagcagaagacguagcagucuacuacugccaacaauacuacacaacaccauacacauucggacaaggaacaaaacuagaaauuaaaagaacagucgcagcaccauccguauucauauucccacccucagacgaacaauuaaaaucaggcacagcaucaguaguauguuuacuaaacaacuuuuacccacgagaagcaaaaguacaauggaaaguagauaacgcacuacaaucaggaaacucacaagaaagcguaacagaacaagacucaaaagacucaaccuacucacuaucaucaacacuaacuuuaucaaaagcagacuacgaaaaacacaaaguauacgcaugcgaagucacacaccaaggcuuauccucaccaguaaccaaaagcuucaacagaggagaaugc

SEQ ID NO: 45886 - RNA, 735 nt, Artificial Sequence
  derived and/or modified sequence opt6 from ALX-0061_HeavyChain1
gaaguacaacuaguugaaucagguggaggauuaguacaaccaggaggaaguuuaagauuaaguugugcagcaagugggaguguauuuaaaauaaacguuauggcaugguauagacaagcaccuggaaaaggaagagaauuaguagcaggaauaauaaguggaggaucaacaaguuaugcagauaguguaaaaggaagauuuacaauaucaagggauaaugcaaaaaauacauuauauuuacaaaugaauaguuuaagaccagaagauacagcaguauauuacugugcauuuauuacaacagaaucagauuaugauuuaggaagaagauauuggggacaaggaacacuaguaacaguaagcagcggaggagggggaucaggaggaggaagugaagugcaauuaguagaaaguggaggaggguuaguacaaccaggaaauaguuuaagauuaagcugugcagcaaguggauuuacauucaguagcuuuggaaugucauggguacgacaagcaccaggaaaaggauuagaauggguaagcaguauaagcggaucaggaagugacacauuauaugcagauagugugaaaggaagauucacuauaaguagggacaaugcaaaaacaacauuauaucuacaaaugaauagcuuaagaccagaagauacagcgguauauuauuguacaauaggaggaagcuuaucaagaagcucacaaggaacauuaguaacaguaaguagu

SEQ ID NO: 45887 - RNA, 1347 nt, Artificial Sequence
  derived and/or modified sequence opt6 from Amatuximab_HeavyChain1
caaguacaauuacaacaauccggcccagaacuagaaaaaccaggugccucaguaaaaauaucaugcaaagccagcgguuacagcuucacaggauacacaaugaauugggucaaacaaucucacggaaaaagccuagaauggauaggccuaauaaccccauacaacggcgcaucaucuuauaaccaaaaauucagaggaaaagcuacauuaaccguagacaaaucaucaucaacagcauauauggaccuccuaucacuaacaucagaagauucagcaguauacuuuugcgccagaggcggauacgacggacgaggauucgacuauuggggaucaggaaccccaguuacaguaucaucagcaucaacuaaaggacccucaguauucccucuagcacccucaucaaaauccaccucaggagguacagccgcacuagguugccuuguaaaagacuacuucccagaaccagucaccguauccuggaauucaggagcauuaaccaguggaguacacaccuuccccgcaguccuacaaucgucaggacucuauucucuauccucaguaguaaccguaccaucaucaucacuaggcacacaaacuuauauaugcaacguaaaucacaaaccauccaauaccaaaguagacaaaaaaguagaaccaaaaucaugugacaaaacccacacauguccuccauguccagcaccagaauuacuuggaggaccauccguauuucuauuucccccaaaaccaaaagauacacuuaugauuucaagaacuccagaaguaacaugcguagucguagacguaucacaugaagaccccgaaguuaaauucaacugguacguagacggaguagaaguacacaaugcaaaaacaaaaccuagagaagaacaauacaacucaaccuaccgaguaguaucagucuuaacaguccuacaccaagacugguuaaacggaaaagaauacaaaugcaaaguuucaaauaaagcauuaccagcaccaaucgaaaaaacaauauccaaagcaaaaggucaaccacgagaaccacaaguauacacacuaccaccaucuagagacgaacuaacaaaaaaucaaguaucauuaaccugccuuguaaaaggauucuauccauccgauauagcaguugaaugggaaaguaacggacaaccagaaaacaauuauaaaacaaccccaccaguucuagacucagacggaucauucuucuuauacucaaaacuaacaguagauaaaucaagauggcaacaaggaaacguauucucaugcucugucaugcacgaagccuuacauaaccacuacacacaaaaaucauuaucacuauccccaggaaaa

SEQ ID NO: 45888 - RNA, 639 nt, Artificial Sequence
  derived and/or modified sequence opt6 from Amatuximab_LightChain1
gacauagaacuaacacaaucaccagcaauaaugucagcaucaccaggagaaaaaguaacaaugacaugcucagcaucaucaucaguaucauacaugcacugguaccaacaaaaaucaggaacaucaccaaaaagauggauauacgacacaucaaaacuagcaucaggcguaccaggaagauucucaggaucaggaucaggaaacucauacucacuaacaauaaguucaguagaagcagaagacgacgcuacauacuacugccaacaauggagcaaacauccacuaacauucggaucaggaacaaaaguagaaauaaaacgaacaguagcagcaccaucaguauuuauauucccaccaucagacgaacaacuaaaaucaggaacagcaucaguaguaugccuacuaaacaacuucuacccaagagaagcaaaaguucaauggaaaguagacaacgcacuacaaagcggaaacucacaagaaucaguaacagaacaagacuccaaagacucaacauacucacuaucauccacacuaacacuaucaaaagcagacuaugaaaaacacaaaguauacgcaugcgaaguaacacaccaaggacuaucaucaccaguaacaaaaagcuucaacagaggagaaugc

SEQ ID NO: 45889 - RNA, 1350 nt, Artificial Sequence
  derived and/or modified sequence opt6 from Anetumab_ravtansine_HeavyChain1
caaguagaauuaguccaauccggagcugaaguaaaaaaaccaggagaaucacuuaaaauaucauguaaaggaaguggauacucauuuaccucauacuggauaggauggguaagacaggcaccaggaaaaggacuagaauggaugggaauaauagacccuggugauucacguacucguuauucaccaucauuccaaggacaaguuacaaucucagcagacaaaucaauaucaacagcauaucuccaauggucuucucucaaagccagcgauacagcaauguauuauugugccagaggacaauuauacggaggaacauauauggauggauggggacaaggaacacuagucacagucucaucagcuagcaccaaaggaccaucaguauuuccacuagcaccaucaucaaaauccaccucaggaggaacagcagcauuaggaugcuuagucaaagacuauuucccagaaccaguaacaguaagcuggaauucaggagccuuaacaucaggcguccacacguuuccagcaguacuacaaucaucaggauuauauuccuuaucaucaguugugacuguaccuucaagcucacuaggcacacaaacauacauuugcaacguaaaccacaaaccaucaaacacaaaaguagauaaaaaagucgaaccaaaaagcugugacaaaacucauacaugcccccccugucccgcaccagaauuacuagguggaccaucaguauuccuauucccaccaaaaccaaaagauacacuaaugauaucaagaacacccgaaguaacaugcguaguaguugacguaucacacgaagauccagaaguaaaauuuaauugguacguagacggcguagaaguccauaaugcaaaaacaaaaccaagagaagaacaauacaacucuacuuauagaguaguaucaguacuaacuguacuacaccaagauuggcuaaauggaaaagaauacaaaugcaaaguaucaaauaaagcacuuccugcaccaauagaaaaaacaaucucaaaagccaaaggacagccacgugaaccacaaguauauacucuaccacccucacgcgacgaacuuacaaaaaaucaagucucuuugaccugcuuaguaaaaggauucuacccaucugacauagcuguagaaugggaaaguaacggacaaccagagaauaauuacaaaacuacaccaccagucuuagacucagacggcucauuuuuuuuauacucuaaauuaacaguagacaaaucaagauggcaacaaggaaacguauuuucuugcucaguaaugcaugaagcuuuacacaaucacuacacccaaaaaucccuaucccuuucaccaggaaaa

SEQ ID NO: 45890 - RNA, 651 nt, Artificial Sequence
  derived and/or modified sequence opt6 from Anetumab_ravtansine_LightChain1
gacauagcccuaacacaaccagcaucaguaucaggaucaccaggccaaucaauaacaauaucaugcacaggaacaucaucugacauaggaggcuacaacucagucagcugguaccaacaacacccaggaaaagcaccaaaacuaaugauauacggaguaaacaauagaccuucaggaguaucaaacagauucucaggaucaaaaucaggaaacaccgcaucacuaacaauaucaggauuacaagcagaagacgaagcagacuacuacuguucaucauacgacauagaaucagcaacaccaguauucggaggaggcacaaaacuaacaguauuaggccaaccaaaagcagcaccaucaguaacacuauucccaccaucaucagaagaauuacaagcaaacaaagcaaccuuaguaugccuaaucucagacuuuuacccaggagcaguaacaguagcauggaaaggagacucaucaccaguaaaagcaggagucgaaacaacaacaccaucaaaacaaucaaacaacaaauaugcagcaucaucuuaccuaucacuaacuccagaacaauggaaaucacacagaucauacucaugccaaguaacacacgaaggaucaacaguagaaaaaacaguagcaccaacagaaugcucc

SEQ ID NO: 45891 - RNA, 1341 nt, Artificial Sequence
  derived and/or modified sequence opt6 from Anifrolumab_HeavyChain1
gaaguacaacuaguacaaucaggagcagaaguaaaaaaacccggagaaucacuaaaaauaucuugcaaaggaucaggauacauauucacaaacuacuggauagccuggguaagacaaaugcccggcaaaggacuagaaucaaugggaauaaucuauccaggagauucagacaucagauacucaccaucuuuucaaggacaaguaacaauaucagcagauaaauccauaacaacagcauaccuacaaugguccagccuaaaagcaucagacacagcaauguacuauugcgcaagacacgacauagaaggcuuugacuacuggggaagaggcacauuagucaccguaucaucagcaucaacaaaaggaccaucaguauucccacucgcaccaucaucuaaaucuacaucaggaggcacagcagcauuaggaugcuuaguaaaagauuacuucccagaaccuguaacaguaucauggaacucaggagcacuaacuucaggcguacacaccuuuccagcaguacuacaaucauccggacuauacucauuauccucaguaguaaccguaccaucaucaucccuaggaacucaaacauacaucugcaacguaaaucacaaaccaucaaacacuaaagucgacaaacgcguagaaccaaaaucaugcgauaaaacacacacaugcccucccugcccagcaccagaauucgaaggaggaccaucaguauuuuuauuccccccuaaaccaaaagauacauugaugauaucaagaacaccagaaguaacaugcguaguagucgacguaucccacgaagaccccgaaguuaaauucaacugguacguagacggaguagaaguacauaacgcaaaaaccaaaccaagagaagaacaauacaacucaacuuacagaguaguaagcgucuuaacaguacuacaccaagacugguuaaauggaaaagaauacaaaugcaaaguaucaaacaaagcacuuccagcauccauagaaaaaacaauaucaaaagccaaaggacaaccaagagaaccucaaguauacacccuaccaccaagucgcgaagaaaugacaaaaaaucaaguaucacuuaccuguuuaguaaaaggcuucuacccaucagacauagccguugaaugggaaucaaacggacaaccagaaaacaacuacaaaacaacaccaccuguucuagacuccgacggaucguuuuuccuauacucuaaacugacaguagacaaauccagguggcaacaaggaaacguauucuccuguucgguaaugcacgaagcacuacauaaccacuacacacaaaaaucacuaucacuauccccagguaaa

SEQ ID NO: 45892 - RNA, 645 nt, Artificial Sequence
  derived and/or modified sequence opt6 from Anifrolumab_LightChain1
gaaauaguacuaacacaaucaccaggaacacuaucacucucaccaggagaaagagcuacacuaucaugcagagcaucacaaucaguaucaucaucauucuucgcaugguaccaacaaaaaccaggacaagcacccagauuacuaauauacggagcaucaucacgagcaacaggaauacccgaccgauuaucaggaucaggaucaggaacagacuucacacuaacaauaacaagacuagaaccagaagacuucgcaguauacuauugccaacaauacgacucaucagcaaucacauucggacaaggaacaagacuagaaauaaaaagaacaguagcagccccaucagucuucauauucccaccaucagacgaacaauuaaaaucaggaacagcaucuguaguaugccuauuaaacaacuucuacccaagagaagcaaaaguacaauggaaaguagacaacgcauuacaauccggaaacucacaagaaucaguaacagaacaagacucaaaagauucaacauacucacuaucauccacauuaacacuauccaaagccgacuacgaaaaacacaaaguauacgcaugcgaagucacccaccaaggauuaucaucacccguaacaaaaucauucaacagaggcgaaugc

SEQ ID NO: 45893 - RNA, 1344 nt, Artificial Sequence
  derived and/or modified sequence opt6 from Anrukinzumab_HeavyChain1
gaaguacaacuaguagaaucuggaggcggcuuaguacaaccaggcggaucauuaagacuaucaugcgccgcuucagguuuuacuuuuauaucauacgccaugucaugggucagacaagcaccaggaaaaggacucgaaugggucgcuucaauaucaucaggaggaaacacuuauuauccugacucagucaaaggcagauucaccauuucucgggacaacgccaaaaauucauuauaucuacaaaugaauucacuaagagcugaagauacugcaguauauuacugugccagauuagauggauacuauuuuggauuugcauauuggggacaaggcacacuagugacaguauccucugccucaacaaaagguccuucaguauucccucuagcaccuucaucaaaaucaacaucuggaggaacagcagcacuaggaugucucguaaaagacuauuucccagaaccaguuacuguuucauggaacucaggcgcacuaaccucagguguacauacauuucccgcagucuuacaaucaucaggccuauauucauuaucaucaguaguaacaguuccuucaucaucacucggaacccaaaccuauauuuguaauguaaaccacaaaccuucaaauacaaaaguagauaaaaaaguugaaccaaaaucaugugacaaaacacauacauguccaccuugcccagcacccgaagcuuuaggugcaccaucaguauuuuuauucccaccuaaaccaaaagacacacucaugauaucaagaacacccgaagucaccuguguuguaguagauguaucacaugaagacccugaaguaaaauucaacugguauguagauggaguagaaguccacaaugcaaaaacaaaaccaagagaagaacaauauaauucuacuuaccgaguaguaucaguacuaacagugcuacaucaagauuggcuaaaugguaaagaauauaaaugcaaaguaucuaacaaagcauuaccggcaccaauugaaaaaaccaucagcaaagcaaaaggacaaccgagagaaccccaaguuuauacacuaccaccaucacgagaagaaaugacaaaaaaccaaguaucacuaacaugcuuaguaaaaggauucuacccaucagauauagcaguagaaugggaauccaauggacaaccagaaaacaacuacaaaacaaccccaccuguuuuagauucagauggaucauuuuucuuauauucaaaauuaacaguagacaaaucaagauggcaacaaggaaacguauucucaugcucugucaugcacgaagcccuucacaaucacuauacacaaaaaucauuaucacuaucuccaggaaaa

SEQ ID NO: 45894 - RNA, 654 nt, Artificial Sequence
  derived and/or modified sequence opt6 from Anrukinzumab_LightChain1
gauauacaaaugacacaaucaccaucaagcuuaagcgcaagcgugggagauagaguuacaauaacauguaaagcaagugaaagcguagacaauuacggaaaaucacucaugcacugguaccaacaaaaaccaggaaaagcacccaaacuauuaauauaucgagcaagcaaucuagaaagcggagucccaaguagauucucaggaucaggaucaggaacagacuuuacauuaacaauaagcucauuacaaccagaagauuuugcaacauacuauugccaacaaucaaaugaagacccauggacauucggaggaggaacaaaagucgaaauaaaaagaacagucgcagcaccaagcguauucauuuucccaccaucagacgaacaacuaaaaucagguacagcaucaguaguaugcuuacuaaauaacuuuuacccgagagaagccaaaguacaguggaaaguagauaacgcguuacaaagcggaaacucacaagaaaguguaacagaacaagauagcaaagacucaacauauagcuuaagcucaacauuaacauuaagcaaagcagauuacgaaaaacauaaaguauacgcaugcgaaguaacacaccaaggauuaagcucaccaguaacuaaaagcuuuaacaggggcgaaugc

SEQ ID NO: 45895 - RNA, 1338 nt, Artificial Sequence
  derived and/or modified sequence opt6 from Apolizumab_HeavyChain1
caaguacaauuacaagaaucaggcccaggccuaguaaaaccauccgaaacacuaagcuuaaccugcacaguuucagguuucucauuaaccaacuauggaguacacugggucagacaaucaccaggaaaaggauuagaauggaucggagucaaaugguccggaggaucaacagaauauaacgcagccuuuauaucaagacuaacaauaucaaaagauacaucaaaaaaccaaguaagccuuaaacuaaauucauuaacagcagcagacacagccguuuacuacugcgcacgcaacgacagauaugcaauggauuauuggggacaaggcacacuaguaacagugaguucagcaucaacaaaaggaccuucaguuuuuccuuuagcacccucauccaaaucaacaucaggaggcacagcagcacuuggaugucuaguaaaagacuacuuucccgaaccaguuacaguaucauggaacucaggcgcauuaacaucugguguacacacauuucccgcaguacuccaaucuucaggacucuacucauuaucaucaguaguaacagucccaucaucuucauuaggaacccaaacauauauaugcaacguaaaccauaaaccaucaaacacaaaaguugacaaaaaaguagaaccaaaaucaugcgacaaaacccacacaugcccuccaugcccagcccccgaauuauuaggaggaccaucaguauucuuauuuccaccuaaaccaaaagacacacuaaugauaaguagaacaccagaaguaacaugcgucguagucgacguaagccaugaagacccagaaguaaaauucaacugguacguagacggagucgaaguacacaacgcuaaaacuaaaccacgagaagaacaauacaauucaacauaccgaguaguaucaguauuaacuguccuacaccaagacugguuaaauggaaaagaauacaaaugcaaagucagcaauaaagcacuaccugcaccaauugaaaaaacaauaaguaaagcaaaaggacaaccacgagaaccacaaguauacacacuacccccaaguagagaugaacuuacaaaaaaucaaguuucucucacauguuuaguaaaaggauuuuacccaucagacauagcaguagaaugggaauccaacggacaaccggaaaauaauuauaaaacuacaccaccaguacuagauucagacggaucauuuuuccucuauucaaaacuaacaguagacaaaagcagauggcaacaaggaaauguuuucucauguucaguaaugcacgaggcacuacacaaccacuauacucaaaaaucacuaucacuaucaccaggcaaa

SEQ ID NO: 45896 - RNA, 642 nt, Artificial Sequence
  derived and/or modified sequence opt6 from Apolizumab_LightChain1
gacauacaaaugacacaaucaccaucaagccuaagcgcaagcguaggagacagaguaaccauaacaugcagagcaagcgaaaacauauacucauaccuagcaugguaccaacaaaaaccaggaaaagcaccaaaacuauuaguaucaaacgcaaaaacauuagcagaaggcguaccaagcagauucucaggaucaggaucaggaaaacaauucacacuaacaauaagcucacuacaaccagaagacuucgcaacauacuacugccaacaccauuacggaaacucauacccauuuggacaaggaaccaaacuagaaauaaaaagaacaguagcagcaccaagcguauucauauuuccaccaucagacgaacaacuaaaaucaggcacagcaucagucguaugucuacuaaauaacuucuacccaagagaagccaaaguacaauggaaaguagacaacgcauuacaaagcggaaacucacaagaaagcguaacagaacaagauaguaaagacucaacauacagccuaagcucaacacuaacauuaagcaaagcagacuacgaaaaacacaaaguauaugcaugcgaaguaacacaccaaggacuaagcuccccaguaacaaaaagcuucaacagaggagaaugc

SEQ ID NO: 45897 - RNA, 378 nt, Artificial Sequence
  derived and/or modified sequence opt6 from Apomab_HeavyChain
gaaguacaauuaguacaaaguggaggaggaguagaaaggccaggaggaaguuuaagauuaucaugugcagcaaguggauuuacauuugaugauuaugcaauguggguaagacaagcaccaggaaaaggauuagaauggguaaguggaauaaauuggcaaggaggaagcacaggguaugcagauaguguaaaaggaagaguaacaauaaguagagauaaugcaaaaaauaguuuauauuuacaaaugaauaguuuaagagcagaagauacagcaguauauuauugugcaaaaauauuaggagcaggaagaggaugguauuuugauuauuggggaaaaggaacaacaguaacaguaaguagugcaaguacaaaaggacca

SEQ ID NO: 45898 - RNA, 324 nt, Artificial Sequence
  derived and/or modified sequence opt6 from Apomab_LightChain
ucagaacuaacacaagacccagcaguaucaguagcacuaggacaaacaguaagaauaacaugcucaggagacucacuaagaucauauuacgcaucaugguaccaacaaaaaccaggacaagcaccaguacuaguaauauacggagcaaacaauagaccaucaggaauaccagacagauucucaggaucaucaucaggaaacacagcaucacuaacaauaacaggagcacaagcagaagacgaagcagacuacuacugcaacucagcagacucaucaggaaaccacguaguauucggaggaggaacaaaacuaacaguauuagga

SEQ ID NO: 45899 - RNA, 645 nt, Artificial Sequence
  derived and/or modified sequence opt6 from Aquaporumab_LightChain
gaaauaguacuaacacaaucaccaggcacacuauccuuaucaccaggagaaagagcaacauuaucaugcagagcaucacaaacaguaagaacaaacuacuuagcaugguuccaacaaaaaccaggacaagcaccaagacuauuaauauucggagcaucaucaagagccacaggaauaccagacagauucucaggcucaggcucaggaacagacuucacauuaacaauauccagauuagaaccagaagacuucgcaguauacuacugccaacaauacggaucaucaccauggacauucggacaaggaacaaaaguagaaauaaaaagaacagucgcagcaccaucaguauucauauucccaccaucagacgaacaacuaaaaucaggaacagccucaguaguaugccuacuaaacaacuucuacccacgagaagcaaaaguucaauggaaaguagacaacgcacuacaaucaggaaacucacaagaaucaguaacagaacaagacuccaaagacucaacauacucacuaucaucaacauuaacacuaucaaaagcagacuacgaaaaacacaaagucuaugcaugcgaaguaacacaccaaggauuauccucaccaguaacaaaaucauucaacagaggugaaugu

SEQ ID NO: 45900 - RNA, 1326 nt, Artificial Sequence
  derived and/or modified sequence opt6 from Arcitumomab_99tc_HeavyChain
gaaguaaaacucguagaauccggaggaggacuaguacaaccaggaggauccuuacgacuaucaugugcaacaucaggauuuacauucacagacuauuauaugaauuggguaagacaaccacccggaaaagcccuagaauggcuuggauuuauaggcaacaaagcaaauggauacacaacagaauacucagccucagucaaaggaagauucacaauaucacgugauaaaucccaaucaauauuauauuuacaaaugaauacacuaagagccgaagauucagcaacauauuacugcaccagagauagaggacuaagauucuacuuugauuacuggggucaaggaacaacauuaaccguauccuccgcuaaaacaacgcccccaucaguauacccauuagcaccaggcucagcagcccaaacaaacucaaugguaaccuuagguugucuaguuaaaggauacuuccccgaaccaguaacagucacauggaacuccggaagcuuauccuccggaguccacaccuuuccagcaguucuacaaagcgauuuauacacacuaucaaguucaguaacaguaccuucuucaccaagacccuccgaaacaguaacaugcaaugucgcacacccagcaucauccacuaaaguagauaaaaaaaucguuccaagagacugcccaccauguaaaugcccagcuccaaaucuacuaggaggcccaucaguauucauauuuccaccaaaaauaaaagauguccuaaugauaucacuaucaccaauaguaacaugcguaguaguagacgucucagaagacgacccagauguccaaauaucaugguuugucaauaacguagaaguacacaccgcccaaacacaaacacacagagaagauuacaacucaacacuaagaguaguuucagcacuaccaauacaacaucaagacuggaugagcggaaaagaauucaaauguaaaguuaacaacaaagacuuaccagcaccaaucgaaagaacaauaucaaaaccaaaagguucaguaagagcaccccaaguauauguacuaccaccaccagaagaagaaaugacaaaaaaacaaguaacucuaacauguauggucacugacuucaugccggaagauauauacguagaauggacaaauaacggaaagacagaauuaaauuauaaaaacacagaaccagucuuagauucagauggcaguuacuucauguauucuaaacuaagaguagaaaaaaaaaacuggguagaaagaaacucauacucaugcucuguaguacacgaaggacuacacaaccaccacacaacaaaaucauucucaaga

SEQ ID NO: 45901 - RNA, 639 nt, Artificial Sequence
  derived and/or modified sequence opt6 from Arcitumomab_99tc_LightChain
caaacaguacuaucacaaucaccagcaauacuaucagccucaccaggcgaaaaaguaacaaugacaugcagagcaucauccucagucacauacauacacugguaucaacaaaaaccaggaucaucaccaaaaucauggauauacgcaacaucaaaccuagcaucagguguaccagcacgauucucuggaucaggaucaggaacaucauauucacuaacaaucucaagaguagaagcagaagacgcagcaacauacuacugccaacacugguccucaaaaccaccaacauucggaggaggaacaaaacuagaaauaaaaagagcagacgcagccccaacaguaucaauauucccaccaucaucagaacaacucacaucaggaggagcaucaguaguaugcuuccuaaacaacuuuuaccccaaagacauaaacguaaaauggaaaauagacggauccgaaagacaaaacggaguacuaaacucauggacagaucaagacucaaaagacucaacauacucaaugucaucaacacuaacauuaacaaaagacgaauacgaacgacacaacuccuacacaugcgaagcaacacacaaaacaucaacaagcccaauaguaaaauccuucaauagaaacgaaugc

SEQ ID NO: 45902 - RNA, 1329 nt, Artificial Sequence
  derived and/or modified sequence opt6 from Ascrinvacumab_HeavyChain1
caaguacaacuacaagaauccggaccaggacuagucaaaccuucccaaacucuaagucuaacaugcacaguaucaggaggaucaauuuccucaggcgaauacuacuggaauuggauuagacaacauccagguaaagguuuagaauggauaggauacauauacuacucaggaagcacauauuacaauccaucacuaaaaucaagaguaaccauaaguguagauacuucaaaaaaccaauucucacuaaaacuaucauccguaacagcagcagacacagcaguauauuauugcgcaagagaaucagucgcaggcuucgacuacuggggacaaggaacccuaguaacaguaucauccgcaucaacaaaaggacccucaguuuucccccuagcaccauguuccagaucaacaucagaaagcacagcagcacuaggcugucucguaaaagacuacuucccagaaccagucacaguaucauggaacagcggagcacucacauccggaguccacacauuuccagcaguacuacaaucuaguggccuauacuccuuaaguucaguaguaacaguaccaucaucaaacuucggaacacaaacauacacaugcaauguagaccacaaaccaucaaacacaaaaguagauaaaacaguagaaagaaaaugcugcgucgaaugcccaccaugcccagcacccccaguagcuggaccaucaguauuucuauuuccaccaaaaccaaaagauacauuaaugauaucaagaacccccgaaguaacaugcguaguuguagacguaucacacgaagauccagaaguccaauucaacugguacguagacggaguagaaguacacaacgcaaaaacaaaaccaagagaagaacaauucaacucuacauucagaguaguuuccguacuaaccguaguccaccaagauuggcucaacggcaaagaauacaaauguaaaguaucaaacaaaggauuaccagcaccaauagaaaaaaccauaucaaaaacaaaaggacaacccagagaaccacaaguauacacauuaccacccagcagagaagaaaugaccaagaaccaagucucacuuacaugcuuaguuaaaggauucuacccauccgacauagcaguagaaugggaauccaauggucaacccgaaaacaacuacaaaacaaccccuccuaugcuagacucagaugguucuuucuuccuauacuccaaauuaacaguagacaaaucuagauggcaacaaggaaauguauuuucaugcuccguaaugcaugaagcauuacauaaccacuacacccaaaaaucacuaucacuaucacccgga

SEQ ID NO: 45903 - RNA, 645 nt, Artificial Sequence
  derived and/or modified sequence opt6 from Ascrinvacumab_LightChain1
gaaauaguacuaacccaaucaccaggaacacuaucucuaucaccaggagaaagagcaacacucucaugcagagcaucacaaagcguaucaucaucauaccuagcaugguaccaacaaaaaccaggacaagcaccaagacuacuaauauacggaacaucaucacgagcaaccggaauaccugacagauucucaggaucaggaucaggaacagacuuuacacuaacaauaucaagacuagaaccagaagacuucgcaguauacuacugccaacaauacgguucaagcccaaucacauucggacaaggaacaagauuagaaauaaaaagaacaguagccgccccaaguguauucauauucccaccaucagacgaacaacuaaaauccggaacagcaucaguaguaugucuccuaaauaacuucuacccaagagaagcaaaaguucaauggaaaguagacaacgcacuacaaucaggaaacucacaagaaucaguaacagaacaagacagcaaagacucuacauacagccuaucaucaacacuaacauuaucaaaagcagacuacgaaaaacacaaaguauacgcaugcgaaguaacacaccaaggacuaucaucaccaguaacaaaaucauucaacagaggagaaugc

SEQ ID NO: 45904 - RNA, 1314 nt, Artificial Sequence
  derived and/or modified sequence opt6 from Aselizuab_HeavyChain1
gaaguacaacucguagaauccgguggaggacuaguccaaccaggaggaagucucagacuaucaugcgccgcaucuggauucacauucaguacauacgcuucuuggguaagacaagccccaggaaaaggauuagaauggguugcaucaauaucaacaggcggcucuaccuacuauccagacucaguaaaaggcagauucacaauaagcagagauaacgcaaaaaauacacucuacuuacaaaauucacuuagagcagaagacacagccguuuauuacugcgcaagagacuaugacggauauuuugacuacuggggacaaggaacacuaguaacaguaucaucagcaucaacaaaaggaccaucuguauuuccauuagcuccaugcucaagaucaacuuccgaauccaccgcagcucucggaugucuaguaaaagauuauuuuccagaaccaguaacuguauccuggaauuccggagcauuaacaucaggaguccauacauuucccgcaguacuacaaucauccggacuauacagucuaucauccguaguaacaguacccucaucuucacuaggaacaaaaacauacacaugcaacgucgaucacaaacccucaaauacaaaaguagauaagagaguagaaucaaaauacgguccaccaugcccaucaugcccagcaccagaauuccuuggaggcccauccguauuccuauucccuccaaaaccaaaagacacuuuaauaagccgaacaccagaaguaaccugcguaguaguagacguaucgcaagaagacccagaaguacaauucaacugguacguagacggaguagaaguacauaacgcaaaaacaaaaccacgcgaagaacaauucaauucaaccuacagaguaguaucaguacucacaguacuacaucaagacuggcuaaacggaaaagaauacaaaugcaaaguaagcaauaaaggccucccauccucaauagaaaaaacaauuucaaaagcaaaaggacaaccacgagaaccacaaguauacacacuaccacccucacaagaagaaacaaaaaaucaaguaucccuaacaugccuuguaaaaggcuuuuacccauccgauauugccgucgaaugggaaucuaauggucaaccagaaaauaacuauaaaacuacaccaccugucuuagacuccgacggaucauuuuuuuuguacagcagacuaacaguagauaaauccagauggcaagaaggaaaugucuuuucauguucuguccacgaagcauuacauaaccauuacacacaaaaaucacuaucucuaucacuuggaaaa

SEQ ID NO: 45905 - RNA, 1311 nt, Artificial Sequence
  derived and/or modified sequence opt6 from Aselizuab_HeavyChain2
gaaguacaacuaguugaaucuggaggugguuuaguccaacccgguggaucuuuaagauuauccugcgcagcauccgguuuuacauucucaacauaugcaucauggguucgacaagccccagggaaaggauuagaauggguagcuucuauauccacuggagguucaacauacuacccagauucagucaaaggacgcuucacaauaucucgagauaacgcaaaaaacacauuauacuuacaaaauucccuucgagcugaagacacagcaguauauuacugugcacgagauuacgacggauauuucgacuauuggggacaaggcacacuaguaacuguaucaucagcaagcacaaaaggaccuucaguauuuccauuagcaccaugcucaagauccacgucugaaucaacagcagcacuuggaugucuaguuaaagacuauuucccagaaccaguaacagucucauggaauuccggagcacuuacuucuggaguacauacauuuccagccguuuuacaaucaucaggauuauacagcuuaucaucaguaguaaccguaccaucuagcucccuaggaacaaaaacauacacauguaacgucgaccacaaaccaucaaauacaaaaguagauaaaagaguagaauccaaauacggaccaccaugcccauccuguccagcaccagaauucuuaggaggacccaguguuuuuuuauuuccuccuaaacccaaagauacaaucaguagaacaccagaaguaacauguguaguaguagacgugucacaagaagacccagaaguucaauuuaacugguacgucgacgguguagaaguacauaacgcaaaaacaaaaccuagagaagaacaauucaacucaacauacagaguaguuucaguauuaacaguacuucaccaagacuggcuaaauggaaaagaauauaaaugcaaagucucaaacaaaggacuaccaucaucaauagaaaaaacaauaucaaaagcaaaaggacaaccaagagaaccacaagucuacacucuaccaccaucccaagaagagacaaaaaaucaaguaucauuaacaugcuuaguaaaaggauucuauccauccgacauagcagucgaaugggaaucaaauggacaaccugaaaacaauuacaaaacaacuccucccguacuagacucagauggcucauuuuuucuauacucaagauuaacaguagauaaaucaagauggcaagaaggcaacguauucucauguucaguacaugaagcacuacacaaucauuacacacaaaaaucauuaucauuaucauuaggaaaa

SEQ ID NO: 45906 - RNA, 648 nt, Artificial Sequence
  derived and/or modified sequence opt6 from Aselizuab_LightChain1
gacauacaaacacaaucaccaagcucacuaucagcaucaguaggagacagaguaaccauaacaugcaaagcaucccaaucaguagacuacgacggagacucauacaacugguaccaacaaaaaccaggaaaagcacccaaacuauuaauauacgccgcaucaaaccuagaaucaggaauaccaucaagauucucaggaucaggauccggaacagacuucacauuaacaauaucaucauuacaaccagaagacuucgcaacauacuacugccaacaaucaaacgaagacccauggacauucggacaaggaacaaaaguagaaauuaaaagaacaguagcagcaccaucaguauucauauucccacccucagacgaacaauuaaaaucaggaacagcaucaguaguaugcuuauuaaacaacuucuacccaagagaagcaaaaguacaauggaaaguagacaacgcauuacaaucaggaaacucacaagaaagcguaacagaacaagacucaaaagacucaacauacagcuuaagcucaacccuaacauuaucaaaagcagacuacgaaaaacacaaaguauacgcaugugaaguaacacaccaaggacuaucaucaccaguaaccaaaucauucaauagaggcgaaugc

SEQ ID NO: 45907 - RNA, 1344 nt, Artificial Sequence
  derived and/or modified sequence opt6 from Atezolizumab_HeavyChain1
gaaguccaacuuguagaaucaggaggaggccuaguccaaccaggcggaucauuaagacuauccugcgcagcaucaggauucacauuuucagacagcuggauacacuggguaagacaagcaccagguaaaggacuagaaugggucgcauggauauccccauacggaggauccacuuacuaugccgauucaguaaaaggcagauuuacuauaucagcagauacguccaaaaauacagcauauuuacaaaugaauucuuuacgagccgaagauacagcaguauacuacugugcuagaagacacuggccaggaggcuuugauuauuggggacaaggaacauuagucacaguuucaucugcaucaacuaaaggacccucgguauucccauuagcaccgucauccaaaucaaccagcggaggaaccgcagcacuugguugucuaguuaaagacuacuuuccagaaccuguuacaguaucuuggaauucuggagcccuaacuucaggaguacacacauuccccgcaguucuacaaucaucaggauuauauucauuaucaucaguagugacaguaccuucaucaucacuaggaacacaaacauauauaugcaacguaaaucauaaaccguccaacacaaaaguagacaaaaaaguagaaccaaaaucuugcgacaaaacucauacauguccaccaugcccagcaccagaacuacuaggaggaccaucuguauuucuuuuuccaccaaaaccaaaagauacauuaaugauaucaagaacaccagaaguaacuugcguagucguagauguaucacaugaagauccagaagucaaauucaacugguauguugacggagucgaaguccacaaugcaaaaacaaaaccaagagaagaacaauacgcaucuacauauagaguaguaucaguacuaacaguauuacaccaagacugguuaaauggcaaagaauacaaaugcaaaguuucaaauaaagcacuccccgcaccaauagaaaaaacaauaucaaaagcaaaaggacaacccagagaaccacaaguauacacauuaccaccaucaagagaagaaaugacgaaaaaccaaguaucauuaacaugccucguuaaaggauucuacccauccgauauagcagucgaaugggaauccaauggacaaccagagaauaacuauaaaacaacaccaccaguucuagacucugacggcucuuuuuuccucuacucaaaacuaacaguugacaaaucacgauggcaacaagguaauguauucucaugcucaguaaugcacgaagcauuacauaaucacuacacccaaaaaucucuuucacuaucaccagguaaa

SEQ ID NO: 45908 - RNA, 642 nt, Artificial Sequence
  derived and/or modified sequence opt6 from Atezolizumab_LightChain1
gacauacaaaugacacaaucaccaucaucauuaucagcaucaguaggagacagaguaacaauaacaugcagagcaucccaagacguaucaacagcaguagccugguaccaacaaaaaccaggaaaagcaccaaaacuacuaaucuacuccgcaucauucuuauauucaggaguaccaucaagauucucaggaucaggaucaggaacagacuucacacuaacaauauccucauuacaaccagaagacuucgcaacauacuacugccaacaauaccucuaucaccccgcaaccuucggacaaggcacaaaaguagaaauaaaaagaaccguagcagcaccuuccguauucauauucccaccaucagacgaacaacuaaaaucaggaacagcaucaguaguaugccuacuaaacaacuucuacccaagagaagcaaaaguacaauggaaaguagacaacgcauuacaauccggaaacucucaagaaucaguaaccgaacaagacucaaaagacucaacauacuccuuaucaucaacacuaacauuauccaaagcagacuacgaaaaacacaaaguauacgcaugcgaagucacacaccaaggacuaucauccccagucacaaaaucauucaacagaggagaaugc

SEQ ID NO: 45909 - RNA, 1323 nt, Artificial Sequence
  derived and/or modified sequence opt6 from Atinumab_HeavyChain1
gaaguacaauuaguagaaaguggaggaggcuugguccaaccagguggauccuuacgauuaucaugcgcagcaucgggauuuacauuuuccaauuauuggaugucauggguuagacaagcaccagguaaaggauuagaauggguagcaacuauuaaacaagauggcucccaaaaaaauuaugucgacucaguaaaaggaagguucacaauaucaagagauaacgcaaaaaauuccuuauacuuaagauuaaacucucuaagagcugaagacacggcaguuuacuauugcgcaacagaacuauuugaccuaugggguagagguucacuaguaacuguaucaucagcaucaacaaaaggaccaucaguauucccacuugccccaugcagucgcuccacuucagaaucuacugcagcacuaggauguuuaguaaaagauuacuuuccagaaccaguaaccguaagcuggaacucuggagcacuaacaucaggaguacauacauucccagcaguauuacaaucaucaggacuauauucacuaagcucagucguaacaguuccaucaucaucauuagguacaaaaacauauacauguaacguagaccacaaaccaucaaauaccaaaguagauaaaagagucgaaucaaaauacggaccaccauguccaucauguccagcuccagaauucuuaggaggucccucugucuuuuuauuuccaccaaaaccuaaagauacuuuaaugauuucaagaacaccagaaguaacaugcguaguaguagauguaucccaagaagacccugaaguacaauuuaacugguacguugacggaguagaaguccauaacgcaaaaacaaaacccagagaagaacaauucaacagcaccuauagaguaguaucaguacuaacuguacuacaccaagauuggcuaaauggaaaagaauauaaauguaaaguuucgaacaaaggccucccuucaucaaucgaaaaaacuauaucuaaagcuaaaggacaaccaagagaaccacaagucuacacuuuaccaccaucacaagaagaaaugacaaaaaaucaaguaagcuuaacaugccuaguaaaaggcuuuuauccaucagacauagcagucgaaugggaaaguaauggacaaccagaaaacaacuauaaaacaacaccaccuguauuagauucagauggcucauucuuuuuauacucaagacuaacuguagauaaaagcagauggcaagaaggaaauguauuuuccugcucaguuaugcaugaagcauuacacaaccauuacacucaaaaaucacuaagcuuaucccuagguaaa

SEQ ID NO: 45910 - RNA, 642 nt, Artificial Sequence
  derived and/or modified sequence opt6 from Atinumab_LightChain1
gaaauaguacuaacacaaucaccagcaacacuaagccuaucaccaggagaaagagcaaccuuaucaugcagagcaucacaaucaguaucaucauaccuagcaugguaccaacaaaaaccaggacaagcaccaagacuauuaauauacgacgcaucaaaccgagcaacaggaaucccagcaagauuuucaggcucaggcuccggaacagacuucacccuaacaaucucaucauuagaacccgaagacuucgcaguuuacuauugccaacaaagaucaaacuggccaauaacauucggacaaggaaccaaacuagaaaucaaacgaacaguagcagcccccucaguauucauauucccacccucagacgaacaacuaaaaucaggaacagccucaguaguaugcuuacuaaacaacuucuacccaagagaagcaaaaguacaauggaaaguagacaacgcauuacaaucaggaaacucacaagaaagcgucacagaacaagacagcaaagacucaacauacagcuuaucaucaacacuaacauuaucaaaagcagacuacgaaaaacacaaaguauacgcaugcgaaguaacacaccaaggauuaucaucaccaguaacaaaaucauuuaacagaggagaaugc

SEQ ID NO: 45911 - RNA, 1329 nt, Artificial Sequence
  derived and/or modified sequence opt6 from Atlizuab_HeavyChain1
guacaauuacaagaauccggaccaggacuaguccgaccaucacaaacauuaucacuaacuuguacaguaucaggcuacucaauaacaucagaucacgccuggucuuggguuagacaaccaccaggcagaggacuagaauggauaggauauauaagcuauuccggaauaacaacauauaacccaucauuaaaaucucgaguuacauuaagagacacaucuaaaaaucaauuuucucuuagacuaucaucaguaacagcagccgauaccgcaguuuacuacugcgcaagaucccucgcacgaaccacagcagauuauuggggacaaggcucccuagucacaguaucaucagcaucaacaaaaggaccaucaguauuuccacuagcacccucuucaaaaucaacaucagguggaacagcagcccuaggauguuuaguaaaagauuacuucccagaaccaguuaccguaucuuggaacucaggagcacuaacuaguggaguccauaccuuuccagcaguuuuacaaaguucagggcuauauucucuaucauccguaguaacaguacccucaagcucauuaggaacacaaaccuacauauguaauguaaaucauaaaccaucaaacacaaaaguagacaaaaaaguagaacccaaaucaugugacaaaacacauacaugcccaccaugucccgcaccugaauuacuagggggacccucaguauuccuauuuccaccaaaaccaaaagauacauuaauauccagaacaccugaaguaacaugcgucguuguagauguaucacacgaagacccugaagucaaauuuaacugguauguugacggcguugaaguucacaacgcaaaaacaaaaccaagagaagaacaauacaauucaacauaccgaguaguaucaguacuuacaguauuacaccaagacuggcuaaauggaaaagaauauaaauguaaaguaucuaauaaagcauuaccugccccuauagaaaaaacuauaucaaaagcaaaaggacaaccucgagaaccccaaguauauacacuaccccccucacgagaugaacuaacaaaaaaucaaguaucucuaacaugucuaguuaaaggauuuuacccaucagauaucgcaguagaaugggaaucaaauggucaaccagaaaauaacuacaaaacaacaccaccaguauuagauucagacggcucauucuuucuauauuccaaauuaacaguagauaaauccagauggcaacaaggaaacgucuuuucauguagcguucacgaagcauuacacaaucacuacacccaaaaaucacuaucacuaagcccagga

SEQ ID NO: 45912 - RNA, 639 nt, Artificial Sequence
  derived and/or modified sequence opt6 from Atlizuab_LightChain1
gacauacaaacacaaucaccaucaucacuaucagcaucaguaggagacagaguaacaauaaccugcagagcaagucaagauauauccucauaccuaaacugguaccaacaaaaacccggaaaagcaccaaaauuacuaauauacuacacaucaagacuacacucuggaguaccaucaagauucucaggaucaggaucagguacagauuucacauuuacaauaucaucacuacaaccagaagacauagccacauacuacugccaacaaggaaacacacuaccauacacauucggacaaggaacaaaaguagaaauaaaaagaacagucgcagcaccaucaguauucauauucccaccaucagacgaacaauuaaaaucaggaacagcauccguaguaugccuacuaaacaacuucuacccaagagaagcaaaaguacaauggaaaguagacaacgcauuacaauccggaaacucacaagaaucaguaacagaacaagacucaaaagacucaacauacucacuaucauccacacuaacacuaucaaaagcagacuacgaaaaacauaaaguauacgcaugcgaaguaacacaccaaggacuaucaucaccaguaacaaaaucauucaacagaggagaaugc

SEQ ID NO: 45913 - RNA, 792 nt, Artificial Sequence
  derived and/or modified sequence opt6 from Aurograb_SingleChain
auggcaaaaguacaauuauuacaaagcgcaacagaaguaaaaaaaccaggugcaaguguaaaaguaaguuguaaagcauacggauacacuuuuacagauuauggaauaacauggguaaggcaagcaccuggacaagguuuagaauggaugggauggauaucagcauauaauggauacacaaauuaugcacaaaaauuucaagauagaauaacaaugacuacagaugcaucaacaaguacagcauauauggaauuaagaaguuuaagaccagaugacacugcaguauuauacugugccagagauagagaagaugcaucacuacuaagagauggacauuggggucaaggaacauuaguaacaguaucaaguggaggaggaggcucaggaggaggaggaaguggaggaggaggaucaggaggaggaggaagcgaaacaacauuaacacaaucaccaggaacauuaucauuaaguccaggagaaagagcaacauuaaguugcagagcaagucaaauaguaaguucaucauaucuagcaugguaucaacaaaaaccaggacaagcaccaagacuacuaauauacggagcaaguagcagagcaacaggaauaccagacagauuuagcggaaguggaucaggcacagauuucacauuaacaaucucaaaauuagaaccagaagauuuugcaguauauuauugucaacauuacgggucaagcaguccauggacaaguagaccaagagaccaaucagauauaaaaagggcagcagcacuagaacaccaucaucaccaucau

SEQ ID NO: 45914 - RNA, 1350 nt, Artificial Sequence
  derived and/or modified sequence opt6 from Avelumab_HeavyChain1
gaaguccaacuauuagaaucagguggaggccucguacaaccuggaggaucauuaagauuaaguugugccgcaucaggauucacauucucaagcuacauaaugauguggguaagacaagcccccggcaaaggacuagaauggguuucaucaauauacccaagcggagguauaacauucuaugcagacacaguuaaaggacgauuuacaauaaguagagacaauagcaaaaacacucuauauuuacaaaugaauucauuaagagcagaagacacagcuguauacuacugugcaagaauuaaauuaggaacaguaaccaccguagacuacuggggacaaggcacucuaguaacaguaaguagugcaucaacaaaaggaccuucuguauucccacuagcacccucaucaaaaagcacauccggaggaacagcagccuuagguugcuuagucaaagacuauuucccagaaccaguaacaguauccuggaauucaggcgcccuaaccucaggaguacacacauucccagcaguacuacaaagcuccggauuauauucacucucuucaguaguaacuguaccaucaucgucacuaggaacacaaacuuacauaugcaauguaaaccacaaaccaucaaacacaaaaguagacaaaaaaguagaaccaaaaagcugcgauaaaacccacacaugcccaccuuguccagccccagaacuauuaggaggaccaucaguuuuuuuauuuccccccaaaccaaaagauacauuaaugauuagccgaacaccagaaguaacaugugucguugucgauguuucacacgaagauccagaaguaaaauucaauugguacguagauggaguagaaguccauaacgcaaaaacaaaaccacgcgaagaacaauauaauucaacauaucgaguagucucaguucucaccguauuacaccaagauugguuaaauggaaaagaauacaaauguaaaguaucuaauaaagcauuaccagcaccaauagaaaaaaccauaucaaaagcuaaaggacaaccaagagaaccacaaguauacacauuacccccaucaagagacgaacuaacaaaaaaucaaguuaguuuaacuuguuuaguaaaaggauucuauccauccgacauagccguagaaugggaaucuaauggacaacccgaaaauaauuacaaaacaacaccgccaguacuagauagugacggaagcuuuuuucuauauucaaaacuaacaguagauaaaucgagauggcaacaaggaaauguauucucauguagcguuaugcacgaagcauuacauaaccauuacacacaaaagucacuaucccuaaguccagguaaa

SEQ ID NO: 45915 - RNA, 648 nt, Artificial Sequence
  derived and/or modified sequence opt6 from Avelumab_LightChain1
caaucagcacuaacacaaccagcaucaguaucaggaucaccaggacaaucaauaacaauauccugcaccggaacaucaucagacguaggaggauacaacuacguaucaugguaucaacaacacccaggaaaagcacccaaacuaaugauauacgacguaagcaacagaccaagcggagucucaaacagauucucaggaucaaaaucaggaaacacagcaucauuaacaauaaguggauuacaagcagaagacgaagcagacuacuacugcucaucauacacaucaucaucaaccagaguauucggaacaggaacaaaaguaacaguacuaggacaaccaaaagcaaauccaacaguaacacuauucccaccaucaucagaagaauuacaagcaaacaaagcaacacuaguaugcuuaauuucagacuucuacccaggagcaguaacagucgcauggaaagcagacggauccccaguaaaagcaggaguagaaacaacaaaaccaucaaaacaaucaaacaacaaauacgcagcaucauccuaccuaucacuaacaccagaacaauggaaaucacacagaucauacucaugccaaguaacacacgaaggaucaacaguagaaaaaacaguagcuccaacagaaugcuca

SEQ ID NO: 45916 - RNA, 1344 nt, Artificial Sequence
  derived and/or modified sequence opt6 from Bapineuzumab_HeavyChain1
gaaguacaauuauuagaaucaggaggaggauuaguacaaccaggaggaucacuaagauuaaguugugcagcaucaggauuuaccuuuucaaauuacggaaugucauggguaagacaagcaccaggaaaaggauuagaauggguagcauccauacgaucagguggaggaagaacauacuauucagacaacguuaaaggacgauucacuauaucacgagacaacucaaaaaacacacucuaucuacaaaugaauucacuacgagcagaagacacagcaguauacuacuguguaagauaugaccacuacucaggaucaucugacuauuggggccaaggaacacuagucacuguauccucagcaagcacaaaaggcccaucaguauuuccacuugcaccaucuucaaaaucaacaucaggaggaacagcagcccuugguugcuuaguaaaagacuacuucccagaaccaguaaccguaucauggaauucaggagcacuaacaucaggaguacacaccuuuccagcaguauuacaaucaucaggacuauacucauuguccucaguaguaacaguuccaucaucaucauuagguacacaaaccuauauaugcaaugucaaccacaaacccucaaacacaaaaguagacaaaaaaguagaaccaaaaaguugugacaaaacccacacaugcccaccaugcccagcaccagaauuauuaggaggaccauccguuuucuuauucccaccaaaacccaaagacacacuaaugauaucaagaacaccggaaguaacaugcguagucguagacguaucacacgaagauccagaagucaaauucaacugguacguagacggcgucgaaguacauaaugcuaaaacaaaaccacgagaagaacaauacaacucaacuuacagagucgucucaguacucacaguauuacaucaagacuggcuaaauggaaaagaauacaaaugcaaaguaucaaauaaagcauuaccagcccccaucgaaaaaacaauaucaaaagcaaaaggucaaccacgagaaccacaaguauauacccuuccaccaucccgagaagaaaugacaaaaaaccaaguaucacuaaccugucuaguaaaaggauucuacccaucagauauagcaguagaaugggaaucaaacggccaaccagaaaacaauuauaaaacaacaccaccuguccuugacucagacggcucauuuuuccuuuacucaaaacuaacuguugacaaaucacgauggcaacaaggaaacgucuucucaugcucagucaugcacgaagcauuacacaaucauuacacacaaaaaucccuaucauuaucaccagga

SEQ ID NO: 45917 - RNA, 657 nt, Artificial Sequence
  derived and/or modified sequence opt6 from Bapineuzumab_LightChain1
gauguaguaaugacacaaucaccauuaucacuaccaguaacaccaggagaaccagcaucaauaucaugcaaaagcucucaaucacuauuagacucagacggaaaaacauaccuaaacuggcuucuacaaaaacccggacaaucaccacaaagauuaauuuaccuaguaucaaaacuagacucaggaguaccagacagauucucaggaucaggaucaggaacagacuucacacuaaaaauaucaagaguagaagcagaagacguaggaguauacuacuguuggcaaggaacacacuucccaagaacauucggacaaggaacaaaaguagaaauaaaaagaacaguagcugcaccaucaguauucauauucccacccuccgacgaacaacuaaaaucaggaacagcaucaguaguaugccuacucaacaacuucuacccaagagaagcaaaaguacaauggaaaguagacaaugcacuacaaucaggaaacucacaagaaucaguaaccgaacaagacucaaaagauucaacauacucacuaucaucaacacuaacacuaucaaaagcagauuacgaaaaacacaaaguauacgcaugcgaaguaacacaccaaggacuaucaucccccguaacaaaaucauuuaaccgaggcgaaugc

SEQ ID NO: 45918 - RNA, 1338 nt, Artificial Sequence
  derived and/or modified sequence opt6 from Basiliximab_HeavyChain
caacuacaacaaucaggaacuguacucgcacgaccaggcgccucaguaaaaaugucuuguaaagcaucagguuacuccuuuacccgauacuggaugcauuggaucaaacaacgacccggacaaggccuagaauggauaggagcaauauaccccgguaacucagauacuucauacaaccaaaaauucgaaggcaaagcaaaauuaaccgcaguaaccuccgcaaguacagcauauauggaacuauccucacuaacacacgaagacucugcuguauacuauugcucccgagacuaugguuacuacuucgacuuuuggggacaaggaacaacccuaacaguaucaucagcauccacaaaaggaccaucagucuucccacuagcccccucaucaaaaucuacaucagguggaacagccgcccucggcugcuuaguuaaagacuacuuuccagaacccguaacaguaucauggaacucuggcgcccuaacaucaggaguacacacauucccagccguacuacaaucuucaggacuauauucacuaucaucagucguaacaguaccaucaucaagucucggcacacaaacauauauaugcaacguaaaccacaaaccaucaaauacaaaaguagauaaaagaguugaaccccccaaaucaugcgacaaaacucacacaugcccaccuugccccgccccagaauuauuaggaggacccucagucuuucuuuuuccaccaaaaccaaaagauacauuaaugauaucaagaacaccagaaguaacaugugucguagucgacguaucacacgaagauccagaaguuaaauucaacugguauguagacggcguagaaguccauaaugcaaaaacaaaaccaagagaagaacaauacaacuccaccuacagaguaguaagcguacuuacaguacuacaccaagacuggcuaaauggaaaagaauacaaaugcaaaguaucaaacaaagcauuaccagccccaauagaaaaaacaauaagcaaagcaaaaggacaacccagagaaccacaaguauacacacuaccacccucuagagacgaacuaacaaaaaaucaaguaucucuaaccugucuaguaaaaggcuucuauccaucagauauagcaguagaaugggaaucuaacggacaaccagaaaacaacuauaaaacaacacccccaguauuagacucagacggauccuuuuucuuauacucaaaacucacagucgacaaauccagauggcaacaaggcaacguauucucauguuccguaaugcacgaagcacuacacaaccacuacacccaaaaaucauuaagcuuaucaccaggaaaa

SEQ ID NO: 45919 - RNA, 630 nt, Artificial Sequence
  derived and/or modified sequence opt6 from Basiliximab_LightChain
caaauagucucaacccaaucaccagcaauaaugucagcaucaccaggcgaaaaaguaacaaugacaugcucagcaucaucaucacgaucauacaugcaaugguaucaacaaaaaccaggaacaucaccaaaaagauggaucuacgacacaagcaaacuagcaucaggagucccagcaagauucucaggaucaggaucaggaacauccuacucacuaacaauaucaucaauggaagcagaagacgcagcaacauacuacugccaccaaagaucaucauacacauucggcggaggaacaaaacuagaaauaaaaagaacaguagcagcaccaucagucuuuauauucccaccaucagacgaacaacuaaaaucaggaacagcaucaguaguaugucuauuaaacaacuucuacccaagagaagcaaaaguacaauggaaagucgauaacgcacuacaaucaggaaauucacaagaaucaguaacagaacaagacucaaaagacucaacauacucacuaucaucaacacuaacccuaucaaaagcagacuacgaaaaacacaaaguauacgcaugcgaaguaacacaccaaggacuaucaucaccaguaacaaaaucauucaacagaggagaa

SEQ ID NO: 45920 - RNA, 1350 nt, Artificial Sequence
  derived and/or modified sequence opt6 from Bavituximab_HeavyChain
gaaguacaauuacaacaaucaggccccgaacuagaaaaaccaggagcaagcgucaaauuaucauguaaagcauccggauacucuuucacaggauauaacaugaacugggucaaacaaucacauggaaaaucccuugaauggauaggucacaucgacccauacuacggugacacaucauacaaucaaaaauucagaggaaaagcaacacuaacaguugauaaaagcucauccaccgcauacaugcaacuaaaaagucuaacaucagaagauucagcaguauauuacuguguaaaaggaggauacuacggccauugguauuuugauguauggggugcagguacaacaguaacaguauccuccgccuccaccaaaggccccagcguuuuuccuuuagcaccaucaucaaaauccacaucaggaggaacagcagcacucggaugcuuaguaaaagacuacuuuccugaaccaguaacagucucauggaauaguggagcacuaacuucaggaguucacaccuucccagcaguucuucaaucaucuggauuguacucacucucaucaguaguaaccguaccauccucuucauuaggcacacaaacauacauuugcaacguaaaucacaaacccuccaacacaaaaguagacaaaaaaguagaaccaaaauccugugauaaaacccauacaugcccacccugcccagcacccgaauuauuaggaggaccaucugucuuccuauuuccacccaaaccaaaagacacccuaaugauuucaagaacaccagaaguuacaugcguaguaguagacguaucacacgaagaucccgaaguaaaauucaacugguacguagacggaguagaaguacacaaugcaaaaacaaaaccucgagaagaacaauacaauucuacauacagaguaguaagcguacuaacuguacuacaccaagacuggcuaaauggaaaagaauauaaauguaaaguauccaacaaagccuuacccgcaccaauagaaaaaacaauaucaaaagcaaaaggacaaccacgagaaccacaagucuauacacuaccaccaucacgagacgaacuaaccaaaaaccaaguaucauuaaccuguuuaguaaaaggauucuauccaucagauaucgccguagaaugggaaucaaacggacaacccgaaaacaacuauaaaacaacaccaccaguauuagacuccgauggaucuuucuuuuuauacagcaaacuuaccguagauaaaucaagauggcaacaaggaaacgucuucucauguucaguaaugcacgaagcacuccauaaccauuacacacaaaaaucauuaucauuaucaccaggaaaa

SEQ ID NO: 45921 - RNA, 642 nt, Artificial Sequence
  derived and/or modified sequence opt6 from Bavituximab_LightChain
gacauacaaaugacacaaucacccucaucacuauccgcaagcuuaggagaaagaguaucauuaacaugucgagcaagccaagacauaggcucaucacuaaacuggcuacaacaaggaccagacggaacaaucaaaagacuaauauacgcaacauccucacuagauucagguguaccaaaaagauuuucuggaucaagaucaggaucagacuacucacuaacaauaucaucacuagaaucagaagacuucguagauuacuacugccuacaauacguaucaagcccaccaacauucggagcaggaacaaaacuagaauuaaaaagagcagacgcagccccauccguauucauauucccaccaucagacgaacaacuaaaaucaggcacagcaucaguaguaugccuacuaaacaacuucuauccaagagaagccaaaguccaauggaaaguagacaacgcacuacaaucaggaaacucacaagaaucaguaacagaacaagacucaaaagacucaacauacucccuaucaucaacacuaacacuaucaaaagcagauuacgaaaaacauaaaguauacgcaugugaaguaacacaucaaggauuaucaucacccguaacaaaaucauuuaacagaggagaaugc

SEQ ID NO: 45922 - RNA, 624 nt, Artificial Sequence
  derived and/or modified sequence opt6 from Bavituximab_LightChain_variant_8734_L
gacauucaaaugacacaaucaccaucauccuuaucagcaucauuaggagaacgaguaucacuaacaugccgagcaucacaagacauaggaucaucccuaaacuggcuacaacaaggaccagacggaacaauaaaaagauuaauauaugcaacaucaucccuagacagcggaguaccaaaaagauucucaggaucaagaucaggaucagacuacucauuaaccauaucaucacuagaaucagaagacuucguagacuacuacugccuacaauacguaucaagcccaccaacauuuggagccggaacaaaacuagaacuaaaaagagcagacgcagcaccaucaguauucauauucccacccucugacgaacaauuaaaauccggaacagcaucaguaguaugccuacuaaacaacuucuacccaagagaagcaaaaguacaauggaaaguagacaacgcacuacaaucaggaaacucacaagaaucaguaacagaacaagacucaaaagacucaacauacucacuauccaaagcagacuacgaaaaacauaaaguauacgcaugcgaaguaacacaccaaggauuaaguucacccguaacaaaaagcuucaacagaggagaaugc

SEQ ID NO: 45923 - RNA, 1368 nt, Artificial Sequence
  derived and/or modified sequence opt6 from Begelomab_HeavyChain1
caaguucaauuacaacaaucaggagcagaauuagucaaaccaggagccuccgucaaauuaucauguaaagcuagcggauauaccuucagaucauaugacauaaacuggguacgacaaagaccagaacaaggacuagaauggauaggcuggauauucccuggcgacggauccacaaaauauaacgaaaaauuuaaaggaaaagcuacacuaacaacagacaagucaucaagcacagcauauaugcaacuaucucgacuaaccucagaagacucagcuguuuauuucugugcaagauggacaguagucggaccaggguacuuugacguauggggagcaggaacaacaguaacagucucauccgcaaaaacaacuccccccucaguauacccauuagcaccaggcuguggagacacaacaggaucaucuguaacauuaggaugccuaguaaaagguuauuucccagaaucagucacuguaacauggaacucagguucacuuagcagcuccguucacacauuucccgcccuauuacaaucuggccuguauacaaugucaagcaguguaacaguaccaucaucuacauggccuucucaaacuguaacaugcucaguugcccauccagcaaguucaacaacagucgauaaaaaacuagaaccaucuggcccuauaucaacaauaaaucccugcccccccuguaaagaaugccacaaauguccagcaccaaaccucgaaggaggucccucaguauuuauauuucccccaaacauaaaagauguucuaaugauaucacuaacaccuaaaguaaccuguguaguuguugauguaucagaagaugacccagauguacaaauauccugguucguaaacaacguugaaguccacacagcccaaacacaaacucauagagaagauuauaauucaacaauaagaguagucucaacacuaccaauacaacaccaagauuggaugucuggaaaagaauuuaaauguaaaguaaacaacaaagaccuaccuucuccaauagaacgaacaauuucaaaaauaaaaggacuaguuagggcuccacaaguauauauccuaccacccccagcugaacaacuaaguagaaaagaugucagucuaacaugucuaguaguaggauucaauccuggagacaucuccguagaauggacaucuaauggacauacagaagaaaacuauaaagauacagcgccaguacuagauucugauggaaguuauuucauauauucaaaacuaaauaugaaaacauccaaaugggaaaaaacagacucauuuucauguaacguaagacaugaaggauuaaaaaauuacuaccuaaaaaaaacuauaucaagaucaccuggaaaa

SEQ ID NO: 45924 - RNA, 639 nt, Artificial Sequence
  derived and/or modified sequence opt6 from Begelomab_LightChain1
caaauaguacuaacacaaucaccagcaauaaugucagccucaccaggagaaaaaguaacaauaacaugcuccgcaucaucaucaguaucauacaugaacugguuccaacaaaaaccaggaacaucaccaaaauuauggauauacucaacaucaaaccuugcaucaggaguaccagccagauucuccggaucaggaucaggaaccucauacucccuaacaauaucaagaauggaagcagaagacgcagcaacuuacuacugccaacaacgaucaucauacccaaacacauucggaggaggaacaaaacuagaaauaaaaagagcagacgcagcaccaacagucucaauauucccaccaucauccgaacaacuaacaucaggaggagcaucaguaguaugcuuccuaaacaacuucuacccaaaagacauaaauguaaaauggaaaauagacggauccgaaagacaaaacggagucuuaaacucauggacagaccaagacucaaaagacucaacauacucaaugucaucaacacuaacacuaacaaaagacgaauaugaacgacacaacucauacacaugcgaagcaacacauaaaaccucaacaucaccaauaguaaaaucauucaacagaaacgaaugu

SEQ ID NO: 45925 - RNA, 1353 nt, Artificial Sequence
  derived and/or modified sequence opt6 from Benralizumab_HeavyChain1
gaaguacaacuaguucaaucuggcgcagaaguaaaaaaaccaggagcaucaguaaaagucucaugcaaagcauccggauacacuuucacaucauacguaauacauuggguacgacaaagacccggacaaggauuagcauggaugggcuauauaaacccuuacaaugacgguacaaaauauaaugaaagauucaaaggcaaaguaacaaucaccagugauagaucaacaagcaccguauacauggaacuaaguucccuaagaagcgaagacacagcaguauacuuaugcggccgagaaggaauacgauauuacggccuacuaggagacuacuggggacaaggaacacucguaacaguaucaucugccucaacaaaaggaccaucaguauucccacuagcacccucaucaaaaucaaccucuggaggaacagcagcccucggaugucuaguuaaagacuacuuuccagaacccguaacaguaucauggaacagcggugcauuaacuucaggaguacacacauucccagcaguacuucaauccucaggacuauacucauuaucaaguguaguaacaguaccaucaucaagccuaggaacacaaacuuauauaugcaaugucaaccacaaacccuccaacacaaaaguagacaaaaaaguagaaccaaaaucaugcgauaaaacacauacaugcccaccauguccagcaccagaauuauuaggaggaccuucuguauuccuauuuccaccaaaaccaaaagauacacucaugauaagccgaacacccgaaguaaccugugucguaguagacguuucacacgaagauccagaaguaaaauucaacugguacguagacgguguagaaguucauaacgcaaaaacaaaacccagagaagaacaauacaacagcacauacagaguaguaucaguacuaacuguacuucaccaagacuggcuaaacggaaaagaauacaaauguaaagucaguaauaaagccuuaccagcaccaauugaaaaaacaauaucaaaagcaaaaggacaaccaagagaaccucaaguauauacacuaccccccagcagagaugaacuaacaaaaaaucaaguaaguuuaacuugcuuaguaaaaggauucuacccaagugauauagcaguugaaugggaaucuaacggucaaccagaaaauaauuacaaaaccaccccacccguacuagauucagacggcucauucuuccucuauucaaaacucacaguugacaaaucacgauggcaacaaggcaacguauucagcuguucagugaugcacgaagccuuacauaaccacuauacacaaaaaucacuaucacucucaccagguaaa

SEQ ID NO: 45926 - RNA, 642 nt, Artificial Sequence
  derived and/or modified sequence opt6 from Benralizumab_LightChain1
gacauacaaaugacacaaucaccaucaagccuaucagcaucaguaggagacagaguaacaauaacaugcggaacaucagaagacauaauaaauuaccuaaacugguaucaacaaaaaccaggaaaagcaccaaaacuacuaaucuaccauacaucaagacuucaaucaggaguaccaucaagauucucaggaucaggaucaggaacagacuucacacuaacaauaucaucacuacaacccgaagacuuugccacauacuauugccaacaaggauacacacuaccauacacauucggacaaggaacaaaaguagaaauaaaacgaacaguagcagcaccaagcguauucaucuucccaccaucagacgaacaauuaaaaucaggaacagcaucaguaguaugccuacuaaacaacuucuacccaagagaagcaaaaguacaauggaaaguugacaaugcacuacaaucaggaaacucacaagaauccguaacagaacaagacucaaaagacucaacauacucacuaucaucaacauuaacacuauccaaagcagacuacgaaaaacacaaaguauacgcaugcgaaguaacacaccaaggauuauccucacccguaacaaaaucauucaacagaggagaaugc

SEQ ID NO: 45927 - RNA, 1329 nt, Artificial Sequence
  derived and/or modified sequence opt6 from Betalutin_HeavyChain1
gaaauacaacuucaacaaaguggucccgaacucguaaaaccaggagcaucaguaaaaguaagcugcaaagcaucaggauacucauucacagacuauaacauguauuggguaaaacaaucacacggaaaaucccucgaauggauaggauacauagaucccuacaauggagacacaacauacaaucaaaaauucaaaggaaaagcaacauuaacaguagauaaaucuucuucaacagccuucauucacuuaaauucauuaacaucagaagacucagcaguauacuacugcgcacgaucgccauacggucauuacgcaauggauuacugggggcaagguacaagcgucacaguaucauccgcaaaaacuacccccccauccguauauccauuagcaccuggaucagcagcacaaacuaauucuaugguaacacuagguugucucguaaaaggauacuucccagagccaguaacaguuacauggaacucaggcucauuaucaucaggaguacauacauucccugcaguauuacaaucugaccuauauacacuaucaucaucaguaacaguaccaaguucaacauggccaucugaaaccguaacaugcaauguagcacauccagcuuccucaaccaaagucgacaagaaaauaguaccaagagauuguggauguaaacccuguauaugcacaguacccgaaguauccucaguauucauuuucccacccaaaccaaaagacguccucacaauaacacuaacaccaaaaguaacaugcguaguaguagacauaucaaaagacgacccagaaguacaauuuucaugguuugucgacgacguagaaguacauacagcacaaacacaacccagagaagaacaauucaacucgacauucagaucuguaucagaacuaccaauaaugcaucaagacuggcuaaacggaaaagaauucaaaugucgaguaaauuccgccgcauucccagcacccauagaaaaaacaauuucaaaaacaaaagguagaccuaaagcaccacaaguauacacuauaccacccccaaaagaacaaauggccaaagauaaagucagccucacaugcaugauaacagacuucuucccugaagacauaacaguagaauggcaauggaacggacaaccagcugaaaauuacaaaaauacacaaccaauuauggauacagauggaucauacuucguauacucaaaacuaaacguucaaaaaucaaacugggaagcuggaaauacauucacauguucuguccuacacgaaggacuacauaaucaucacacagaaaaaucauuaucccacuccccaggcaaa

SEQ ID NO: 45928 - RNA, 642 nt, Artificial Sequence
  derived and/or modified sequence opt6 from Betalutin_LightChain1
gacauaguaaugacacaaucacacaaacuauuaucaacaucaguaggagacagaguauccauaacaugcaaagcaucacaagacguaucaaccgcaguagacugguaccaacaaaaaccaggccaaucaccaaaacuauuaauaaacugggcaucaacacgacacacuggaguaccagacagauuuacaggaucaggcucaggcacagacuauacacuaacaauaucaucaaugcaagcagaagaccuagcacuauacuacugcagacaacacuacucaacaccauucacauuuggaucaggaacaaaacuagaaauaaaaagagcagacgcagccccaacaguauccauauucccaccaucaucagaacaacuaacaucaggaggagcaucaguaguaugcuuccuaaacaacuucuacccaaaagacauaaacgucaaauggaaaauagacggcucagaaagacaaaacggaguacucaacucauggacagaccaagacuccaaagauucaacauacucaaugucaucaacacuaacacuaacaaaagacgaauacgaaagacauaacucauacacaugcgaagcaacacacaaaacaucaacaucaccaauaguaaaaucauucaacagaaacgaaugc

SEQ ID NO: 45929 - RNA, 1344 nt, Artificial Sequence
  derived and/or modified sequence opt6 from Bevacituzuab_HeavyChain1
gaaguacaauuagucgaaucaggaggaggccuaguacaaccaggcggaucauuacgccuaucaugugccgcaucaggcuacacauucacaaacuacggaaacuggguucgacaagcuccaggaaaaggauuagaauggguaggcuggauuaacacauacacaggagaaccaacauaugccgcagacuuuaaaagaagauucacauuuucacuugacacauccaaaucaacagcauaccuacaaaauucacuaagagccgaagacacagcgguuuacuacugcgccaaauacccacacuauuauggaucuucacacugguacuucgacguauggggacaaggaacacuaguaacaguaucaagcgccucuacaaaaggacccucaguuuucccacucgcaccaucuucaaaaucaacaucaggaggaaccgcagcauuaggauguuuaguuaaagacuacuuccccgaaccaguuacaguaucauggaacucaggagcucucacaucaggaguacacacauuuccagccguucuccaaucauccggauuauacucucuuucuuccguaguaacgguaccaucaucaucacuaggaacucaaaccuauaucuguaacguaaaucauaaaccauccaacacaaaaguagacaaaaaagucgaaccaaaaagcugcgacaaaacacacacauguccaccauguccagccccagaauuacuaggaggcccaucaguauuccuauuuccacccaaaccaaaagauacacuaauaucccgaacaccagaaguaacaugcguagucguagacguaucacacgaagauccagaaguaaaauucaacugguacguagauggaguagaaguccauaaugcaaaaacaaaaccacgugaagaacaauauaauucaacauacagagucguaucaguauuaaccguccuacaucaagacuggcuaaauggaaaagaauacaaaugcaaaguaucaaauaaagcacuaccagcaccaauagaaaaaacaauaagcaaagcuaaaggucaaccaagagaaccacaaguauauacauuaccaccaucaagagaagaaacuaaaaaucaaguuucauuaacauguuuaguaaaaggcuucuacccaucagauauagcagucgaaugggaaucuaacggccaaccagaaaacaauuauaaaacaacaccacccguacuagacucagacggcucauucuuccuauauucaaaacuaacaguagauaaaucacguuggcaacaaggaaauguauucucauguuccguacaugaagcucuccauaaccacuacacucaaaaaucucucuccuuauccccaggaaaa

SEQ ID NO: 45930 - RNA, 639 nt, Artificial Sequence
  derived and/or modified sequence opt6 from Bevacituzuab_LightChain1
gauauacaaacacaaucaccaucaucacuaucagcauccguaggagacagaguaacaauaacaugcuccgcaucucaagacauauccaacuaccuaaacugguaccaacaaaaaccaggaaaagcaccaaaaguccuaauauacuucaccucaucacuacauuccggaguaccaucacgauucucaggaucaggaucaggaacagacuucacacuaacaauaucaucacuacaaccagaagacuucgcaacauacuacugccaacaauacucaacaguaccauggacauucggacaaggaacaaaaguagaaauaaaaagaacaguagcagcaccaucaguauucauauucccaccaucagacgaacaacuaaaaucaggaacagcaucaguaguaugccuacucaacaauuucuacccaagagaagcaaaaguacaauggaaaguagacaaugcauuacaaucaggaaacucacaagaaucaguaaccgaacaagacucuaaagacucaacauacucccuaucaucaacacuaacauuaucaaaagcagacuacgaaaaacacaaaguauaugccugcgaagucacacaccaaggucuaucaucaccaguaacaaaaucauucaacagaggcgaaugc

SEQ ID NO: 45931 - RNA, 639 nt, Artificial Sequence
  derived and/or modified sequence opt6 from Bevacizumab_154-aspartic_acid_LightChain
gacauacaaaugacacaaucacccuccucacuaucagcaucaguaggagacagaguaacaauaaccugcucagcaucacaagacauaucaaacuacuuaaacugguaccaacaaaaacccggaaaagcacccaaagucuuaauauacuucacauccucacuacacucuggaguaccaucaagauucucaggaucaggaucaggaacagacuucacacuaacaauauccucauuacaaccagaagacuuugcaacauacuacugccaacaauacucaacaguaccauggacauucggacaaggcacuaaaguagaaauaaaaagaacaguagcagccccaucaguauucauauuuccaccaucagacgaacaacuaaaaucaggaacagcaucaguaguaugccuacuaaacaacuucuacccacgagaagcaaaaguacaauggaaaguagacaacgcagaccaaucaggaaacucacaagaaucaguaacagaacaagacucuaaagacucaacauacucacuaucaucaacacuaacacuauccaaagcagauuacgaaaaacacaaaguauacgcaugcgaaguaacacaccaaggacuaucuuccccaguaacaaaaucauucaacagaggcgaa

SEQ ID NO: 45932 - RNA, 639 nt, Artificial Sequence
  derived and/or modified sequence opt6 from Bevacizumab_154-substitution_deriv_LightChain
gacauacaaaugacacaaucaccaucaucacuaucagcaucaguaggagacagaguaaccauaacaugcucagcaucacaagacauauccaacuaccuaaacugguaccaacaaaaaccaggaaaagcaccaaaaguacuaauauacuucacaucaucucuacacucaggaguaccaucaagauucucaggaucaggaucaggaacagacuuuacacuaacaaucucaucacuacaacccgaagacuucgcaacauauuacugccaacaauacucaacaguaccauggacauucggacaaggaaccaaaguagaaauaaaaagaacaguagcagcaccauccguauuuauauucccaccaucagacgaacaacuaaaaucaggaacagcaucaguaguaugccuacuaaauaauuucuacccaagagaagcaaaaguacaauggaaaguagacaacgcagaccaaucaggaaacucacaagaaucaguaacagaacaagacucaaaagacucaacauacucccuaucaucaacccuaacuuuaucaaaagcugacuacgaaaaacacaaaguauacgcaugcgaaguaacacaccaaggacuaucauccccaguaacaaaaucauucaacagaggagaa

SEQ ID NO: 45933 - RNA, 672 nt, Artificial Sequence
  derived and/or modified sequence opt6 from Bevacizumab_180-serine_HeavyChain
gaaguucaauuaguagaaucagguggaggauuaguacaaccaggaggaucacuaagauuaagcugugcagcaucaggauacacauucacaaacuauggaaugaacuggguaagacaagcaccaggaaaaggacuagaauggguaggauggauaaauacauauacaggugaaccaacauacgcagcagacuuuaaaagaagauuuacauuuucauuagauacaucaaaaucaacagcauauuuacaaaugaauucacuuagagcagaagauacagcaguauauuacugugcaaaauacccacacuacuacggaucaucacauugguauuuugaugucuggggacaaggaacauuaguaacagucucaucagcaagcacaaaaggaccaucaguauuuccacuagcaccaagcagcaaaucaacaucaggaggaacagcagcacuaggauguuuaguaaaagauuacuuuccagaaccaguaacaguaucauggaacagcggagcacuaacuucaggaguacauacauuuccagccguaagccaaucaaguggccuauauucauuaucaucuguaguaacuguaccaaguucaucacuaggaacacaaacauauauauguaacguaaaccauaaaccaucaaacacaaaaguagauaaaaaaguagaaccaaaa

SEQ ID NO: 45934 - RNA, 672 nt, Artificial Sequence
  derived and/or modified sequence opt6 from Bevacizumab_180-substitution_deriv_HeavyCahin
gaaguacaacuaguagaaucaggaggcggacuaguacaaccaggcggaucauuaagauuaucaugugcagcaucaggauacacauucacaaacuauggaaugaacuggguaagacaagcuccaggaaaaggacuagaauggguuggcuggauaaauaccuauacaggagaaccaacauaugcagcagacuuuaaaagaagauuuacauuuucacuagacaccucuaaaucaacagcauaucuacaaaugaauagcuuaagagcagaagauacagcaguauauuacugugcaaaauacccacacuauuacgguuccagccacugguauuuugacguauggggacaagguacauuaguaacaguaucaucagcaucaacaaaaggaccaucuguauuuccauuagcaccaucaucaaaaucaacaucuggagguacagcagcauuaggauguuuaguaaaagauuacuuuccagaaccaguaacaguaucauggaacucaggagcucuaacaucaggaguacauacauuuccagcaguaucacaaucaucuggacuauauuccuuaucaucuguaguaacaguaccaucaucaucccuuggaacacaaacauauauauguaauguaaaccauaaaccaucaaauacaaaaguagauaaaaaaguagaaccaaaa

SEQ ID NO: 45935 - RNA, 1359 nt, Artificial Sequence
  derived and/or modified sequence opt6 from Bevacizumab_beta_HeavyChain1
gaaguucaacuaguagaaucagguggaggauuaguacaaccaggaggcucacuaagauuaucaugcgcagccuccggauacacauucacaaauuacggaaugaauuggguucgacaagcaccaggaaaaggacuugaauggguugguuggauaaacacauacacaggagaaccuacuuaugcagcagacuucaaacguagauuuacauucucuuuagacacaucaaaaucaacagcauacuuacaaaugaauucauuaagggcagaagauacagcaguauacuacugcgcuaaauauccucauuacuacggaucaucacauugguacuuugauguauggggccaaggaacacuagucacgguuucaucagcaucuacaaaaggacccaguguuuuuccauuagcuccaagcucaaaaagcacaucaggcggaaccgcagcucuaggaugccuagucaaagauuauuuuccagaaccuguaacaguaucauggaauucaggagcccuaacuucuggaguacacacuuucccagcaguauuacaaucaucagguuuguacucacuaagcaguguaguaacaguaccuucaucauccuuagguacacaaacuuauauuuguaacgucaaucacaaaccaaguaacacaaaaguagauaaaaaaguugaacccaaaucaugugacaaaacccauacaugcccccccugcccagccccagaauuauuagguggaccaucaguauuucuauuuccaccaaaacccaaagacacuuuaaugaucucacguacuccagaaguaacaugcguaguaguugacguaucccacgaagacccagaaguaaaauuuaacugguacguagacggaguugaaguacacaacgcaaaaacuaaaccacgagaagaacaauacaauagcaccuaccguguaguaaguguacucacaguauuacaccaagacuggcuaaauggaaaagaauauaaauguaaaguaaguaauaaagcacuaccagcaccaaucgaaaaaacuauaucaaaagcaaaaggucaaccaagagaaccacagguauacacauuaccaccauccagagaagaaaugacaaaaaaucaaguaucccuaaccugucuaguaaaaggauuuuacccgucugauauagcagucgaaugggaaucaaacggacaaccugaaaacaacuacaaaacaacaccuccaguacucgacagugacggcucauucuucuuauauucaaaauuaacuguagacaaaucaagauggcaacaagguaacguauuuucauguuccguaaugcacgaagcauuacauaaccacuacacacaaaaaucacuaagcuuaagcccaggaaaa

SEQ ID NO: 45936 - RNA, 642 nt, Artificial Sequence
  derived and/or modified sequence opt6 from Bevacizumab_beta_LightChain1
gauauccaaaugacacaaucaccaucaucacuaucagcaucuguaggagacagaguaacaauaaccugcucagcaucacaagacauaucaaacuacuuaaacugguaccaacaaaaaccuggaaaagcaccaaaaguacuaauauacuucacaucaucacuacacucaggaguuccauccagauucucaggcucaggauccggaacagacuucacacuaaccauaucaucauuacaaccagaagacuucgcaacauacuacugccaacaauacuccacaguaccauggacauucggacaaggaacaaaaguagaaauaaaaagaacaguagccgcaccaucaguauucauauucccaccaucagacgaacaauuaaaaucaggcacagcuucaguaguaugcuuacuaaacaacuucuacccaagagaagccaaaguacaauggaaaguagacaacgcacuacaaucaggaaacucacaagaauccguaacagaacaagacuccaaagacucaacauacucauuaucaucaacauuaacacuaucaaaagccgacuacgaaaaacauaaaguauacgcaugcgaaguaacacaucaaggacuauccucaccaguaaccaaaucauucaauagaggagaaugc

SEQ ID NO: 45937 - RNA, 687 nt, Artificial Sequence
  derived and/or modified sequence opt6 from Bevacizumab_FcDomain
ucaugcgauaaaacacauacaugccccccaugcccagcaccagaacuacuaggaggaccaucaguauuccuauucccaccaaaaccaaaagacacauuaaugauaucaagaacaccugaaguaacaugcguaguaguagauguaucacacgaagacccagaaguaaaauucaacugguacguagacggaguagaaguacacaaugcaaaaacaaaaccaagagaagaacaauacaacucaacauacagaguaguaucaguacuaacuguacuacaccaagacuggcuaaacggaaaagaauacaaaugcaaagucucaaacaaagcacuaccagccccaauagaaaaaacaauaucaaaagccaaaggacaaccaagagaaccacaagucuacacauuaccaccaucaagagacgaacuaacaaaaaaccaaguaucacuaacaugcuuaguaaaaggauucuacccauccgacauagccguagaaugggaaucaaacggacaaccagaaaauaacuacaaaacaacaccaccaguacuagacucagacggaucauucuucuuauacucaaaacuaacaguagacaaauccagauggcaacaaggcaacguauucucaugcucaguaaugcacgaggcacuucacaaucauuacacacaaaaaucauuaucacuaucaccaggaaaa

SEQ ID NO: 45938 - RNA, 672 nt, Artificial Sequence
  derived and/or modified sequence opt6 from Bevacizumab_HeavyChain
gaaguacaauuaguagaaucaggaggaggacuaguacaaccaggagguucauuaagauuaucaugugcagcaucaggauacacauucacaaacuauggaaugaacuggguaagacaagcaccagguaaaggucuagaauggguaggauggauaaauacauauacaggagaaccaacauaugcagcagacuuuaaaagaagauuuacauuuucauuagacacaucaaaaucaacagcauaucuacaaaugaauucauuaagagcagaagacacugcaguauauuacugcgcaaaauacccacacuauuauggaucaucacacugguacuuugacguauggggacaaggaacauuaguaacuguaucaagcgcaucaacaaaaggaccaucaguauucccauuagcaccaagcucaaaaucuacaucuggaggaacagcugcauuaggauguuuaguaaaagauuacuuuccugaaccaguaaccguaucauggaacucuggagcacucaccucaggaguccauacauucccagcuguccuacaaucaagcggacuauauucauuaucaucaguaguaacaguaccaucaucaucacuaggaacacaaacauauauauguaacgucaaucauaaaccaucaaauacaaaaguagacaaaaaaguagaaccaaaa

SEQ ID NO: 45939 - RNA, 1428 nt, Artificial Sequence
  derived and/or modified sequence opt6 from Bevacizumab_HeavyChain_variant1
gcuuccgcaacuaugggaugguccugcauaauauuauuuuuaguugccacugcaacaggcguucauucagaaguacaacuagucgaaagcggugguggauuaguacaaccagguggaucacuaagacuaucaugcgccgccucaggauauacauuuaccaacuauggaaugaauuggguccgacaagcaccaggaaaaggacuagaaugggucggcuggauaaacacauauaccggagaaccaaccuacgcagcugauuucaaaagaagauuuacauuuucacuagacacaucaaaaucuacagcauaccuucaaaugaacucccuuagagcagaagauacagcaguauacuauugcgcaaaauauccucacuacuacggaucaucucauugguauuucgacguauggggacaaggaacccuaguaacaguaucaucagcaucaacuaaagguccaucaguauuuccacuagcccccucaucaaaauccacaucaggagguacagcagcacucggguguuuaguaaaagacuauuucccagaaccaguaacaguauccuggaacucaggagcacucacaucuggaguccauacauuuccagcuguauuacaaucaucuggacuuuacucacuaucaucaguaguaacuguaccaucuucaucauuaggaacccaaacauauaucugcaauguaaaccacaaaccuucuaacacaaaaguugauaaaaaaguagaaccaaaaucuugugacaaaacacauacauguccacccugcccagcaccagaacuauuaggcgguccaucuguauucuuauuccccccuaaacccaaagacacacuaaugaucucuagaaccccugaaguaacaugcguaguaguagacguuucacacgaagacccagaaguaaaauuuaauugguauguagacggaguagaaguucacaacgcaaaaacaaaaccaagagaggaacaauacaacaguacauauagaguaguaucaguauuaacaguauuacaucaagauugguuaaauggaaaagaauauaaaugcaaaguuucaaauaaagcacucccugcaccuauagaaaaaacaaucaguaaagcaaaaggacaaccaagagaaccacaaguuuacacacuaccucccuccagagaagaaaugacaaaaaaucaagucucccucacaugucuuguuaaaggauuuuacccaucugacaucgcaguugaaugggaaaguaacggacaaccagaaaauaacuacaaaacaacaccaccagucuuagacucagauggaucauuuuucuuauacucaaaauuaacaguagacaaaucaagauggcaacaaggaaacguauuuucaugcucaguaaugcacgaagcccugcauaaucacuacacacaaaaaagcuuaucacuuucaccaggaaaa

SEQ ID NO: 45940 - RNA, 369 nt, Artificial Sequence
  derived and/or modified sequence opt6 from Bevacizumab_HeavyChain_V-Region
gaaguacaauuaguagaaaguggaggaggauuaguacaaccaggaggaaguuuaagauuaaguugugcagcaaguggauauacauuuacaaauuauggaaugaauuggguaagacaagcaccaggaaaaggauuagaauggguaggauggauaaauacauauacaggagaaccaacauaugcagcagauuuuaaaagaagauuuacauuuagucuagauacaaguaaaaguacagcauauuuacaaaugaauagucuaagagcagaagauacagcaguauauuauugugcaaaauauccacauuauuauggaaguagucauugguauuuugauguauggggacaaggaacauuaguaacaguaaguagu

SEQ ID NO: 45941 - RNA, 717 nt, Artificial Sequence
  derived and/or modified sequence opt6 from Bevacizumab_LightChain1
gcauccaaauuagcaacaaugggauggucuugcaucauauuauuccuaguagcaacagcaacaggaguacacucagacauacaaaugacacaaucaccaucaucacuaucagcaucaguaggagacagaguaacaauaacaugcagagcaucacaagacauaucaucauauuuaaacugguaccaacaaaaaccaggaaaagcaccaaaacuacuaauauacuacacaucaagacuacacagcggaguaccauccagauucucaggaucaggcucaggcacagacuucaccuucaccauaucaucauuacaaccagaagacauagcuacauacuacugccaacaaggaaacacauuaccauacaccuucggacaaggaacaaaaguagaaauaaaaagaacagucgcagccccauccguauucauauucccaccaucagaugaacaauuaaaaucaggaacagcaucaguaguaugccuauuaaacaacuucuacccacgagaagcaaaaguacaauggaaaguagacaacgcacuacaaucaggaaauucucaagaaucaguaacagaacaagacucaaaagacucaacauacucccuaucaucaaccuuaacucuauccaaagcagacuacgaaaaacacaaaguauacgcaugcgaaguaacacaccaaggacuaaguucaccaguaaccaaaucauucaacagaggcgaaugc

SEQ ID NO: 45942 - RNA, 711 nt, Artificial Sequence
  derived and/or modified sequence opt6 from Bevacizumab_LightChain2
gcaucagcaacaaugggcuggagcugcauaauauuauuccuaguagcaaccgcaaccggaguacacucugacauacaaaugacacaaucaccaucaucacuaucagcaucaguaggcgacagaguaacaauaacaugcucagccucacaagacauaucaaacuaucucaacugguaccaacaaaaaccaggaaaagcaccaaaaguccuaauauacuucaccucaucauuacacucaggcguaccaucaagauucucaggaucaggcucaggaacagacuuuacacuaacaauaucaucacuacaaccagaagacuucgcaacauacuauugucaacaauacucaacaguacccuggaccuucggacaaggaacaaaaguagaaauaaaaagaacaguagcagcaccaucaguauucauauucccaccaucagacgaacaauuaaaaucaggaacagcaucaguaguaugccuacuaaacaacuucuaccccagagaagcaaaaguccaauggaaaguagauaacgcauuacaaucaggaaauucacaagaaucagucacagaacaagacucaaaagacucaacauauucccuauccucaacacuaacacuauccaaagcagacuaugaaaaacacaaaguauacgcaugcgaagucacacaccaaggacucucaucaccaguaacuaaaucauucaauagaggagaaugu

SEQ ID NO: 45943 - RNA, 642 nt, Artificial Sequence
  derived and/or modified sequence opt6 from Bevacizumab_LightChain
gacauacaaaugacccaaucaccaucaucauuauccgcaucaguaggagacagaguaacaauaacauguucagcaucacaagacauaucaaacuacuuaaacugguaccaacaaaaaccaggaaaagcaccaaaaguacuaauauacuucacaucaucauuacacucaggaguaccaucaagauucucaggaucaggaucaggaacagacuucacacuaacaauaucaucacuacaaccagaagacuucgcaacauacuacugccaacaauacucaacaguaccauggacauucggacaaggaacaaaaguagaaaucaaaagaacagucgcagcaccaucaguauucauauucccaccaucagacgaacaacuaaaaucaggaacagcauccguaguaugccuacuaaacaacuucuacccaagagaagcaaaaguacaauggaaaguagacaacgcuuuacaaucaggaaacucacaagaaucaguaacagaacaagacuccaaagacucaacauacucacuaucaucaacacuaacacuauccaaagcagacuacgaaaaacacaaaguauacgcaugcgaaguaacacaccaaggacuauccucaccaguuacaaaaucauucaacagaggagaaugc

SEQ ID NO: 45944 - RNA, 324 nt, Artificial Sequence
  derived and/or modified sequence opt6 from Bevacizumab_LightChain_VJ-Region
gacauacaaaugacacaaucaccaucaucacuaucagcaucaguaggagacagaguaacaauaacaugcucagcaucacaagacauaucaaacuaccuaaacugguaccaacaaaaaccaggaaaagcaccaaaaguacuaauauacuucacaucaucacuacacucaggaguacccucaagauucucaggaucaggaucaggaacagacuucacacuaacaauaucaucacuacaaccagaagacuucgcaacauacuacugccaacaauacucaacaguaccauggacauucggacaaggaacaaaaguagaaauaaaaaga

SEQ ID NO: 45945 - RNA, 321 nt, Artificial Sequence
  derived and/or modified sequence opt6 from Bevacizumab_LightChain_V-Region
gacauacaaaugacacaaucaccaucaucacuaucagcaucaguaggagacagaguaacaauaacaugcucagcaucacaagacauaucaaacuaccuaaacugguaccaacaaaaaccaggaaaagcaccaaaaguacuaauauacuucacaucaucacuacacucaggaguaccaucaagauucucaggaucaggaucaggaacagacuucacacuaacaauaucaucacuacaaccagaagacuucgcaacauacuacugccaacaauacucaacaguaccauggacauucggacaaggaacaaaaguagaaauaaaa

SEQ ID NO: 45946 - RNA, 369 nt, Artificial Sequence
  derived and/or modified sequence opt6 from Bevacizumab-rhuMAb-VEGF_HeavyChain_gamma1-Chain_VDJ-Region
gaaguacaacuaguagaaucaggaggaggauuaguacaaccaggaggaucauuaagacuaucaugugcagcaucaggauauacauuuacaaauuauggaaugaauuggguaagacaagcaccaggaaaaggauuagaauggguaggauggauaaauacauauacaggagaaccaacauaugcagcagauuuuaaaagaagauuuacauucagucuagauacaucaaaaucaacagcauaucuacaaaugaauucauuaagagcagaagacacagcaguauauuauugcgcaaaauauccacauuauuauggaucaagucauugguauuuugauguauggggacaaggaacauuaguaacaguaaguuca

SEQ ID NO: 45947 - RNA, 321 nt, Artificial Sequence
  derived and/or modified sequence opt6 from Bevacizumab-rhuMAb-VEGF_LightChain_VJ-Region
gacauacaaaugacacaaucaccaucaucacuaucagcaucaguaggagacagaguaacaauaacaugcucagcaucacaagacauaucaaacuaccuaaacugguaccaacaaaaaccaggaaaagcaccaaaaguacuaauauacuucacaucaucacuacacucaggaguaccaucaagauucucaggaucaggaucaggaacagacuucacacuaacaauaucaucauuacaaccagaagacuucgcaacauacuacugccaacaauacucaacaguaccauggacauucggacaaggaacaaaaguagaaauaaaa

SEQ ID NO: 45948 - RNA, 1341 nt, Artificial Sequence
  derived and/or modified sequence opt6 from Bevacizumab_gamma1-Chain
gaaguucaauuaguugaaucaggcggaggacuaguacaaccaggaggcucccuaagauuaucaugcgcagcaucaggauauacauucaccaauuacggaaugaauuggguaagacaagcaccuggcaaaggacuagaauggguaggauggauaaacacauacacaggagaacccacauaugcagcagacuucaaaagaagauucacuuuuucauuagacacuaguaaaucaacagcauaucuacaaaugaacucacuaagagcagaagacacagccguuuauuauugugcaaaauauccacauuacuacggaagcucacauugguauuuugauguuuggggacaaggaacuuuagucacugucuccucagccucuacaaaaggaccaucaguauuuccacuagcccccucuucaaaaagcacauccggaggaaccgcagcacuagguugucuaguuaaagacuauuucccagaaccaguaacagucuccuggaacucaggcgcacucacuuccggaguacauacuuuccccgcagucuuacaaucaucaggaucucuaucuucaguagucacagucccaucaucaucacucggaacccaaacauacauauguaauguaaaucacaaaccuucaaacacaaaagucgacaaaaaaguagaacccaaaucuugcgacaaaacacacacauguccaccaugcccagcuccugaauuacuaggagguccaucaguuuuccuuuuccccccaaaaccaaaagacacacuuaugaucucaagaaccccagaaguaacaugcguuguuguagacgucucacacgaagaucccgaaguaaaauuuaacugguacguagauggaguagaaguacauaacgcaaaaacaaaacccagagaagaacaauacaacuccuauguuguuucaguauuaacaguauuacaucaagacugguuaaacggcaaagaauacaaauguaaaguaucaaacaaagcuuuaccugcaccaauagaaaaaacaauaucaaaagcaaaaggacaaccacgagaaccccaaguuuauacauuaccaccaucuagagacgaacuuacaaaaaaccaagucaguuuaacaugcuuagucaaaggcuucuauccaagugacauagcagucgaaugggaauccaacggacaaccagaaaauaauuacaaaacaaccccaccaguauuagauucagacgguucuuuuuucaaaaaacuaacuguagacaaaucaagauggcaacaaggaaauguuuucuccuguucaguaaugcacgaagcauuacacaaccauuacacacaaaaaucuuuaucacuaucaccaggaaaa

SEQ ID NO: 45949 - RNA, 1359 nt, Artificial Sequence
  derived and/or modified sequence opt6 from Bevacizumab_gamma1-Chain_CH3-Region_mutein
gaaguacaacuaguagaaaguggaggcggcuuaguacaacccggaggaucacuacgauuaucuugcgccgcaucaggcuacacuuuuacaaauuacggaaugaacuggguaagacaagccccaggaaaaggccuagaauggguuggauggauaaauacauacacuggugaaccaacauaugccgcagauuuuaaacgaagauucacauuuagucuagacacuucaaaaucaacagccuauuuacaaaugaauucuuuaagagcagaagauacagccgucuauuacugugcaaaauacccacacuauuacggaucaucacacugguacuuugacgucuggggacaaggaacuuuagucacaguaucauccgcaaguacuaaagggccauccguauucccacuugcaccaagcucaaaaucaacaucaggaggaaccgcagcauuaggaugucuaguaaaagauuacuuucccgaaccaguuaccguauccuggaacuccggagccuuaacaucaggaguccauaccuuuccugcaguucuacaaucaucuggccuuuacucacuaucaucuguaguaacuguacccucuucaucauuaggaacacaaacauauauauguaacguaaaccauaaaccaucaaauacaaaaguagauaaaaaaguagaaccaaaaaguugugacaaaacacacacaugucccccaugcccugcaccagaacuccuaggaggaccaucaguauucuuauuuccaccaaaacccaaagauacuuuaaugauaucaagaacccccgaaguaacaugugucguuguagaugucucacaugaagacccugaaguaaaauucaauugguauguagacggaguagaaguacacaaugccaaaacaaaaccccgagaagaacaauauaacucaacauacagaguuguaucaguauuaacuguauuacaccaagacuggcuaaauggaaaagaauacaaauguaaaguaucuaacaaagcacuuccagcaccaaucgaaaaaacaauuuccaaagccaaaggacaaccccgagaaccccaaguuuguacucuaccaccaucaagagaugaacuuacaaaaaaccaaguaucacuaucaugcgcagucaaaggauucuauccauccgauaucgcuguagaaugggaaagcaacggacaaccagaaaacaauuauaaaacaacaccaccaguauuagacucugacgguucauuuuuucuaguuucaaaacuuacaguagacaaaucaagauggcaacaaggaaacguauucucuugcucugucaugcacgaagcauuacacaaccacuacacacaaaaaucauuaucccuaucaccaggaaaa

SEQ ID NO: 45950 - RNA, 1347 nt, Artificial Sequence
  derived and/or modified sequence opt6 from Bezlotoxumab_HeavyChain1
gaaguccaacuaguacaaucaggagcugaaguaaaaaaauccggagaaucccuaaagauaucaugcaaaggcagcggauacagcuuuacaucauacuggauaggauggguacgacaaaugccaggaaaaggauuagaauggaugggaauauuuuauccaggagauucaucuacuagauacuccccaucuuuccaaggacaaguuacaauaucagcagacaaaucuguaaauaccgcuuaccuucaauggagcucucuaaaagcaucagacacagcaauguacuauugcgcaagaagaagaaauuggggcaacgcuuucgauauauggggccaaggaacaaugguaacaguaucaagcgcuucaacaaaaggaccuaguguauucccacuagcacccuccagcaaaaguacaucaggaggaacagcagcucuaggcugucuaguaaaagacuacuucccagaaccaguuacaguaucuuggaauucaggagcacucacaucagguguacacacauucccugcaguacuacaaagcucaggacucuauucucuaucaucaguaguaacaguaccaagcucuagucuaggaacacaaacauacauuugcaauguaaaucauaaaccaucgaauacaaaaguagacaaaagaguagaaccaaaaucaugcgauaaaacacacacuugcccacccugcccugcacccgaacuauuaggcgguccaucuguauuucuauucccaccuaaaccuaaagacacauuaaugauaucaagaacaccugaaguaacaugcguaguuguagacguaucacaugaagacccagaaguaaaauuuaacugguacguagacggcguagaaguacacaaugcaaaaaccaaaccaagagaagaacaguauaacaguacauacagaguaguaagcguauuaacaguacuucaucaagauuggcucaauggaaaagaauacaaauguaaaguaucaaauaaagcauuaccagcaccaauagaaaaaacaauaucaaaagccaaaggacaacccagagaaccacaaguauacacauuaccaccuucaagagaagaaaugacaaaaaaucaaguaaguuuaacauguuuaguaaaaggauucuacccaagcgacauagccguugaaugggaaucuaacggacaaccagaaaauaacuauaaaacaacaccacccguacuagacagcgauggauccuuuuuccuuuacuccaaacuaacaguagauaaaucaagauggcaacaaggaaauguauuuucauguucaguaaugcaugaagcacuacacaaccauuauacacaaaaaucauuaaguuuaucccccggaaaa

SEQ ID NO: 45951 - RNA, 645 nt, Artificial Sequence
  derived and/or modified sequence opt6 from Bezlotoxumab_LightChain1
gaaauaguccuaacccaaucaccaggaacacuaucacuaucacccggagaacgagcaacauuaucaugcagagcaucacaaucaguaucaucaucauaccuagccugguaccaacaaaaacccggacaagcaccaagauuacuaaucuacggagcaucaucaagagcaacaggaauaccagacagauucucuggaucaggaucaggaacagauuucacacuaacuauaucaagacuagaaccagaagacuucgcaguauacuacugucaacaauacggaucaucaacauggacauucggacaaggaacaaaagucgaaaucaaaagaacaguagcagcaccauccguauuuauauucccaccaucagacgaacaauuaaaaucaggaacagcaucagucguaugcuuacuaaacaacuucuacccaagagaagcaaaaguacaauggaaaguagacaacgcacuacaaucagguaacucacaagaaucaguaacagaacaagacucaaaagacucaacauacucacuaucaucaacauuaacccuauccaaagccgacuacgaaaaacacaaaguauacgcaugcgaaguaacacaccaaggacuaucaucaccaguaaccaaaucauucaacagaggagaaugc

SEQ ID NO: 45952 - RNA, 1335 nt, Artificial Sequence
  derived and/or modified sequence opt6 from Bimagrumab_HeavyChain1
caaguacaacuaguacaaucaggagccgaaguaaaaaaaccaggagcaagcguaaaagucucaugcaaagcaucaggauauacauucacuucaucauauauaaacuggguuagacaagcaccaggucaaggacuagaauggaugggaacuauaaacccagucucaggaucaacaucauaugcacaaaaauuucaaggaagagucacaaugacuagagacacuaguauauccacagcauauauggaacuaucaagacuaagaucugaugacacagcaguauauuacugcgccagaggaggaugguucgacuauuggggucaaggaacccuaguuacaguaucaucagcauccacaaagggaccaucaguuuucccacuagcacccucaucaaaaucaacaucaggaggaacagcagcauuaggaugcuuagugaaagacuacuucccugaaccaguaaccguuucauggaacaguggagcauuaacauccgguguccauaccuuccccgcagucuuacaaucaagcggacuauacucacuaaguucaguaguuacaguccccucaaguucacucggaacacaaacuuacauaugcaacgucaaccacaaaccaagcaacacuaaaguagacaaaagaguagaaccaaaaucaugcgauaaaacacauacauguccaccaugcccagcaccagaagcugcaggaggaccuuccguauuuuuauucccaccaaaacccaaagacacccuaaugauaucuagaacaccagaaguuacaugcgucguaguugacguuucacaugaagacccagaaguaaaauucaauugguauguagauggaguagaaguacacaacgcaaaaacgaaacccagagaagaacaauacaacucaacauacagaguaguaucaguauuaacaguauuacaccaagauugguuaaacggaaaagaauacaaaugcaaaguaucaaauaaagcacuuccagcaccaauagaaaaaacaauaucaaaagcaaaaggacaaccacgagaaccacaaguauacaccuuaccacccucaagagaagaaaugacaaaaaaccaagucucguuaacaugucuaguaaaaggauucuacccaucagacaucgcagucgaaugggaaucaaacggccaaccagaaaauaacuacaaaacaacaccaccaguacuagacucugacggaucauucuuccucuacaguaaauuaacaguugacaaauccagauggcaacaaggaaauguauucuccugcucagucaugcaugaagcccuacacaaccacuauacacaaaaaucauuaucauuaagcccaggaaaa

SEQ ID NO: 45953 - RNA, 1332 nt, Artificial Sequence
  derived and/or modified sequence opt6 from Bimagrumab_HeavyChain
caaguucaacuaguacaaucaggagccgaaguuaaaaaaccaggagccucaguaaaaguaucauguaaagcaucaggauauacauucacaucuuccuacauaaauuggguaagacaagccccuggacaaggauuagaauggauggguacaauaaaccccguaucuggaucuacuucauacgcacaaaaauuccaaggacgaguaacuaugacaagagacacaucuauaucaacugcuuacauggaauuaucaagacuaagauccgacgacaccgcaguauacuacugcgcaagaggaggcugguucgauuacuggggacaaggaacuuuaguaacaguaucaucagcaucuacaaaaggaccaucagucuuuccauuagccccaucaucuaaauccacaucaggaggaacagcagccuuaggaugcuuaguaaaagauuauuuuccagaaccaguaacaguaucuuggaauucaggagcacuaacaucaggaguccacacuuuuccugcaguuuuacaauccucaggccucuacucauuaucaucaguagucacaguaccaucaagcaguuuaggaacacaaacauacauauguaacgucaaccauaaaccgucaaauacuaaaguagauaaaagaguugaaccaaaauccugcgauaaaacacacacaugucccccaugcccagcuccagaagcagccggcggaccauccguauucuuauucccgccaaaaccaaaagacacacuaaugaucagccgaacacccgaagucaccuguguuguaguugacguaucucacgaagaucccgaaguaaaauucaacugguacguagauggcgucgaaguccauaaugcaaaaacaaaaccucgugaagaacaauauaauucuacauaccgaguaguuucaguccuaacaguacuacaucaagacuggcuaaauggaaaagaauacaaauguaaaguaucaaacaaagcauuaccagcacccauagaaaaaacuauaucaaaagcaaaaggacaacccagggaaccucaaguauauacauuacccccuucaagagaagaaaugacaaaaaaucaaguaucauuaaccugcuuaguaaaaggauuuuacccaucagacauagcaguagaaugggaaucuaacggacaaccagaaaauaacuacaaaacuacaccaccuguauuagacucagauggaucauucuuucuauacuccaaacuaacaguagacaaaucucgauggcaacaaggcaauguauucuccuguucagugaugcacgaagcacuacauaaccauuacacgcaaaaaagucuaucucuuucaccagga

SEQ ID NO: 45954 - RNA, 651 nt, Artificial Sequence
  derived and/or modified sequence opt6 from Bimagrumab_LightChain1
caaucagcauuaacacaaccagcaucaguaucaggcucaccaggacaaucaauaacaauaucuugcacaggaacaucauccgacguaggauccuacaacuacguaaacugguaucaacaacaucccggaaaagccccaaaauuaaugauauacggaguaucaaaaagaccaucaggaguaucaaacagauucucaggaucaaaaucaggaaacacagcaucccuaacaauaucaggauuacaagcagaagacgaagcagacuacuacugcggaacauucgcaggaggaucauacuacggaguauucggaggcggaacaaaauuaacaguacuaggacaaccaaaagcagcaccauccguaacacuauucccaccaucauccgaagaacuacaagcuaacaaagcaacauuaguaugccuaauaucagacuucuacccaggagcaguaacaguagcauggaaagcagacucauccccaguaaaagcaggaguagaaacaacaacaccaucaaaacaaucaaacaacaaauacgcagcaucaucauaccuaucacuaacaccagaacaauggaaaucacacagaucauauucaugccaaguaacacaugaaggaucaacaguagaaaaaacaguagcacccaccgaaugcuca

SEQ ID NO: 45955 - RNA, 1365 nt, Artificial Sequence
  derived and/or modified sequence opt6 from Bimekizumab_HeavyChain1
gaaguacaacuaguagaaucugguggaggacucguacaaccaggaggaucccuaagacucucaugcgccgcaucaggauucacauucucagacuacaacauggccuggguacgccaagcacccggcaaaggacuagaauggguagcaacaauaacauacgaaggaagaaauacuuauuacagagacucagucaaaggacgcuucacaauuucacgugacaacgcaaaaaauagucuauaccuacaaaugaacucacuaagagcagaagacacagcugucuacuacugugcaucaccuccccaauacuacgaaggaucaauauacagacuaugguuugcacacuggggacaaggaacacucguaacaguaucauccgcaucaacuaaagguccuucaguauucccacuagcuccaucaucuaaaucaacaucaggagguacugcagcauuaggaugccuaguaaaagauuacuucccagaaccaguaacaguaucauggaacagcggagcacucacaucaggaguacauaccuucccagccguccuacaaucaucaggacuauacaguuuaucaucaguaguaacaguaccaaguuccucacuaggaacucaaaccuauaucugcaacguaaaccauaaaccaucaaacacaaaaguggacaaaaaaguagaaccaaaaucuugcgauaaaacacacacaugcccucccugcccagcaccagaacuacuaggaggaccuucaguauuucuauucccacccaaaccaaaagauacacuuaugauaucaagaaccccagaaguaacaugcguaguagucgacguuucccaugaagauccagaaguaaaauucaacugguacguagacggaguugaaguacacaaugcaaaaacaaaaccaagagaagaacaauauaacucaacauaccgugucguuagcguacuuacaguacuacaccaagacuggcucaacggaaaagaauacaaaugcaaaguaucaaacaaagcacuaccagccccaauagaaaaaaccauaucaaaagcaaagggucaaccccgagaaccccaaguuuacacacuaccaccaagccgagacgaacuaaccaaaaaccaaguaucacuaacaugccucguaaaaggcuucuacccaucagacaucgcaguagaaugggaaucaaacggacaaccagaaaacaacuacaaaacaacaccacccgucuuagacagcgacgguucauuuuuccuauauuccaaauuaacaguagacaaaucuagauggcaacaaggaaacguauucucaugcucgguaaugcacgaagcacuacacaaucacuauacacaaaaaucauuaucccuaagcccaggaaaa

SEQ ID NO: 45956 - RNA, 642 nt, Artificial Sequence
  derived and/or modified sequence opt6 from Bimekizumab_LightChain1
gcaauacaacuaacacaaucaccaucaucacuaagcgcaucaguaggagacagaguaacaauaacaugcagagcagacgaaagcguaagaacacuaaugcacugguaccaacaaaaaccaggaaaagcaccaaaacuauuaaucuaccuaguaucaaacagcgaaauaggaguaccagacagauucucaggaucaggaucaggaacagauuucagacuaacaauaagcucacuacaaccagaagacuuugcaacauacuauugccaacaaacauggucagacccauggacauucggacaaggaacaaaaguagaaauaaaaagaacaguagcagcaccaagcguauucauauucccacccucagacgaacaacuaaaaucaggaacagcaucaguuguaugccuacuaaauaacuuuuacccaagagaagcaaaaguccaauggaaaguagacaacgcacuacaaucaggaaacucacaagaaagcguaacagaacaagacucaaaagacucaacauacaguuuaagcucaacacuaacacuaaguaaagccgauuacgaaaaacauaaaguauacgcaugcgaagucacacaccaaggauuaagcucaccaguaacaaaaagcuucaacagaggagaaugc

SEQ ID NO: 45957 - RNA, 1344 nt, Artificial Sequence
  derived and/or modified sequence opt6 from Bleselumab_HeavyChain1
caauuacaacuucaagaaucaggaccaggacuacuaaaaccuuccgaaacacucagucuaacauguacaguauccggaggauccauaucauccccuggauauuacggagguuggauaagacaacccccaggaaaagguuuagaauggauaggaucaauauacaaaucaggaaguacauaucauaacccaucacuaaaaucacgagucacaaucucaguagauacaucuaaaaaccaauucucacuaaaacuaucaucuguaacugcagcugacacugcagucuacuacuguacaagaccaguaguccgcuauuuuggaugguucgacccauggggacaaggaacauuagucacaguuuccuccgccucaacaaaagguccaucaguauucccuuuagccccaugcucacgaucaacaucugaaucaacagcugcacuaggaugucuaguaaaagacuacuuuccagaacccguuaccgucucuuggaauuccggagccuuaaccucaggcguacauacauuuccagccguccuacaaucuucuggucuauauuccuuaucauccguagucacaguaccauccucaucuuuaggcacaaaaacauauacauguaacguagaucauaaaccuucaaauacaaaaguagauaaaagaguagaaucaaaauauggacccccaugcccaccaugcccagcaccagaauucgaaggaggaccaagcgucuuuuuauuuccaccaaaaccaaaagauacacuuaugauuucuagaaccccagaaguaacauguguaguagucgauguaucucaagaagauccugaaguucaauuuaacugguacguagacggaguagaaguacacaaugcaaaaacaaaaccccgcgaagaacaauuuaauucaacauacagaguaguaucuguucuaacaguccuucaccaagacuggcuaaacggaaaagaauauaaaugcaaaguaucaaauaaaggacucccaucauccaucgaaaaaacaauauccaaagcuaaaggacaacccagagaaccacaaguauauacccuaccaccaagucaagaagaaaugacaaaaaaccaaguuucuuuaacaugucuaguaaaaggauucuauccaucagacauugccguagaaugggaaagcaacggacaaccugaaaauaauuauaaaacaacaccuccaguauuagacagcgauggauccuuuuuuuuauauucacgacuaaccguagauaaaucucguuggcaagaaggcaauguauucucauguuccguaaugcaugaagcccuacauaaucauuacacacaaaaaucacuuucacuuagcuuagguaaa

SEQ ID NO: 45958 - RNA, 639 nt, Artificial Sequence
  derived and/or modified sequence opt6 from Bleselumab_LightChain1
gcaauacaacuaacccaaucaccaucaucacuaucugcaucaguaggagacagaguaacaauaacaugcagagcaucacaaggaauaucaucagcacuagcaugguaccaacaaaaaccaggaaaagcaccaaaauuacuaauauacgacgcaucaaacuuagaaucaggaguaccaucacgauucucaggaucaggaucaggaacagauuucacacuaacaauaucaucccuacaaccagaagacuucgcaacauacuauugccaacaauucaacucauacccaacauucggacaaggaacaaaagucgaaauaaaacgaacaguagcagcuccaucaguauucauauucccaccaucagacgaacaauuaaaauccggaacagcaagcguaguaugccuauuaaacaacuucuacccacgagaagcaaaaguacaauggaaaguagacaaugcacuacaaucaggaaacucacaagaaucaguaacagaacaagacucaaaagacucaacauacucacuaucaucaacacuaacacuauccaaagcagacuaugaaaaacacaaaguauacgcaugugaaguuacacaccaaggacuaucuucacccguaacaaaauccuucaacagaggcgaaugc

SEQ ID NO: 45959 - RNA, 1512 nt, Artificial Sequence
  derived and/or modified sequence opt6 from Blinatumomab_HeavyChain1
gauauucaacuaacacaaucaccagcaaguuuagcaguaucguuaggacaaagagcaacaauuaguuguaaagcaagccaaagcguugauuaugacggagauagcuauuuaaauugguaccaacaaauuccaggccaaccaccaaaacuauugauauaugacgccucaaauuuaguaagcggaauaccuccaagauuuagcggaucaggaagugguacugauuuuacauuaaacauacacccagucgaaaaaguagaugccgcuacauaucauugccaacaaucaacagaagacccauggacauuuggagguggaacuaaacuagaaauuaaaggaggcggcggaucuggaggagggggaaguggaggcggaggaagucaaguacaauuacaacaaaguggagcagaacucguuagacccggaucaaguguaaaaauuaguugcaaagccagcggauaugcauucagcaguuauuggaugaauuggguuaaacaacgaccaggacaagguuuagaauggauuggacaaauuuggccuggagacggagauacaaauuauaauggaaaauucaaaggaaaagccacacuaacagcagacgaaaguagcucaacagcauauaugcaauuaaguaguuuagcaagugaagauucagcaguuuauuuuugugcaagaagagaaaccacgacaguaggaagauacuauuaugcaauggauuacuggggacaagggacaaccguaacaguaucaucaggaggcggaggaucagauauaaaauuacaacaaucaggugcagaauuagcaagaccaggagcaagcguaaaaaugucaugcaaaacaagcggauauacuuucacaagauacaccaugcacuggguaaaacaaagaccuggacaaggauuagaauggauagguuauauaaauccaaguagaggauauacaaauuauaaucaaaaauucaaagacaaagcaacacuaacaacugauaaauccaguagcacagcauacaugcaacuuaguaguuuaacaucagaggauagcgcaguauauuauugugcuagauauuaugacgaccauuauuguuuagacuauuggggacagggaacuacuuuaacaguaucuagcguagaaggaggauccggaggaaguggcggaucaggaggaaguggaggaguggacgauauacaacuaacacagaguccggcuauaaugagcgcaagucccggagaaaaaguaacaaugacaugucgagcaucaucaucaguauccuauaugaauugguaucaacaaaaaucagggacaaguccaaaaagauggauauaugacacaaguaaaguagcaagcggaguaccauauagauuuucagguagcgggucaggaacaaguuauagccuaacaauaaguucaauggaagcagaagaugccgcaacauauuauugccaacaauggaguagcaauccauugacuuuuggagcaggaacaaaauuagaacugaaacaucaucaucaccaccau

SEQ ID NO: 45960 - RNA, 1512 nt, Artificial Sequence
  derived and/or modified sequence opt6 from Blinatumomab_SingleChain
gauauucaguuaacacaaucgccagcuagucuagcaguaaguuuaggucaacgagcaacaauuaguuguaaagcaucucaaagcguugauuaugauggugacucuuaucuaaauugguaucaacaaauaccaggacaaccaccaaaauuauugauuuaugacgcgaguaauuuaguaaguggaauaccuccaagguuuucaggaucagggucaggaacagacuuuacauuaaauauacauccuguugaaaaaguugaugcagcaaccuaccauugccaacaaucaacagaagacccauggacuuuuggaggaggaacaaaacuugaaauuaaaggaggaggaggaaguggagguggagguucaggaggaggaggaucacaaguucaauugcaacaaucaggagcagaauuaguaagaccaggaaguagugucaaaauaucauguaaagcuaguggauaugccuucuccucauacuggaugaacuggguaaagcaaagaccaggucaaggauuagaauggauaggacaaauuuggccaggagauggagauacaaauuauaauggaaaauuuaaagguaaagcaacucuaacugcagaugaaucaucaucaacugcauauaugcaauuaucuucacuagcaagugaggauucagcaguauauuuuugugcaagaagagaaacuacaacuguaggaagauauuauuaugcgauggauuauuggggacaaggaacaacaguaacuguaucaaguggaggcggaggaucagauauaaaauugcaacagaguggugcugaauuagcaagaccaggggccucuguaaaaaugaguugcaaaacaagcggauauacauucacaagauauacaaugcauugggucaaacaacgaccaggacaaggacuagaauggauuggauauauaaauccuucaagaggauacacaaacuauaaucaaaaauucaaagauaaagcuacacugacaacagacaagucaucaaguacagcuuauaugcaauuaaguaguuuaacaucagaagauagugcaguauauuauugugcaagauacuaugacgaucauuauuguuuagacuacuggggacaaggaacgacuuuaacgguuagcaguguagaaggaggaucaggaggaagcggaggaucaggaggaucuggagguguagacgauauacaauugacacaaucaccagcuauaaugagugcuagcccaggagaaaaagucacaaugacauguagagcaaguucaucaguuucauauaugaauugguaucaacaaaaaagcggaacaaguccuaagagauggauauacgauaccuccaaaguagcaucuggaguaccauacagauuuucagggagugggagugguacaucauacucauuaacaauaaguucaauggaagcagaagaugccgcaacauauuauugucaacaauggucaucaaacccucuaacauuuggagccggaacaaaauuagaauuaaaacaucaccaucaucaucac

SEQ ID NO: 45961 - RNA, 1512 nt, Artificial Sequence
  derived and/or modified sequence opt6 from Blinatumumab_SingleChain_variable_fragment_fusion_protein_(bite)
gauauacaauuaacacaaagcccagcaaguuuagcagugaguuuagggcaaagagcaacaauaaguuguaaagcaagucaaaguguagauuaugacggagacucauauuuaaauugguaucaacaaauaccaggacaaccaccaaaauuauuaauauaugaugcaaguaacuugguaucaggaauaccaccaagguucagcggaucaggaucaggaacagauuucacauuaaauauucaucccgucgaaaaaguagacgcagcaacauaucacugccaacaaagcaccgaagauccauggacauuuggugggggaaccaaacuagaaauaaaaggcggaggcggaucaggagguggagggaguggaggaggaggaucacagguacaauuacaacaaucaggcgccgaauuaguaagaccaggaucaucaguaaaaauaucauguaaagcaucagguuaugcauuuaguucauacuggaugaauugggugaaacaaagaccgggacaaggauuagaauggauuggacaaauauggccaggagacggagauacaaauuauaauggaaaauuuaaaggaaaagcaacacuaacagcugacgaaucaagcucuacugccuauaugcaacuaaguucauuagcaagugaagauucagcuguuuauuucugugcaaggagagaaacuacaacaguagguagauauuacuacgcuauggacuauuggggacaaggaaccacaguaacaguaucaaguggaggaggaggaucagauauaaaauuacaacaaaguggagcagaauuagcaagaccaggcgcaaguguaaaaaugucauguaaaacaaguggauacacauuuacaagauauacaaugcauuggguaaaacaaaggccaggucaaggguuagaauggauaggauauauaaacccaaguagaggauauacaaauuauaaucaaaaauuuaaggacaaagcaacuuuaacuacagauaaaucaaguagcacggccuauaugcaauuaucaucacuaacuucagaggauucagcgguauacuauugugcaagauauuacgaugaucauuauugucuugauuauuggggacaaggaacaacauuaacaguaucaagcguugaaggagggucaggagguaguggagggucaggcggaucaggaggaguagaugauauacaacuaacucaaaguccagcuauaaugagcgcaaguccaggagaaaaaguaaccaugacauguagggcaaguucuagcguaagcuacaugaauugguaccaacaaaaaagcggaacaaguccgaaaagauggauauaugauaccaguaagguugcuaguggaguaccauauagauuuaguggaagcgguaguggaacaaguuauaguuuaacaauuucaaguauggaagcagaagaugcagcaacauacuacugucaacaauggucaagcaauccacuaacuuuuggagcaggaacaaaacuggaauuaaaacaucaucaucaucaucau

SEQ ID NO: 45962 - RNA, 1344 nt, Artificial Sequence
  derived and/or modified sequence opt6 from Blontuvetmab_HeavyChain
caaguacaacuucaacaaagucgagcagaauuagucagaccuggagcaucaguaacauuaucaugcaaacccucaggauacacauucacagacuacgaaguacacuggguaaaacaaaccccuguacacggccuagaauggauuggagcaauagacccagaaaccggcggcacagccgauaaccaaaaauuuaaaggaaaagcaauauuaacagcugacaaaucauccucaacagcauauauggaacuuagauccuuaacauccgaagacagcgcaguuuauuacugcacaaauuucguagacguauggggaaccggaaccacagucacaguuagcucagcuucaacaacagccccaucaguauuuccauuagcaccauccugcggcucucaaucaggaucaacaguagcacucgccugucuaguuuccggauacuuuccagaaccagucacaguauccuggaacuccggaucccucacuucaggaguacacacauuuccaucaguccuccaaucuuccggacuauauucuuuaucaucaaugguuacaguaccaucaucucgcuggccuucagaaacauucacauguaauguugcacaucccgcaucaaaaaccaaaguagauaaaccaguaccaaaaagagaaaacggaagaguaccaagaccaccagacuguccaaaauguccagcuccagaaauguuaggcggaccaucaguauucauauuuccaccaaaaccaaaagauaccuuauuaauagcacgaacaccagaaguaacauguguuguaguagaucuagauccagaagacccugaaguacaaaucaguugguuuguugacggcaaacaaaugcaaacagcaaaaacacaaccuagagaagaacaauuuaauggcacauaucgaguaguauccguccucccuaucggccaccaagacuggcuaaaaggaaaacaauuuacaugcaaaguaaauaacaaagccuuaccaucacccauagaaagaacuauaucaaaagcuagaggacaagcucaucaaccaucaguauacguauuaccucccucacgugaagaacuaucaaaaaauacaguuucauuaacaugccuaauaaaagacuucuucccaccagacauagacguagaauggcaaucaaacggacaacaagaaccagaaucaaaauauagaacaacaccaccacaauuagaugaagacgguucauacuuucuauauucaaaacuaucaguagacaaaaguagauggcaaagaggagauacuuuuauaugugcaguaaugcaugaagcauuacauaaccauuauacucaaaaaucucuaucccauagcccaggaaaa

SEQ ID NO: 45963 - RNA, 657 nt, Artificial Sequence
  derived and/or modified sequence opt6 from Blontuvetmab_LightChain
gacguagucaugucacaaucaccaucaucacuagccguuucaguaggagaaaaaguaacaaugucaugcaaaucaucacaaucacuacuauacucaggaaaccaaaaaaacuaucuagcaugguaccaacaaaaacccggacaaucaccaagacuacuaauauacugggcaucaacaagagaaucaggagucccagacagauucacaggcucaggauccggaacagacuucacacuaacaauaucaucuguaaaagcagaagaccuagcaguauucuacugucaacaauacuacaacuacccauuaacauucggaggaggaacacaccuaaccguacuaggccaacccaaagcaucaccauccguaacauuauuuccacccucauccgaagaacuaggagcaaacaaagccacccuaguaugucuaaucuccgacuuuuauccaucaggaguaaccguagcauggaaagccgacggaucaccaauaacccaaggaguagaaacaacaaaaccaucaaaacaaucaaacaacaaauacgcagcaucaucauaccuaucacuaacaccagacaaauggaaaucacacuccucauucuccugcuuaguaacacacgaaggcucaaccguagaaaaaaaaguagcacccgcagaaugcuca

SEQ ID NO: 45964 - RNA, 1332 nt, Artificial Sequence
  derived and/or modified sequence opt6 from Blosozumab_HeavyChain1
caaguacagcuaguacaaucuggagcagaaguuaaaaaaccaggagccucaguuaaaguaucuugcaaaguaucaggauucccaauaaaagauaccuuucaacacuggguccgacaagcaccaggaaaaggacuagaauggaugggauggucagauccagaaauaggagauacagaauacgcaucaaaauuucaaggaagaguaacaaugaccgaagacacgucaaccgauacagcauacauggaauuaucuucccuacgcucagaggauaccgcagucuacuauugcgcaacaggagacacaacauacaaauucgacuucuggggacaaggcacaacaguaaccguuucaucagcaucaacaaaagguccauccguauuuccauuagcaccaugcucucgauccacauccgaaagcacagcagcauuaggaugucuaguaaaagauuacuucccagaaccuguuacaguaucauggaacuccggagcauuaacaucaggaguucacacauuuccagcaguccuacaaucaucuggcuuauacucucuaucaucaguaguaacagucccauccucaagucuaggaacaaaaacauacacaugcaacguagaccauaaaccaucaaacacuaaaguagacaaaagaguagaaucaaaauacgguccaccuugucccccaugcccagcuccagaauuucucggaggaccaucaguauucuuauucccaccaaaaccuaaagauacccuaaugaucucaagaacacccgaaguaacauguguaguaguagacguaucucaagaagacccagaaguacaauuuaauugguauguagacggaguugaaguacacaacgccaaaacaaaaccaagggaagaacaauuuaacucaaccuauagagucguaucagucuuaacuguauuacaucaagacuggcuaaacgguaaagaauacaaauguaaaguaucaaauaaaggcuuaccauccucaaucgaaaaaacaauauccaaagcaaaaggacaaccaagagaaccacaaguauauacauuaccaccaucacaagaagaaaugaccaaaaaucaaguuucacuaacaugcuuagucaaaggauucuacccauccgauauagcaguagaaugggaaucaaauggacaaccugaaaacaacuauaagacaaccccaccaguuuuagauucagacggaagcuucuuccuauauucaagacuaacaguagacaaaucccgauggcaagaaggaaauguauuuuccugcaguguaaugcaugaagcacuacauaaccacuacacacaaaaaucacuaucuuuaucauuagga

SEQ ID NO: 45965 - RNA, 642 nt, Artificial Sequence
  derived and/or modified sequence opt6 from Blosozumab_LightChain1
gacauacaaaugacacaaucaccaucaagcuuaagcgcaaguguaggagaccgaguaacaauaacauguaaagcaucacaagacguacacacagcaguagcaugguaccaacaaaaaccaggaaaagcaccaaaacuacuaauauauugggcaaguacaagauggacaggaguaccaagcagauucucaggaucaggaucaggcacagacuuuacauuaaccauaagcucacuacaaccagaagacuuugcaacauacuauugccaacaauauucagauuacccauggacauucggaggaggaaccaaaguagaaauaaaaagaacaguagcagcaccaucaguauucauauucccaccaucagacgaacaacuaaaaucaggaacagcaucuguaguaugccuacuaaauaacuuuuacccaagagaagcaaaaguacaauggaaaguagauaacgcacuacaaaguggaaacucacaagaaucaguaaccgaacaagacagcaaagacucaacauacagcuuaucaucaacauuaacauuaagcaaagccgauuacgaaaaacauaaaguauacgcaugugaaguaacacaucaaggauuaagcucaccaguaacaaaaagcuuuaacagaggagaaugc

SEQ ID NO: 45966 - RNA, 1332 nt, Artificial Sequence
  derived and/or modified sequence opt6 from Bococizumab_HeavyChain1
caaguacaacucguacagucuggcgcagaagucaaaaaaccaggagcauccguaaaaguuuccugcaaagccucaggauacaccuuuacaucauauuauaugcauugggucagacaagccccaggacaaggacucgaauggaugggagaaauaucaccuuuuggaggcagaacuaauuacaaugaaaaauucaaaucaagaguaacaaugacucgugacacaucaaccucaacaguauacauggaacuaucaaguuuaagaucagaagauacagcaguauacuacugugcaagagaaagaccacuauacgccucagacuuauggggacaaggaacaaccgucacaguaucuuccgcuagcacaaaaggacccucaguauuuccauuagcuccaugcucaagaucaacauccgaauccacagcagcacuaggauguuuagucaaagauuacuuccccgaaccaguaacaguaucauggaacucaggagcauuaacauccggaguacacacauucccagcaguccuacaauccucaggcuuauauucacuaagcaguguaguaacaguaccuuccucaaacuucggaacacaaacauacacauguaacguagaccauaaaccaucaaacaccaaaguagacaaaacaguagaaagaaaauguugcguugaauguccaccaugcccagcuccaccaguagcaggucccucagucuuucuuuuuccaccaaaaccaaaagauacacuaaugauaucacguacuccugaaguaaccuguguuguaguagacgucucccaugaagaucccgaaguacaauucaauugguacguagauggaguugaaguacacaacgcaaaaacaaaaccaagagaagaacaauucaacuccaccuucagaguaguuucaguacuaacaguuguacaccaagacuggcuaaauggaaaagaauacaaaugcaaaguauccaauaaaggacucccaucuucaauagaaaaaacaaucucaaaaacuaaaggccaaccaagagaaccccaaguauacacauuaccaccauccagagaagaaaugacaaaaaaccaaguaucauuaacuuguuuaguuaaaggauucuauccauccgacauagcuguagaaugggaaucaaacggacaaccagaaaauaacuacaaaacuacccccccuaugcucgacucagauggaaguuuuuuccuuuacagcaaacuaacaguagacaaaucaagauggcaacaaggcaacguauuuucauguucaguaaugcacgaagcacuacauaaucacuacacacaaaaaucuuuaucacuaucacccgguaaa

SEQ ID NO: 45967 - RNA, 642 nt, Artificial Sequence
  derived and/or modified sequence opt6 from Bococizumab_LightChain1
gacauccaaaugacacaaucaccaucaagccuaucagcaucaguaggagacagaguaacaauaacaugcagagcaucacaaggaauaucauccgcacuagcaugguaccaacaaaaacccggaaaagcaccaaaacuacucauauacucagcaucauaccguuauacaggaguaccaucacgauucucaggcucaggaucaggaacagacuucacauucacaauaucaucacuacaaccagaagacauagcaacauacuacugccaacaaagauacucacuauggagaacauucggacaaggaacaaaacucgaaauuaaaagaacagucgcagcaccauccguauucauauucccccccucagacgaacaauuaaaaucaggaacagcaucaguaguaugcuuacuaaauaacuucuacccacgagaagcaaaaguacaauggaaaguagacaacgcacuacaauccggaaacucacaagaaucaguaacagaacaagacucaaaagacucaacauacucacuaucaucaacccuaacccuaucaaaagcagacuacgaaaaacauaaaguauacgcaugugaaguaacacaccaaggacuaucaucuccaguaacaaaauccuucaacagaggagaaugc

SEQ ID NO: 45968 - RNA, 1338 nt, Artificial Sequence
  derived and/or modified sequence opt6 from Brentuximab_vedotin_HeavyChain1
caaauacaauuacaacaaucagguccagaaguaguaaaaccaggagcuucaguaaaaaucucauguaaagcuucaggauacacauucacagacuacuauauaacauggguaaaacaaaaaccuggucaaggauuagaauggaucggauggauauacccaggauccggaaauacaaaauauaaugaaaaauuuaaaggcaaagcaacacuaacaguagacacauccucaucaacugcauuuaugcaacuaucuucucuuacaucugaagacacagcaguauacuucugcgccaacuacggaaauuacugguucgcauauuggggacaagguacacaaguaaccguaucagcagcaucaacuaaaggacccucuguauucccacuugcaccaucaucaaaaucuacaucaggcggaacugcagcacuaggcugccuaguuaaagacuauuuucccgaaccagucacaguaucauggaauuccggagcccuaacaucaggaguacacaccuuuccagccguauuacaaucuucaggacuauacucauuauccucaguaguaaccguaccaucauccaguuuaggaacacaaacauauauauguaacguuaaccacaaaccaucaaacacuaaaguugacaaaaaaguagaaccuaaaucaugcgauaaaacacauaccugcccaccuugcccugcaccugaauuacucggaggaccauccguauuucuauuuccucccaaaccaaaagacacucuaaugauaucacgaacuccugaaguaaccuguguaguaguagaugucucacacgaagauccugaagucaaauucaauugguauguagacggaguagaaguacacaacgcaaaaacaaaaccacgagaagaacaauacaauucaacauacagaguaguaucaguacucacaguacuacaccaagauuggcuaaacggcaaagaauacaaaugcaaagucucaaacaaagcacucccagcaccaauugaaaaaacaaucuccaaagcaaaaggacaaccuagagaaccacaaguuuauacccuaccaccaucaagagacgaauuaacaaaaaaucaaguaucacuaacaugcuuaguuaaaggauucuaccccagcgacauagccguagaaugggaaucaaacggccaaccagaaaacaacuacaaaacaacaccuccaguacuugacucagauggaucauucuucuuauacucuaaacuaaccgucgacaaaucacgauggcaacaaggcaacguauuuucuuguuccguaaugcacgaagcauuacauaaccacuacacccaaaaaucacuaucauuaucaccagga

SEQ ID NO: 45969 - RNA, 654 nt, Artificial Sequence
  derived and/or modified sequence opt6 from Brentuximab_vedotin_LightChain1
gacauaguacuaacacaaucaccagcaucacuagcaguaucacuaggucaacgagcaacaauaagcugcaaagcaucacaaagcguagacuucgacggagacucauacaugaacugguaccaacaaaaaccaggccaaccaccaaaaguccuaauauacgcagcaucaaaccuagaaaguggaauaccagcaagauucucaggcucaggaucaggaacagacuucacccuaaauauacacccaguagaagaagaagacgcagcaacauacuacugccaacaaucaaacgaagacccauggacauucggaggaggaaccaaacuagaaauaaaaagaacaguagcagcaccaucaguauucauauucccaccaucagacgaacaacuaaaaucaggaacagcaucaguaguaugccuacuaaacaacuucuacccaagagaagcaaaaguccaauggaaaguugacaacgcacuacaaucaggaaacucacaagaaaguguaaccgaacaagacucaaaagacucaacauacagucuaucaucaacacuaacacuaaguaaagcagacuacgaaaaacacaaaguauacgcaugcgaaguaacacaccaaggauuaucaucaccaguaacaaaaucauucaacagaggagaaugc

SEQ ID NO: 45970 - RNA, 1335 nt, Artificial Sequence
  derived and/or modified sequence opt6 from Briakinumab_HeavyChain1
caaguacaacuagucgaaucaggaggcggaguaguacaaccaggcagaucauuaagauuaucaugcgcagcauccggauuuacauucucauccuauggcaugcacuggguaagacaagcuccaggaaaaggauuagaauggguagccuucauaagauacgacggcucaaauaaauauuaugcagauucagucaaaggaagauuuacaauaucaagagauaacuccaaaaacacauuauacuuacaaaugaacucccuaagagcagaagauacagccguuuauuacugcaaaacacaugguucacacgauaauuggggacaaggaacaaugguaacaguaucaucagcaucaacaaaaggaccaagcguauuuccacuagccccaucaucaaaaucaacuucaggaggaaccgcagcccuaggaugccuaguaaaagauuauuuuccagaaccuguaacaguaagcuggaacucuggagcacuaacauccggaguacauacauucccagcaguccuccaaucaucaggauuauacuccuuaucuuccguuguaacaguaccaagcuccucccuaggcacccaaacauauaucugcaacguaaaccauaaaccaucaaacacuaaagucgacaaaaaaguagaacccaaauccugugacaaaacacauacuugcccaccauguccugcaccagaacucuuaggaggaccauccguauuccuauucccaccaaaaccuaaagacacauuaaugauaucaagaacacccgaaguaacuugcguaguugucgacguaucucaugaagaucccgaaguaaaauucaacugguauguagacggaguugaaguucacaacgccaaaacaaaaccacgagaagaacaauacaacucaacauacagaguaguaucaguacuaacaguuuuacaucaagacugguuaaacggcaaagaauauaaaugcaaagucucaaacaaagcccuaccagccccaauagaaaaaacaauaucuaaagcaaaaggacaaccccgcgaaccacaaguauacacacuaccccccucuagagaagaaaugaccaaaaaccaaguaucccuaacaugccuaguaaaaggauucuacccuucagauauagcaguagaaugggaaucaaauggucaaccagaaaauaacuacaaaaccacaccaccuguacucgacucagacggaucauucuuuuuauauucuaaacuaacaguagauaaauccagauggcaacaaggaaauguauucucauguucaguaaugcaugaagcccuacacaaccacuauacccaaaaaucauuaucauuaaguccaggaaaa

SEQ ID NO: 45971 - RNA, 651 nt, Artificial Sequence
  derived and/or modified sequence opt6 from Briakinumab_LightChain1
caaucaguacuaacccaaccaccaucaguaucaggagcaccaggacaaagaguaacaauauccugcuccggaucaagauccaacauaggaucaaacacaguaaaaugguaccaacaacuaccaggaacagcaccaaaacuauuaauuuacuacaaugaccaacgaccaucaggaguaccagacagauucucaggaucaaaauccggaacaucagcaucuuuagcaauaacaggacuacaagcagaagacgaagcagacuacuacugccaaucauacgauagauacacacacccagcacuucuauucggaacaggaaccaaaguaacaguacucggacaaccaaaagcagcaccauccguaacacuauucccaccaucaucagaagaacuacaagcaaacaaagcaacauuaguaugccuaauaucagacuucuacccaggagcaguaacaguagcauggaaagcagacucaucaccagucaaagcaggaguagaaacaacaacaccaucaaaacaaucaaacaauaaauacgcagcaucaucauacuuaucauuaaccccagaacaauggaaaucacacagaucuuacucaugccaaguaacacacgaaggaucaacaguagaaaaaacaguagcacccacagaaugcuca

SEQ ID NO: 45972 - RNA, 1326 nt, Artificial Sequence
  derived and/or modified sequence opt6 from Brodalumab_HeavyChain1
caaguucaacuaguacaauccggagcagaaguuaaaaaaccaggagccucagucaaagucucaugcaaagcaucaggcuauacauucacccgauacggaauaucauggguacgccaagcaccaggacaaggacucgaauggauggguuggauaucaacauacucagguaacaccaauuacgcacaaaaacuacaagguagagucacaaugacaacagauaccuccacaucaacagcauacauggaauuaagaucacucagaucagaugauacagcaguauacuacugcgcacgcagacaauuauauuucgauuauuggggucaaggaacacuaguaacugucagcuccgcuucuacaaaaggaccaucaguauucccacucgcaccaugcucacgcucaaccucagaaucaacugcagcacuaggaugcuuaguaaaagauuauuucccagaaccaguaaccguauccuggaacucaggcgcauuaacauccggaguacacacauuccccgcagucuuacaaucaucagguuuauauucucuaaguucaguaguaaccguaccaucaucaaacuuugggacacaaacauacacaugcaacguagaucacaaaccauccaauacuaaaguagacaaaacgguugaaagaaaaugcugcguagaauguccuccaugccccgcaccuccaguagcaggaccaagugucuuccuauucccaccaaaaccaaaagauacacucaugauaucaagaacaccagaagucacauguguaguaguugacguaucacacgaagacccagaaguucaauucaauugguacguugacggaguagaaguacacaacgcaaaaaccaaaccaagagaagaacaauuuaacagcaccuucagaguaguaucaguacuaacaguaguacaccaagacuggcuuaauggcaaagaauauaaaugcaaaguaucuaacaaaggauuaccagcacccauagaaaaaaccauaaguaagacaaaaggucaaccacgagaaccacaagucuacacauuaccuccaucucgagaagaaaugacaaaaaaccaaguaucauuaacauguuuaguaaaaggcuuuuacccaucagauauagcagucgaaugggaaagcaauggacaaccagaaaacaauuacaaaaccacaccaccaaugcuagacagugauggaucauucuuucuauacucaaaacuaacaguagauaaauccagauggcaacaaggaaacguauucucaugcucuguaaugcacgaagcacuacacaaccacuauacucaaaaaucacuaucacuaucaccaggaaaa

SEQ ID NO: 45973 - RNA, 642 nt, Artificial Sequence
  derived and/or modified sequence opt6 from Brodalumab_LightChain1
gaaauaguaaugacacaaucaccagcaacauuaucaguaagcccaggagaaagagcaacacuaagcugcagagcaucacaaucaguaucaucaaacuuagcaugguuccaacaaaaaccaggacaagcaccaagaccauuaauauaugacgcaucaacacgagcaacaggaguaccagcucgauucucaggaucaggaucaggaacagauuuuacauuaacaauauccucuuuacaaucagaagacuucgccguauacuacugccaacaauacgacaacuggccacuaacauucggaggcggaacaaaaguagaaauaaaaagaacaguagcagcuccuagcguauucauauucccaccaucagacgaacaauuaaaaucaggaacagcaucaguaguaugcuuacuaaauaauuucuacccacgagaagcaaaaguacaauggaaaguagacaacgcacuacaaucaggaaacucacaagaaucaguaacagaacaagacuccaaagacucaacauauucauuaucaucaacacuaacccuaucaaaagccgacuacgaaaaacacaaaguauacgcaugcgaaguaacacaccaaggauuaaguucaccaguaacaaaaucauuuaacagaggagaaugu

SEQ ID NO: 45974 - RNA, 756 nt, Artificial Sequence
  derived and/or modified sequence opt6 from Brolucizumab_HeavyChain1
auggaaauaguaaugacacaaaguccaucaacauuaagcgcaaguguaggagauagaguaauaauaacaugccaagcaagugaaauaauacacucaugguuggcaugguaucaacaaaaaccaggaaaagcgccaaaauuauuaauauauuuagcaaguacacuagcaaguggaguuccuaguagauuuaguggaucaggaucaggagcagaauuuacauuaacaauaaguaguuuacaaccagaugauuuugcuacauauuauugucaaaauguauaucuagcaaguacaaauggagcaaauuuuggucaaggaacaaaauuaacaguacuaggaggaggaggaggaaguggaggaggaggaaguggaggaggaggaaguggaggaggaggaagugaaguacaauuaguugaaaguggaggaggauuaguacaaccaggaggaaguuuaagauuaaguuguacagcaaguggauuuagucuaacggauuauuauuauaugacauggguaagacaagcaccagguaaaggauuagaauggguaggauuuauagauccggaugaugacccauauuacgcaacaugggcaaaaggacgauuuacaauaagcagagauaauagcaaaaauacacuauauuuacaaaugaauaguuuaagagcagaagacaccgcaguauauuauugugcaggaggagaucauaauaguggauggggauuagauauauggggucaaggaacauuaguaacaguaaguagu

SEQ ID NO: 45975 - RNA, 756 nt, Artificial Sequence
  derived and/or modified sequence opt6 from Brolucizumab_scFv_fragment
auggaaauaguaaugacacaaaguccaucaacucuaagugcaagcguaggagauagaguaauaauaacaugucaagcaagcgaaauaauacauucuugguuagcaugguaucaacaaaaaccaggaaaagcaccaaaauuauuaauauauuuagcaaguacauuagcgaguggaguaccaaguagauuuagugguaguggaaguggagcggaauuuacacuaacaauaagcaguuuacaaccagaugauuuugcaacauauuauugucaaaauguauaucuagcaaguacgaauggagcaaauuuuggacaaggaacaaaauuaacuguauuaggaggaggaggaggaagcggaggaggaggaucaggaggaggaggaaguggaggagggggaucagaaguacaauuaguugaaucaggaggaggauuaguacaaccgggaggaaguuuaagauuaaguuguacugcaaguggauuuucauuaacggauuauuauuauaugacauggguaagacaggcaccaggaaaaggauuagaauggguaggauuuauagauccagaugaugauccauauuaugcaacaugggcaaaaggaagauuuacaauaaguagagauaauaguaaaaauacauuauaucuacaaaugaauagccuaagagcagaagauacagcaguauauuauugugcaggaggagaucauaauagcggauggggauuagauauauggggacaaggaacacuaguaacaguaaguagu

SEQ ID NO: 45976 - RNA, 1341 nt, Artificial Sequence
  derived and/or modified sequence opt6 from Brontictuzumab_HeavyChain1
caaguccaauuaguacaaaguggagccgaaguuaaaaaaccaggugcgucaguuaaaauaaguugcaaaguaucaggcuacacacuaagaggauacuggauagaauggguccgccaagcaccaggaaaaggacuagaauggauaggacaaauccuaccaggaacuggaagaacaaacuacaacgaaaaauuuaaaggacgcguuacaaugacagcagauacaucaacagacacagccuauauggaacuuucaucacuaagaagcgaagacacugcaguauauuacugcgcuagauucgacggaaauuacggauauuaugcaauggacuauuggggccaaggaacaacuguaacuguaucaagcgccuccacaaaaggaccaucaguuuuuccauuagcaccaugcagcagaucaaccuccgaaucaacagcagcacuugguugcuuaguaaaagauuauuuuccagaaccaguaacaguauccuggaauucaggcgccuuaacaucaggaguacauacauuucccgcaguacuccaaucaucaggucuauauucacuaaguucaguugugacaguaccauccaguaacuucggaacacaaacauauaccuguaauguggaccacaaaccaagcaauaccaaaguagauaaaacaguagaaagaaaauguuguguagaauguccaccauguccagcaccacccguagcaggcccaagcguauucuuauucccacccaaacccaaagacacacuaaugaucucaagaacaccagaaguuacaugcguaguaguagauguaagucaugaagauccagaaguacaauuuaauugguauguagaugguguagaaguacacaacgcaaaaacaaaaccaagagaagaacaauuuaacucaacauuucguguagucucaguacuuacaguaguacaucaagauugguuaaacggaaaagaauacaaaugcaagguaaguaacaaaggacuaccagcaccaauagaaaaaacaauaucaaaaacaaaaggucaaccaagagaaccacaaguuuauacacuaccaccaucaagagaagaaaugaccaaaaaucaaguaucacuuacaugucuaguaaaaggauuuuacccuagcgauaucgccguagaaugggaaucaaauggacaaccagaaaauaauuacaaaacaacaccaccaaugcuagacucagacggaaguuuuuucuuauacucaaaacuaacaguugacaaauccagauggcaacaaggaaacguauucucauguaguguaaugcacgaagccuuacacaaucacuacacacaaaaaucauuaucacuaaguccaggaaaa

SEQ ID NO: 45977 - RNA, 645 nt, Artificial Sequence
  derived and/or modified sequence opt6 from Brontictuzumab_LightChain1
caagcaguaguaacacaagaaccaucacuaacaguaucaccaggaggaaccguaacacuaaccuguagaucaucaacaggagcaguaacaacaucaaacuacgcaaauugguuccaacaaaaaccaggacaagcaccaagaacacuaauaggaggaacaaauaacagagcaccaggaguaccagcaagauuuucaggaucauuacuaggaggaaaagcagcauuaacacuaucaggagcacaaccagaagacgaagcagaauauuacugcgcacuaugguacagcaaccacuggguauucggaggaggaacaaaacuaacaguacuaggacaaccaaaagcagcaccaagcguaacauuauucccaccaucaucagaagaauuacaagcaaacaaagcaacauuaguaugccucguaucagacuucuacccaggugcaguaacagucgcauggaaagcagacggcucaccaguaaaaguaggaguagaaacaacaaaaccaucaaaacaaagcaauaacaaauacgcagcaagcucauaccuaucacuaacaccagaacaauggaaaucacacagaucauacucaugcagaguaacacacgaaggaucaacaguagaaaaaacaguagcacccgcagaaugcagu

SEQ ID NO: 45978 - RNA, 1332 nt, Artificial Sequence
  derived and/or modified sequence opt6 from BTT-1023_HeavyChain1
caaguccaauuaguagaaucuggaggagguguaguacaaccaggacguucacuaagauuaucaugugcggcauccggauucaccuuuuuuucauacgcaaugcauuggguacgacaaaccccggguaaaggauuagaauggguagcaguuauaugguucgauggcaguaacgaaaacuauguagauagcguaaaaggccgauucacaauuucaagagauaauucaaaaaauacacuguauuuacaaaugaauacacuaagagcugaagacacagcaguauacuauugcgcaagagaugcauggucauacuuugauuauuggggacaaggaaccuuaguaacuguaucuuccgcaucgacaaaaggaccaucaguauuuccacuagcaccaugcucaagaucaacaucagaaucaacagcugcuuuaggaugucucguaaaagacuacuuuccagaaccaguaacaguaucauggaacucaggagcucuaacauccggaguacauacauucccagcaguacuucaaucaucuggacuauauucacuaucaucaguaguaacaguaccaucuuccucuuuaggaacaaaaacauauacaugcaauguagaccauaaaccuucuaauacaaaaguagauaaaagaguagaaucaaaauacgguccuccuugcccacccugcccagcuccugaauucgcuggagguccaucaguauuucuauuccccccaaaacccaaagacacacucaugauaucaagaacaccagaaguaacaugcguaguugucgacgucucacaagaagacccagaaguacaauucaacugguacguagacgguguagaaguacauaacgcaaaaacaaaaccacgagaagagcaauuuaauucuacuuacagaguagucaguguucuaacaguacuacaccaagauugguuaaacggaaaagaauauaaauguaaagucucaaacaaagguuuaccaucaucaauugaaaaaacaauaucaaaagcaaaaggacaaccuagggaaccacaaguauauacacuuccaccaucacaagaagaaaugacaaaaaaccaaguaucccuaacaugucuaguuaaaggauuuuauccaucagacaucgcuguagaaugggaaucaaauggacaaccagaaaauaacuauaaaaccacaccuccaguauuagauucagauggauccuucuucuuguauucacgacuaacaguugacaaaucuagauggcaagaaggaaauguauuuucauguucgguuaugcaugaagcuuuacauaaccauuauacacaaaaaucacuaucacuaucccuaggaaaa

SEQ ID NO: 45979 - RNA, 642 nt, Artificial Sequence
  derived and/or modified sequence opt6 from BTT-1023_LightChain1
guaauacaacuaacacaaucaccaucaucacuauccgcaucaguaggagaccguguaacaaucacaugcagagccucccaaggaauaucaagagcauuagcaugguaccaacaaaaaccaggaaaaggaccaaaauuacuaauauacgacgcaucaucacuagaaucaggaguaccaucaagauucucaggaucaggaucaggaacagacuuuacacuaacaauaucaucucuccaacccgaagacuucgcaacauacuacugucaacaauucaacucauacccacuaacauucggaggaggaacaaaaguagaaauaaaaagaacaguagcagcaccaucaguauucauauucccacccucagacgaacaacuaaaaucaggaaccgcaucagucguaugucuacuaaacaacuuuuacccaagagaagcaaaaguacaauggaaaguagacaacgcacuacaaucuggaaauucucaagaaucaguaacagaacaagacucaaaagacucaacauacucacuaucaucaacauuaacacuaucaaaagcagacuacgaaaaacacaaaguauacgcaugcgaaguaacacaccaaggacuauccucaccaguaacaaaaucauucaacagaggagaaugc

SEQ ID NO: 45980 - RNA, 1341 nt, Artificial Sequence
  derived and/or modified sequence opt6 from Burosumab_HeavyChain1
caagugcaacucguacaaaguggagcagaaguaaaaaaaccaggagcaucaguaaaagucucaugcaaagcuucuggauacacauucaccaaucacuacaugcacuggguaagacaagcaccaggacaaggacuugaauggauggggaucaucaacccaauaaguggauccaccucuaaugcacaaaaauuccaaggaaggguaacaaugacuagagacaccuccaccucaacaguauacauggaacuaucaucacuaagaucagaagauacugcaguauauuacugcgcaagagacauaguagacgcauucgacuucuggggccaaggaacaaugguaacaguuucuagugcaagcacaaaaggaccuucuguuuucccacuugccccauccagcaaaaguacuucaggaggaacugcagcauuaggauguuuagucaaagacuacuuuccugaaccaguaacaguauccuggaacucaggagcccuaacauccggaguacacacuuuccccgcaguacuacaaagcuccgguuuauacucccucuccuccguaguuacaguuccaucuucaucauuaggaacccaaacauauauauguaacguaaaccauaaaccaucuaacacaaaaguagauaagaaaguugaaccaaaauccugcgauaaaacucacacaugccccccgugccccgcaccagaauuacuaggcggaccaucaguauuuuuauuuccaccaaaaccaaaagauacauuaaugauaucaagaacaccagaaguaaccuguguaguaguagauguaucgcacgaagacccugaaguaaaauucaacugguacgucgacggaguagaaguacacaaugccaaaacaaaacccagagaagaacaauacaacucaacauacagaguagucagcguacuuacuguacuucaccaagacugguuaaaugguaaagaauauaaauguaaagucucaaauaaagcccuuccugcaccaauagaaaaaacuauaucuaaagcaaaaggacaaccaagagaaccacaaguauacacccuaccaccaucacgagaugaacuaaccaaaaaccaaguaucauuaacaugcuuaguaaaaggauucuaccccuccgauauagcaguugaaugggaaucuaacggacaacccgaaaacaacuacaaaacaacaccaccaguacuagacucagacggaucauucuucuuauacuccaaacuaacaguagauaaaagcagauggcaacaaggcaacguauuuaguugcucaguaaugcaugaagcacuacauaaucauuacacacaaaaaagcuuauccuuaucuccaggaaaa

SEQ ID NO: 45981 - RNA, 639 nt, Artificial Sequence
  derived and/or modified sequence opt6 from Burosumab_LightChain1
gcaauacaacuaacacaaucucccucaucacuaucagcaucaguaggagacagaguaaccauaacaugcagagccucacaaggcauaucaucagcacuaguaugguaccaacaaaaaccaggcaaagcacccaaacuacuaauauacgacgcaucaucacuagaaucaggaguuccaucaagauuuucaggauccggaucaggaacagacuucacacuaacaaucucaucauuacaaccagaagacuuugcaacauacuacugccaacaauucaacgacuacuucacauucggcccaggcacaaaaguagacauaaaacgaacagucgcagcaccaucaguauucauauucccaccaucagaugaacaacuaaaauccggaacagcauccguaguaugccuacuaaacaacuucuacccaagagaagcaaaaguacaauggaaaguagacaaugcacuacaaucaggaaauucacaagaaucaguuacagaacaagacucaaaagacucaaccuauucauuaucauccacacuaacauuauccaaagccgacuacgaaaaacacaaaguauacgccugcgaaguaacacaccaaggacuauccucaccaguaacaaaaucauucaaccgaggagaaugc

SEQ ID NO: 45982 - RNA, 1344 nt, Artificial Sequence
  derived and/or modified sequence opt6 from Canakinumab_HeavyChain1
caaguacaauuaguagaauccggaggaggcguaguacaaccaggaagaagcuuacgauuaucaugugcagcuucaggauucacauucuccguauacggaaugaacuggguaagacaagcaccagguaaaggacucgaaugggucgccauaauaugguaugauggagauaaucaauacuaugccgauucaguaaaagguagauuuaccauaagcagagacaacagcaaaaauacacuauaccuacaaaugaauggauuacgagcagaagacacagcagucuauuacugcgcaagagaucuaagaacaggaccauucgacuauuggggacaaggaacuuuaguuacaguaagcucagcauccacaaaaggucccucagucuucccacuagcaccaucauccaaaucuacaagcggaggcacugcagcacucggcugucuaguaaaagacuauuuucccgaaccaguaacaguaucauggaacagcggcgcuuuaacaucaggaguacacacauucccugccguacuacaauccucaggacuauauuccuuaucaucaguaguuacaguaccaagcucaucacuagguacacaaacauacauaugcaacguaaaucacaaaccaucaaacacaaaaguugauaaacgcguagaaccaaaaucaugugacaaaacccacacaugcccaccaugcccagcaccagaauuacuaggcggucccucaguuuucuuauuuccaccaaaacccaaagacacauuaaugauaucaagaacaccagaaguaacaugcgucguuguagauguaucacacgaagaccccgaagucaaauucaauugguacguugauggaguagaaguucauaacgcaaaaacaaaaccuagagaagaacaauacaauucaacauauagaguaguaagcguccuaacaguacuacaccaagacuggcuaaacggcaaagaauacaaaugcaaaguaaguaauaaagcuuuaccugcacccauagaaaaaacaauaucaaaagcaaaaggacaaccaagagaaccacaagucuauacccuaccaccaucacgagaagaaaugacuaaaaaucaaguuagcuuaacaugcuuaguaaaaggauucuauccaucagacauagccguagaaugggaaucaaauggccaaccagaaaauaacuauaaaacaacuccaccaguauuagacagcgacggaucuuucuuucuauauucaaaauuaacagucgauaaaucaagauggcaacaagguaacguauuuuccuguucaguaaugcacgaagcacuacacaaccauuacacgcaaaaaagccuaucacuuucaccaggcaaa

SEQ ID NO: 45983 - RNA, 1344 nt, Artificial Sequence
  derived and/or modified sequence opt6 from Canakinumab_HeavyChain
caaguacaacuaguagaaucaggaggaggagucguucaaccaggaagaucauuacguuuauccugugcagcaucuggauuuacauucucaguauauggaaugaauuggguaagacaagcaccaggcaaaggauuagaaugggucgcaauaauaugguaugauggugauaaucaauacuaugcagacucaguaaaaggacgauucaccaucucaagagauaacagcaaaaacacacucuauuuacaaaugaauggacuaagagcagaagacacagcaguauacuacugcgcacgagaucuaagaacagguccauuugacuacuggggccaaggaaccuuaguaaccgucucauccgcaucaacuaaaggacccucaguauuuccauuagcaccaucaucuaaaaguacaucagguggaacagcagcauuaggaugcuuagucaaagacuacuucccagaaccaguaacuguaucauggaauucaggagcccuuaccucaggaguacauacauucccagcaguacuccaaucaucaggauuauacucacuuucuaguguagucacaguaccaucaucaucacuaggaacacaaacuuacauaugcaacguaaaccacaaacccucuaacacuaaaguagauaaaagaguagaaccuaaaucaugcgauaaaacacacacuuguccacccugcccagcaccagaacuacucggagguccauccguauuuuuauuuccuccaaaaccuaaagacacacuuaugauaucucgaacaccagaaguuacuugcguagucguagauguaagucaugaagacccagaaguaaaauucaacugguacguagauggaguagaaguacacaacgcaaaaacaaaaccucgagaagaacaauacaacucaacauacagaguaguaagcguacuaacaguacuccaucaagacugguugaauggaaaagaauacaaaugcaaaguaaguaauaaagcacuaccagcaccaauagaaaaaacaauaucaaaagcaaaaggacaaccaagagaaccacaaguauauacauuaccaccuucaagagaagaaaugacaaaaaaccaaguaaguuuaacauguuuaguaaaagguuuuuauccaucugauauagcaguagaaugggaaucaaauggacaacccgaaaacaauuacaaaacaacaccaccaguacuagauucagacggaucauucuucuuauacucaaaacuuaccguugacaaaagcagauggcaacaaggaaacguauucaguugcucaguaaugcacgaagcacuacauaaucauuacacacaaaaaagucuaagucuaucaccaggaaaa

SEQ ID NO: 45984 - RNA, 642 nt, Artificial Sequence
  derived and/or modified sequence opt6 from Canakinumab_LightChain1
gaaauaguacuaacacaaucuccagacuuccaaucaguaacaccaaaagaaaaaguaacaauaacaugcagagccucacaauccauaggaucaucacuacacugguaccaacaaaaacccgaccaaucaccaaaauuacuaauaaaauacgccucucaaucauucucaggaguaccaucaagauucucaggaucaggaucaggaacagauuuuacccuaacaauaaacucacuagaagcagaagacgcagcagcauacuauugucaccaaucaucaucacuaccauucacauucggaccaggaaccaaaguagacauaaaacgaacaguagcagcaccauccguauucauauucccaccaucagacgaacaauuaaaaucaggaacagccucaguaguaugccuacuaaacaacuucuauccacgcgaagccaaaguacaauggaaagucgacaacgcacuacaaucaggaaauucacaagaaucaguaaccgaacaagacucaaaagacucaacauacucauuaucaucaacccuaacacuaucaaaagcagacuacgaaaaacacaaaguauacgcaugcgaaguaacacaccaaggacuaucaucaccaguaaccaaaucauucaacagaggcgaaugc

SEQ ID NO: 45985 - RNA, 642 nt, Artificial Sequence
  derived and/or modified sequence opt6 from Canakinumab_LightChain
gaaauaguacuaacccaaucaccagacuuccaaucaguaaccccaaaagaaaaaguaacaauaacaugcagagcaucacaaucaauaggcuccucccuacacugguaccaacaaaaaccagaccaaucacccaaacuacuaaucaaauacgcaucucaaucauucucaggaguaccauccagauucucaggaucaggaucuggaacagacuucacacuaacaauaaauucacuagaagcagaagacgcagcagccuacuacugccaccaaucauccucacuaccauucacauucggaccaggaacaaaaguagacaucaaaagaacaguagcagcaccaucaguauucauauucccaccauccgacgaacaacuaaaaucaggaacagcaucaguaguaugcuuacuaaacaacuucuacccaagagaagcaaaaguacaauggaaaguagauaacgcacuacaaucaggaaacucacaagaaagcguaacagaacaagacucaaaagacucaaccuauucacuaagcucaacacuaacccuaucaaaagcagauuacgaaaaacauaaaguauacgcaugcgaaguaacacaccaaggacuaucaucaccaguaacaaaauccuucaacagaggcgaaugc

SEQ ID NO: 45986 - RNA, 1182 nt, Artificial Sequence
  derived and/or modified sequence opt6 from Canakinumab_LightChain_variant_8836_L
caaguacaguuagucgaaucaggcggcggaguaguacaaccagguagaaguuuacgacucucaugcgcagcaucaggcuucacuuucaguguauacgguaugaauuggguaagacaagcaccaggcaaaggauuagaauggguugcuauaauaugguaugacggcgacaaucaauauuacgcagacucaguaaaaggaagauucacaauuucuagagauaauucaaaaaacacccuauaccuacaaaugaacggauuaagagcagaagauacagccguauauuauugcgcaagagaucucagaaccggaccauuugacuauuggggacaaggaacacuagucacaguaucaucagcaagcacaaaaggaccaucaguauuuccacuagcaccaaguucaaaaucaacaucaggaggaacagccgcuuuaggaugccuaguaaaagauuacuuuccagaaccaguaaccguuucauggaacucuggagcacuuacaucaggaguucauacauuuccugcuguauuacaaucaaguggauuagaaaucguucuaacacaaucaccagacuuccaaagcguaacaccaaaagaaaaaguaacaauuacuuguagagcaagucaaagcauaggaucauccuuacacugguaucaacaaaaaccagaucaaucaccuaaauuauuaauaaaauaugcaagucaaucauuuagcggagucccaagcagauuuuccggauccggaagcggcacagacuuuacauuaacaauaaauucccuugaagcagaagaugcagcagcauacuauugucaucaaucaagcucauuaccauucacuuucggaccaggaacaaaagucgauauaaaaagaacaguagcagccccaagcguauuuauauucccaccaucagacgaacaacuaaaaucuggaacagcaucaguaguaugccuucuaaauaacuucuacccacgagaagccaaaguacaauggaaaguagacaacgcccuccaaucaggaaacucacaagaaucaguaacagaacaagauagcaaagacucaacauauucacuaucaucaacauuaacacuaagcaaagcagauuacgaaaaacauaaaguauaugcaugcgaaguaacacaucaaggccuaucaucaccaguaacaaaaucauuuaacagaggagaaugc

SEQ ID NO: 45987 - RNA, 1197 nt, Artificial Sequence
  derived and/or modified sequence opt6 from Cantuzumab_HeavyChain1
auagauacaacaacaggagaaccaacuuacgcucaaaaauuccaaggaagaaucgcauucucacuagaaacaucagcuucaacagccuaccuacaaauuaaaucuuuaaaaucagaagacacagcaacauacuucugcgcaagaagaggaccauacaacugguacuucgauguauggggacaaggaacaacuguaacaguauccucagcuucaaccaaaggaccaucaguauucccacuagcaccaucaucaaaaucaaccucaggaggaacagcagcauuaggauguuuagucaaagacuacuucccggaaccaguaaccguaucauggaauucaggagcauuaacaucaggaguccacacauuuccagcaguacuucaaucaucaggacuauacucacuuucaucaguaguaacaguaccaucaucaucacuaggcacccaaacauacauaugcaacguuaaccacaaaccaucuaacacuaaaguagacaaaaaaguagaaccuaaaucaugcgacaaaacacauaccugcccuccaugcccagcacccgaauuacuagguggacccaguguauuucuauucccaccuaaaccaaaagacacauuaaugauaucaagaacuccagaagucaccugcguaguagucgauguaucacacgaagacccugaaguaaaauucaacugguaugucgacggcguugaaguacauaaugcaaaaacaaaaccucgagaagaacaauacaacagcacauaucgaguaguaucaguccuaaccguauuacaccaagauuggcuaaacggcaaagaauacaaaugcaaaguaucaaacaaagcacuaccagcaccaaucgaaaaaaccauaucaaaagcaaaaggacaaccaagagaaccacaaguauacacucuaccaccaucuagagaugaauuaacaaaaaaccaaguaucccuaacaugcuuagucaaaggauucuacccaucagacauagcaguagaaugggaaucaaacggacaaccagaaaauaacuacaaaacaacaccaccaguauuagauucagacggaucauucuuccuauacuccaaacuaacaguugauaaaucacguuggcaacaagguaacguuuucucaugcucaguaaugcacgaagcauuacauaaccacuacacacaaaaaucccuaucacucucaccaggaaaa

SEQ ID NO: 45988 - RNA, 1347 nt, Artificial Sequence
  derived and/or modified sequence opt6 from Cantuzumab_HeavyChain
caaguucaauuaguacaauccggugcagaaguuaaaaaaccuggagaaacaguaaaaauauccugcaaagcaucagacuacacauucacauacuacggaaugaacuggguaaaacaagcaccuggccaaggacuuaaauggauggguuggauagacacaacaaccggugaaccaacauaugcacaaaaauuccaagguagaauagcauucucuuuagaaacaucagcaucaaccgcauaucuacaaauaaaaucauuaaaaucagaagacacagcaacauauuucugcgccagacgagguccauacaacugguacuuugacguauggggacaagguacaacaguaacagucuccucagccucaacaaaaggaccaucuguauucccauuagcaccaucaucaaaaucaacauccgguggcacagcagccuuaggcugccuagucaaagacuacuucccagaaccaguaacaguaucauggaauucaggagcacucacaucaggaguacacacauucccagcuguacuacaaucaucaggauuauacucccucuccaguguaguaacaguaccauccucauccuuaggaacacaaacuuacaucugcaacguaaaccacaaaccaagcaacaccaaaguagacaaaaaaguagaaccaaaaucaugugacaaaacacauacaugcccaccaugccccgccccagaacuacuaggaggaccaucuguauuucuauucccaccaaaaccaaaagacacauuaaugauaucuagaacaccugaaguaaccugcguagucguagacguuucacacgaagauccagaaguaaaauucaauugguacguagacggaguugaaguccacaacgcaaaaacuaaaccaagagaagaacaauacaacucaacauacagaguaguuucaguacuaaccguucuacaucaagacuggcuaaacggaaaagaauauaaaugcaaaguuucuaauaaagcauuaccagcaccaauugaaaaaacaauaagcaaagcaaaaggacaaccaagagaaccacaaguauacacauuaccuccaucaagagacgaacuaacaaaaaaccaagucucacuuacuugcuugguaaaaggauuuuauccaucagacaucgccgucgaaugggaaucgaacggacaacccgaaaacaacuauaaaaccacaccacccguucuagacuccgauggaucauuuuuccucuauucaaaacuaaccgucgacaaauccagauggcaacaagguaauguauuuucaugcucaguaaugcacgaagcauuacauaaccauuacacucaaaaaucauuaucacucucaccaggaaaa

SEQ ID NO: 45989 - RNA, 657 nt, Artificial Sequence
  derived and/or modified sequence opt6 from Cantuzumab_LightChain1
gacauaguaaugacacaaucuccacuaucagucccaguaacaccaggagaaccaguaucaauaucauguagauccucaaaaucacuacuacacucaaacggaaauaccuaccuauacugguuucuacaaagacccggacaaucaccacaacuacuaauauacagaaugucuaacuuaguaucaggaguaccagacagauucucaggauccggaucaggaaccgccuucacauuaagaauaucaagagucgaagcagaagacguaggcguauacuacugccuacaacauuuagaauacccauucacauucggaccaggaacaaaacuagaacuaaaacgaacaguagcagcacccuccguauucauauuuccaccaucagacgaacaacucaaaucaggcacagcaucaguaguaugcuuacuaaacaacuucuacccaagagaagccaaaguacaauggaaaguagacaacgcauuacaaucaggaaacucacaagaauccguaacagaacaagacucaaaagauucaacauacucacuauccuccacacuaacauuaucaaaagcagacuaugaaaaacauaaaguauacgcaugcgaaguuacacaccaaggacuaucaucaccaguaacaaaaucauucaacagaggagaaugc

SEQ ID NO: 45990 - RNA, 1344 nt, Artificial Sequence
  derived and/or modified sequence opt6 from Cantuzumab_mertansine_HeavyChain1
guccaauuaguccaaucaggcgcugaaguaaaaaaaccaggugaaacaguaaaaauaucauguaaagcaucagauuauaccuuuacauacuauggcaugaauuggguuaaacaagcacccggacaaggauuaaaauggaugggauggauagauaccaccacaggagaaccaacauacgcccaaaaauuccaaggaagaauagcauucucacuagaaacuucagcaucuacagcauacuuacaaaucaaaucuuuaaaaucugaagauacagcaacauacuucugcgcaagaagaggaccauacaacugguacuucgacgucuggggacaaggaacaacaguaacaguaucaucagcauccacaaaagguccuucaguuuucccucuagcaccauccucaaaaucaacaaguggaggcacagcagcauuaggcugccuuguuaaagacuauuuuccagaaccaguuaccguaucauggaauucaggagcccuaacaucugguguacauacauuuccagcaguacuacaaucaucaggcuuauacagccuauccucaguaguaacaguacccaguucaucauuagguacacaaacauacauaugcaacguaaaccacaaaccuucaaacacaaaagucgauaaaaaagucgaaccuaaaucaugcgacaaaacacauacaugcccuccaugcccagcaccugaacuacuaggaggccccucaguauuccuauuucccccaaaaccaaaagacacauuaaugauaucccgaacccccgaaguuacaugcgucguaguagacguaucacaugaagacccagaaguaaaauuuaacugguacgucgauggaguugaaguacauaacgcuaaaacaaaacccagagaagaacaauacaauucaacuuaccgaguaguaaguguccuaacaguacuacaccaagacugguuaaacggaaaagaauacaaaugcaaaguaucuaacaaagcacuuccagccccuauagaaaaaacaauaucuaaagccaaaggacaaccacgagaaccacaaguauacacccuacccccuucuagagaugaauuaacaaaaaaccaagucucucucacaugucuaguaaaaggauuuuacccaagugauauagcaguagaaugggaaucuaacggacaaccagaaaacaacuauaaaacaacaccaccaguacuagauucugacggauccuuuuuccucuauucaaaauuaacuguagauaaaucaagauggcaacaaggaaacguauuuucuugcucaguaaugcacgaagcuuuacacaaccacuacacacaaaaaucauuauccuuaucacccggaaaa

SEQ ID NO: 45991 - RNA, 657 nt, Artificial Sequence
  derived and/or modified sequence opt6 from Cantuzumab_mertansine_LightChain1
gacauagucaugacccaaucaccucuaucaguaccaguuacaccaggagaaccaguaucaauaucaugcagaucaucaaaauccuuauuacauucaaacggaaacacauaccuauacugguuccuacaaagaccaggacaaucaccacaacuacuaauauacagaaugucaaaccuaguaucaggaguaccagacagauucuccggaucaggaucaggaacagcauucacucuaagaauaucaagaguagaagcagaagacguaggcguauacuacugccuacaacaccuagaauacccauuuacauucggaccaggaacaaaauuagaacuaaaacgaacaguagcagcaccauccguauucauauucccaccaucagacgaacaauuaaaaucaggaacagcaucaguaguaugccuacuaaacaacuucuacccaagagaagcaaaaguacaauggaaaguagacaacgcauuacaauccggaaacucacaagaaucaguaacagaacaagacucaaaagacuccacauacucauuauccucaacauuaacacuaucaaaagcagacuacgaaaaacacaaaguauacgcaugcgaaguaacacaccaaggacuauccucacccguaacaaaaucauucaacagaggcgaaugc

SEQ ID NO: 45992 - RNA, 1347 nt, Artificial Sequence
  derived and/or modified sequence opt6 from Cantuzumab_ravtansine_HeavyChain1
caaguacaauuaguccaaagcggagcagagguaaaaaaaccaggcgaaacuguaaaaaucucauguaaagcaucggacuauacuuuuacauacuauggaaugaacuggguaaaacaagcaccuggacaaggauuaaaauggaugggauggaucgauacuaccacaggagaaccaaccuacgcacaaaaauuucaaggaagaaucgcauucucacucgaaacuucagcaucaaccgcauauuuacaaauaaaaucauuaaaauccgaagacacagccacauacuuuugcgcacgaagaggaccauacaauugguacuucgacguauggggacaaggaacaacaguaacaguaucauccgcauccacaaaaggacccucaguauucccucuugcaccaagcuccaaaucaacaucagguggaacggccgccuuaggaugccuaguaaaagauuauuuuccugaacccguaacagucagcuggaacucaggagcacuaacaucaggaguacacacauucccagcaguccuucaaucaucaggccuauauucccuaucaucaguagucaccguacccucaucuucauuagguacccaaacauauauauguaaugucaaucacaaaccaucaaacacaaaaguagacaaaaaaguagaaccaaaaucaugcgacaaaacacacacaugcccaccuugcccagcaccagaauuauuaggaggccccucaguauucuuauuccccccaaaaccaaaagauacauuaaugaucucaagaacacccgaaguaacaugcguaguaguagacguaucacaugaagacccugaaguaaaauucaacugguacgucgaugguguagaaguucacaacgcaaaaacaaaaccaagagaagaacaauacaauucaacauaccgaguuguauccguacucaccguacuucaccaagauugguuaaacggaaaagaauacaaaugcaaaguaucaaacaaagcacuaccagcgccaauagaaaaaacaauaucaaaagcaaaaggacaaccaagagaaccacaagucuacacacuacccccaucaagagacgaacuaacaaaaaaucaaguuucacucacuugccuaguaaaaggauucuacccaucagacaucgcagucgaaugggaauccaacggacagccugaaaacaacuacaaaacaacacccccaguucuagacagugauggaucauucuuucuauacucaaaacucacaguagauaaaucaagauggcaacaaggcaauguauucucaugcuccgucaugcaugaagccuuacauaaccacuauacacaaaaaucacuaucacuaucaccaggaaaa

SEQ ID NO: 45993 - RNA, 657 nt, Artificial Sequence
  derived and/or modified sequence opt6 from Cantuzumab_ravtansine_LightChain1
gacauaguaaugacacaaucaccacuaucaguaccaguaacaccaggagaacccguaucaauaucauguagaucaucaaaaucacuacuacacucaaacggaaacacuuaccucuacugguuccuacaaagaccaggacaaucaccccaacuacuaauauacagaaugucaaaccuaguaucaggaguaccagacagauuuucaggaucaggaucaggaacagccuucacauuaagaauaucacgaguagaagcagaagacguaggaguauacuacugccuacaacaccuagaauacccauucacauucggaccaggaacaaaacuagaacuaaaacgaacagucgcagcaccaucaguauuuauauucccaccaucagacgaacaauuaaaaucaggaacagcauccguaguaugccuacucaacaacuucuacccaagagaagcaaaaguacaauggaaaguagacaacgcacuccaaucaggaaacagucaagaaucaguaacagaacaagacucaaaagacucaacauacucacucucaucaacacuaacacuaucaaaagcagacuacgaaaaacacaaaguauaugcaugcgaaguaacacaccaaggacuaucaucacccguaacaaaaucauucaacagaggagaaugc

SEQ ID NO: 45994 - RNA, 777 nt, Artificial Sequence
  derived and/or modified sequence opt6 from Caplacizumab
gaagugcaauuaguagaaaguggaggaggauuaguacaaccaggaggaagucuaagauuaucaugugcagcaaguggaagaacauuuaguuauaauccgaugggaugguuuagacaagcaccagguaaagggagagaacugguagcagcaauuagcagaacaggaggaucaacauauuauccagauaguguagaaggaagauuuacaauaucaagagauaaugccaaaagaaugguauauuuacaaaugaauagcuuaagagcggaagauacagcaguauauuauugugcagcagcaggaguaagagcagaggauggaagaguacgaacauuaccgucagaauauacauuuuggggucaaggaacacaaguaacaguaaguagcgcagcagcagaagugcaauuaguagaaaguggcggaggauuagugcaaccaggaggaagccuaagguuaaguugugcagcaaguggaagaacauuuaguuauaauccaauggggugguuuagacaagcaccaggaaaaggaagagaauuaguagcagcaauaaguagaacaggagggaguacauacuauccagauaguguagaaggaagauuuacaauuaguagagauaacgcaaaaagaaugguauauuuacagaugaauagccuaagagcggaagauacagcaguauauuauugugcagcagcaggaguaagagcagaagauggaagaguaagaacauugccaagugaauauacauucuggggacaaggaacacaaguaacagugucaagu

SEQ ID NO: 45995 - RNA, 777 nt, Artificial Sequence
  derived and/or modified sequence opt6 from Caplacizumab_HeavyChain1
gaaguacaauuaguagaaaguggaggaggauuaguacaaccaggaggaagcuuaagauuaaguugugcagcaagugguagaacauuuagcuauaauccaaugggaugguuuagacaagcaccaggaaagggaagagaauuaguagcagcgauaaguagaacaggagggaguacauauuauccagauagcguagaaggaagauuuacaauaaguagagauaaugcaaaaaggaugguauaucuacaaaugaauaguuuaagagcagaagauacagcgguauauuauugugcagcagcagguguaagagcagaagauggaagaguaagaacauuaccaucggaauauacauuuuggggacaaggaacacaaguuacaguaagcagugcagcagcagaaguacaacuaguagaaaguggaggaggauuaguacagccaggaggaaguuuaagauuaagcugugcagcaaguggaagaacauuuaguuauaauccaaugggaugguuucgacaagcaccaggaaaaggaagagaacuaguagcagcaauaaguagaacaggaggaaguacauauuauccugacagcguagaaggaagguuuacaauaaguagagauaacgcaaaaagaaugguauauuuacaaaugaauagcuuaagagcagaggauacggcaguauauuacugugcagcagcgggagugagagcagaagauggaagaguaagaacauuaccuagugaauauacauuuuggggacagggaacacaaguaacaguaagcagu

SEQ ID NO: 45996 - RNA, 777 nt, Artificial Sequence
  derived and/or modified sequence opt6 from Caplacizumab_HeavyChain1
gaaguacaauuaguagaaucaggaggaggauuaguacaaccuggaggaagucuaagacuaaguugcgcagcaucaggaagaacauuuaguuauaauccaaugggaugguuuagacaagcaccaggaaaagggagagaauuaguagcagcaauaagcagaacuggaggaaguacguauuauccagauaguguagaaggaagguuuacuauaaguagagauaaugcgaaaagaaugguauaucugcaaaugaauaguuuaagagcagaagauacagcaguguauuauugugcggcagcaggaguaagagcagaagaugguagaguaagaacauuaccaagugaauauacauucuggggacaaggaacgcagguaacaguaaguucagcagcugcagaaguacaacuaguagaaagcggagguggauuaguacaaccaggaggaaguuuaagauuaucaugugcggcaaguggaaggacauuuaguuauaacccaaugggaugguuuagacaagcaccgggaaaaggaagagaacuaguugcggcaauaaguagaacaggaggaaguacauauuauccagauagcguagaaggaagauuuacaauaaguagggauaaugcaaagagaaugguauauuuacaaaugaauaguuuaagagcagaagauacagcaguauauuauugugcagcagcaggaguaagagcagaagauggaagaguaagaacguuaccaagugaauauacauucuggggacaaggaacacaaguaacaguaagcagu

SEQ ID NO: 45997 - RNA, 1347 nt, Artificial Sequence
  derived and/or modified sequence opt6 from Carlumab_HeavyChain1
caaguacaauuaguacaaucaggagccgaaguaaaaaaaccuggaucaagcguaaaaguauccuguaaagccucaggaggaacuuucaguucauauggaauaucauggguaagacaagcaccaggucaaggccuagaauggaugggaggaauaauaccaauuuucggaacagcuaacuacgcacaaaaauuccaaggaagaguaacuaucacagcagacgagucaaccagcacagcauacauggaauuaaguagccuccgcuccgaagauacagccguuuauuacugugcacgauaugacggcauauacggagaacuagauuuuuggggacaaggaacauuagucacugucucaucagcaucaacuaaaggacccucuguauucccauuagcaccaucauccaaaucaacaucagggggaacagcagcccuaggaugucuaguaaaagauuacuucccagaaccaguaacaguuucauggaauuccggcgcauuaacaucaggaguccacacauucccugcaguauuacaaucuucagguuuauacucauuaucaucaguagucacuguacccucaucaucauuagguacccaaaccuacauaugcaacguuaaucacaaaccaucaaauacaaaaguagauaaaaaaguagaaccaaaaucaugugacaaaacccacacaugcccaccaugcccagcacccgaacuacuagguggaccaucaguuuuccuuuucccacccaaaccaaaagacacauuaaugauauccagaacaccagaagucaccugcguaguaguugauguaucacaugaagauccagaaguaaaauucaacugguacguagacggagucgaaguccacaacgcaaaaacaaaaccacgcgaagaacaauacaauuccacauaucgaguaguaucaguacuaaccguauuacaccaagauugguuaaauggaaaagaauacaaaugcaaaguaucuaacaaagcacuaccagcaccaauugaaaaaacaauauccaaagcaaaaggacaaccaagagaaccacaagucuacacccuaccaccuucacgcgaugaacuaacaaaaaaccaaguaucacuaacuugcuuaguaaaaggauucuacccaucugacauagcagucgaaugggaauccaacggucaaccugaaaacaacuacaaaacaacaccaccuguccuagacucagauggcucauucuuuuuauacucaaaacuaacaguagauaaaucaagauggcaacaaggcaauguauucucaugcuccguaaugcacgaagcucuacacaaccacuacacacaaaaaucacuaucacuaucaccaggaaaa

SEQ ID NO: 45998 - RNA, 648 nt, Artificial Sequence
  derived and/or modified sequence opt6 from Carlumab_LightChain1
gaaaucguucuaacacaaucaccagcaacauuaagccuaagcccaggagaacgagcaacauuaagcuguagagcaucccaaucaguaucagaugcauaucucgcaugguaccaacaaaaaccaggacaagcaccaagauuacuaauauacgaugcaucaagcagagccacaggaguaccagcaagauuuagcggaagcggaucaggaacagauuucacacuaacaauaucaagcuuagaaccagaagauuucgcaguauauuacugucaccaauacauacaauuacacucauucacauucggacaaggaacaaaaguagaaauaaaacgaacaguagcagcacccagcguauucauauucccuccaucagacgaacaauuaaaaucaggaacagcaucaguaguaugcuuacucaauaacuuuuacccaagagaagcaaaaguacaauggaaagucgacaacgcauuacaaagcggaaacucacaagaaucaguuacagaacaagauagcaaagacucaacuuauagucuaagcucuacauuaacacuaagcaaagcagauuacgaaaaacauaaaguauacgcaugcgaaguaacacaccaaggcuuaucaucacccguaacaaaaagcuuuaauagaggagaaugc

SEQ ID NO: 45999 - RNA, 1353 nt, Artificial Sequence
  derived and/or modified sequence opt6 from Cergutuzumab_amunaleukin_HeavyChain1
caaguucaauuaguacaaucaggagcagaaguaaaaaaaccaggagcaucaguaaaaguaucauguaaagcauccgguuacacauuuacagaauucgguaugaacuggguacgacaagcccccggacaaggauuagaauggaugggauggauaaauacuaaaacaggagaagcaaccuauguagaagaauucaaaggucgaguaacauuuacaacagacacaagcacaucaacugcauauauggaacuaagaucuuuaagaucagacgauacagcuguauauuacugugcccguugggauuucgcauacuauguagaagcaauggauuauuggggacaagguacaacaguaacaguaucaucagcaaguacaaaaggaccuucaguauuuccauuagcaccaucaucuaaaucaacaucaggugguacagccgcauuaggaugucuagucaaagauuauuucccagaacccguuacagucagcuggaacucaggagcacuaaccuccggcguacauacauucccagcuguacuacaaucaucuggacuauauagcuuaucaucuguugucacagucccaucaucuucuuuagguacacaaacauacaucuguaacguaaaucauaaaccaaguaauacaaaaguagacaaaaaaguagaaccaaaaaguugugauaaaacacauaccugcccaccaugcccugcaccugaagcugccgguggaccaagcguuuuccuauucccuccaaaaccaaaagauacucuaaugauaucaagaacuccagaaguaacaugcgucguuguagauguaucacaugaagauccagaagucaaauuuaauugguauguugauggaguagaaguacacaaugcaaaaacuaaaccaagagaagaacaauauaacuccacauaccguguagucucaguauuaacaguauuacaccaagauuggcuaaacggaaaagaauacaaaugcaaaguauccaacaaagcacuaggagcacccauagaaaaaacuauuaguaaagcaaaaggacaacccagagaaccccaagucuguacucucccaccaucacgagaugaacuaaccaaaaaccaagucucucuaucaugcgcaguaaaaggauuuuacccauccgauauagccguugaaugggaaucaaauggccaaccagaaaacaauuauaaaacaacuccccccguauuagauucugacggaucauucuuuuuaguauccaaauuaacuguugacaaaucaagauggcaacaagguaauguauucucuugcucaguuaugcaugaagcucuacauaaucacuauacacaaaaauccuuaucacuaucuccaggaaaa

SEQ ID NO: 46000 - RNA, 1794 nt, Artificial Sequence
  derived and/or modified sequence opt6 from Cergutuzumab_amunaleukin_HeavyChain2
caaguacaacuaguacaaucaggagccgaagucaaaaaaccuggagcaucaguaaaagucucaugcaaagcaagcggauacacauucacugaauucggaaugaacuggguaaggcaagcaccaggacaagguuuagaauggaugggauggauaaauacgaaaacuggcgaagcaacauauguagaagaauuuaaaggcagaguaacauuuacaacugauacgucaacaaguaccgcauauauggaauuaagaagucuacguucagaugacaccgccguuuacuauugugcaagaugggauuucgcauacuauguugaagccauggauuauuggggacagggaacaacgguaacgguaagcucagcaucaacaaaaggaccaaguguauucccauuagccccaucaucaaaaucaaccucaggaggaacagcugcuuuaggauguuuaguuaaagacuacuucccagaaccaguaacaguaucauggaacaguggugcauuaacaaguggaguacauacuuucccagccguguuacaaucaagcggacuauauucacuaaguucggucguaacaguaccaaguucaaguuuggguacacaaacauauauauguaauguuaaccauaaacccucaaacacuaaaguugauaaaaaaguagaaccgaaaucaugugacaaaacacauacauguccaccaugucccgcacccgaagcagcuggaggcccaagcguuuuccuauuuccacccaaacccaaagauacacuaaugaucaguagaacaccggaaguaacaugcguaguaguagauguaagccacgaagauccagaaguaaaauuuaauugguacguugauggcgucgaaguccauaacgcaaaaacaaaaccaagagaagaacaguauaauaguacauauagaguaguaucuguauuaacaguccuacaucaagauuggcuaaacggaaaagaauacaaauguaaagucucaaauaaagcauuaggagcaccaauagaaaaaacuauuucaaaagccaaaggacaacccagggaaccacaaguauauacccuaccacccugucgugaugaauuaaccaaaaaccaaguaagccuauggugccuagucaaaggguuuuauccaucugauauagcuguggaaugggaaagcaauggacaaccagaaaacaauuauaaaacaacaccaccuguauuagauucagacgguaguuucuuccuuuacucaaaacuuacaguagauaaaucaagguggcaacaaggaaacguuuucucauguucaguaaugcaugaagcacuucauaaccauuauacacaaaaaucacuaagccuaucaccagggggagguggugguucagguggcggcggaucaggagguggaggaucagcaccagcuaguucaaguacaaaaaaaacacaauuacaauuagaacaccuacuacuagaucuccaaaugauacuaaacggaauaaauaauuauaaaaacccaaaauuaacaagaaugcuaacugcuaaauucgcaaugccaaaaaaagcaaccgaauuaaaacaucuccaaugccuggaagaagaacuaaaaccuuuagaagaaguccuaaauggcgcacaauccaaaaacuuccaucuaagaccacgagaucucauuaguaacauaaacguaauagugcuagaacuaaaagguagugaaaccacauucaugugcgaauaugccgaugaaaccgcaacaauuguagaauuucucaaccguuggauaacauucgcucaaucaauaauauccacguuaaca

SEQ ID NO: 46001 - RNA, 645 nt, Artificial Sequence
  derived and/or modified sequence opt6 from Cergutuzumab_amunaleukin_LightChain1
gacauacaaaugacacaauccccaucaucacuaucagcaucagucggagacagaguaacaauaacaugcaaagcaucagccgcaguaggaacauacguagcaugguaucaacaaaaaccaggaaaagccccaaaacuacuuauauauucagcaucauacagaaaaagaggaguaccauccagauucucaggauccggaucaggaacagacuuuacacuaacaauaucaucccuacaaccagaagauuuugcaaccuacuacugccaccaauauuacacauacccauuauucacauucggacaaggaacaaaacuagaaauaaaaagaacaguagccgccccaucaguauucauauucccaccaucagacgaacaauuaaaaucaggaacagcaucagucguaugccuacuaaacaacuuuuacccaagagaagcaaaaguccaauggaaaguagacaacgcacuacaauccggaaacucacaagaaucaguaacagaacaagacucaaaagacucaacauacucauuaucaucaacacuaacacuaucaaaagcugacuaugaaaaacacaaaguauacgcaugcgaaguaacacaccaaggcuuaucaucaccaguaaccaaauccuucaacagaggcgaaugc

SEQ ID NO: 46002 - RNA, 687 nt, Artificial Sequence
  derived and/or modified sequence opt6 from Certolizumab_pegol_HeavyChain1
gaaguacaauuaguagaaucaggaggaggauuaguacaaccaggaggaucuuuaagauuaagcugugcagcaucaggauacguuuuuacagauuacggcaugaauuggguaagacaagcaccaggaaaaggacucgaauggaugggauggauaaacacauauauaggagaaccuauauaugcagauucaguaaaaggaagauucacauuuagucuagacacaucaaaaaguacagcuuaucuacaaaugaacucauuacgagcagaagauacagcaguauauuacugcgcaagaggauauagaucauaugcaauggauuauuggggacaaggaacauuaguuacaguaucaagugcaucuacaaaaggaccaaguguauuuccacuagcaccaucaucaaaaucaacaucaggaggaacagcagcauuaggaugucuaguaaaagacuauuuuccagaaccaguaacaguaucauggaauucaggagcauuaacaucaggaguacauacauuuccagcaguauuacaaaguucaggauuauauucauuaaguucaguaguaacaguaccuucaucaucacuaggaacacaaacauauauauguaauguaaaccauaaaccaucaaauacaaaaguagauaaaaaaguugaaccaaaaucaugugauaaaacacauacaugugcagca

SEQ ID NO: 46003 - RNA, 687 nt, Artificial Sequence
  derived and/or modified sequence opt6 from Certolizumab_pegol_HeavyChain
gaaguacaauuaguagaaagcggaggaggacuaguacaaccaggaggaagcuuaagauuaaguugugcagcaagcggauauguauuuacagauuauggaaugaauuggguaagacaagcucccggaaaaggacuagaauggaugggauggauaaauacauauauaggagaaccaauauaugcugauaguguaaaaggacgauuuacauuuaguuuagauacaucaaaaagcacagcauauuuacaaaugaauaguuuaagagcagaagauacagcaguauauuacugugcaagaggauauagaucauaugcaauggauuauuggggucaagguacauuaguaacaguaaguucagcaucaacaaaaggaccaaguguauuuccauuagcuccaucaucaaaaaguacaaguggaggaacagcagcauuaggauguuuaguaaaagauuauuuuccagaaccaguuacaguaucauggaacaguggagcauuaacuucaggaguacauacauuuccagcaguauuacaaagcucaggauuauauaguuuaaguaguguaguaacaguaccaaguucaucauuaggaacacaaacauauauauguaauguaaaucauaaaccaaguaauacaaaaguagauaaaaaaguagaaccaaaaucaugugauaaaacacauacaugugcagca

SEQ ID NO: 46004 - RNA, 642 nt, Artificial Sequence
  derived and/or modified sequence opt6 from Certolizumab_pegol_LightChain1
gacauacaaaugacacaaucaccaucaagccuaagcgcaagcguaggagacagaguaacaauaacaugcaaagcaagccaaaauguaggaacaaacguagcaugguaccaacaaaaaccaggaaaagcaccaaaagcacuaauauacagcgcaagcuuccuauacagcggaguaccauacagauucucaggcucaggaucaggaacagacuucacccuaacaauaucaucauuacaaccagaagacuuugcaacauacuauugccaacaauacaacauauacccauuaacauucggacaaggaacaaaaguugaaauaaaaagaacaguagcagcaccaucaguuuucauauucccacccucagacgaacaacuaaaaucaggaacagccucaguaguaugcuuacuaaacaacuucuacccaagagaagcaaaaguacaauggaaaguagauaacgcacuacaaagcggaaacucacaagaaagcguaacagaacaagacucaaaagacucaaccuacagcuuaagcucuacacuaacacuaagcaaagcagacuacgaaaaacacaaaguauacgcaugcgaaguaacacaccaaggauuaagcucaccaguaacaaaaagcuucaacagaggugaaugc

SEQ ID NO: 46005 - RNA, 642 nt, Artificial Sequence
  derived and/or modified sequence opt6 from Certolizumab_pegol_LightChain
gacauacaaaugacacaaucaccaucaucacuaucagcaucaguaggagaucgaguaacaauaacaugcaaagcaucacaaaacguaggaacaaacguagcaugguaccaacaaaaaccaggaaaagcaccaaaagcacuaauauacucagcauccuuccuauacucaggagucccauacagauucucaggaucaggaucaggaacagacuucacacucacaaucuccucacuacaaccagaagacuuugcaacauacuauugccaacaauacaauauauacccacuaacauucggacaaggaacaaaaguagaaauaaaaagaaccguagcagcaccaucaguauucauauucccaccuucugacgaacaacuaaaaucaggaacagcaucaguaguaugccuacuaaacaacuucuacccaagagaagcaaaaguccaauggaaaguagacaacgcacuacaaucaggaaacucacaagaaagcguaacagaacaagacagcaaagacucaacauacagcuuaucaucaacccuaacacuaucaaaagcagacuacgaaaaacacaaaguauacgcaugcgaaguaacacaccaaggccuauccucaccaguaacaaaaucuuucaacagaggagaaugu

SEQ ID NO: 46006 - RNA, 1356 nt, Artificial Sequence
  derived and/or modified sequence opt6 from Cetuximab_HeavyChain
caaguacaacuaaaacaaucaggccccggacuuguacaaccaucccaaucauuaucaauaacuuguacaguuucaggcuuuucauuaacaaacuacggaguacacuggguccgacaaucaccagguaaaggacucgaaugguuaggaguaauauggucuggcggaaauacagacuauaauacaccauucacaucccgauuauccauaaauaaagacaacuccaaaucccaaguauucuuuaaaaugaacucauuacaaucaaacgacacagcaauauacuauugugcaagagcccuaacauacuaugacuacgaguuugcauauuggggacaagguacauuaguaacaguaucagcagcaucaacaaaaggaccauccgucuuuccauuagcaccaucaucaaaaagcacauccggaggaacagcagccuuaggauguuuaguaaaagacuauuucccagaaccaguaacagucucauggaauuccggagcacuaacaucaggaguccauaccuuuccagcaguacuacaaucaucaggauuauacucacuaucaucaguagucacgguaccaucaucaucucuaggaacacaaacauauauaugcaauguaaaucacaaacccucaaauacaaaaguagauaaaagaguagaaccuaaaucaccuaaaucaugcgauaaaacacauaccugcccccccuguccagcacccgaacuacucggcggaccauccguuuucuuauucccaccuaaaccaaaagacacccucaugauaucaagaacaccagaagucacaugcgucguagucgacguuucacaugaagaccccgaagucaaauucaacugguacguagacggaguagaaguacacaaugccaaaaccaaaccaagagaagaacaauacaacucaacauacagaguaguuucuguucuaacaguucuccaucaagacuggcuaaacggcaaagaauacaaauguaaagucucaaauaaagcucuaccagcuccaauagaaaaaacaauaucuaaagcaaaaggccaacccagagaaccucaaguauauaccuuaccacccucaagagaugaacuaacaaaaaaucaaguaucacuaacaugcuuaguaaaaggauucuacccaucagacauagcaguagaaugggaaucaaacggacaaccagaaaauaacuacaaaacaacaccacccgucuuagauucagacggcucauucuuccuauauagcaaacuaacagucgauaaaucccgcuggcaacaagguaauguauuuuccugcucuguaaugcacgaagcccuacacaaccacuauacacaaaaaucacuaucacuaucaccuggaaaa

SEQ ID NO: 46007 - RNA, 1347 nt, Artificial Sequence
  derived and/or modified sequence opt6 from Cetuximab_HeavyChain_variant
caaguacaacuaaaacaauccggcccaggacuaguucaaccuucacaaucauuaucaauaacaugcacagucucuggauucucacuaacaaacuacggaguacacuggguaagacagucaccagguaaaggacuagaauggcuaggcguaauuuggucuggaggaaacacagauuacaacacaccauucacaucaagacuaucaauaaacaaagauaacuccaaaagucaaguuuuuuucaaaaugaacucacuccaauccaacgacacugccaucuacuacugcgcaagagcacuaacauacuacgacuaugaauuugcauacuggggacaaggaacacuaguaaccguaucagccgcaucuacaaaagguccaucaguauucccacuagcaccaucaucuaaaucuaccucaggaggaacagcagcccuagguugcuuaguaaaagacuacuuuccagaaccaguaacagucucauggaacucaggcgcccuaaccucaggaguccacacauucccagcaguauuacaaucaucaggccuauacucauuaucuucuguaguaacaguaccauccucuucauuaggaacccaaacauacauaugcaacguaaaccacaaaccuucaaacacuaaaguagacaaaaaaguagaaccaaaaucuugcgauaaaacacacacaugcccuccaugucccgcaccagaacuacuaggaggaccaucaguauuccuuuucccacccaaacccaaagacacacucaugauaucaagaacuccagaaguaacaugcguagucguagauguaucccaugaagaucccgaaguaaaauucaauugguacguagauggcguagaaguucacaacgccaaaaccaaaccaagagaagaacaauauaacucuacauaucgaguaguauccguacuaacaguucuacaccaagacugguuaaacggaaaagaauacaaauguaaaguauccaauaaagcacuaccagcaccaauagaaaaaacaauuucaaaagcaaaaggucaaccccgcgaaccacaaguauacacacuuccucccucuagagacgaauuaaccaaaaaucaagucucacuaacaugcuuaguaaaaggauuuuacccaucagauauagcagucgaaugggaaucaaauggacaaccugaaaacaacuacaaaaccacaccaccaguucuugacucugacggaucauuuuuucuauacucaaaauuaacaguugacaaaucaagauggcaacaaggaaacguauuuucuuguucugucaugcacgaagcacuccacaaccacuauacacaaaaaucccucucacuaucccccggaaaa

SEQ ID NO: 46008 - RNA, 639 nt, Artificial Sequence
  derived and/or modified sequence opt6 from Cetuximab_LightChain
gacauacuauuaacacaaucaccaguaauauuauccguaucaccaggagaaagaguaucauuuuccugccgagcuagccaauccauaggaacaaacauacacugguaccaacaaagaacaaacggcucaccaagacuccuuauaaaauacgcauccgaaucaauaucaggaauaccaucaagauucucaggcucaggaucaggaacagacuucacacuaucaaucaauucaguagaaucagaagacauagccgacuacuacugccaacaaaacaacaacuggccaacaacauucggagcaggaacaaaacuagaacuaaaacgaacaguagccgccccauccguauucauauucccaccaucagaugaacaacuaaaaucaggaacagccucaguaguaugccuacuaaacaacuucuacccaagagaagcaaaaguacaauggaaagucgacaacgcacuacaaucaggaaacucacaagaaucaguaaccgaacaagacuccaaagacucaacauacucacuaucaucaacacuaacacuaucaaaagcagacuacgaaaaacacaaaguauacgcaugcgaaguaacacaccaaggccuauccucaccaguaaccaaaucauucaacagaggagca

SEQ ID NO: 46009 - RNA, 642 nt, Artificial Sequence
  derived and/or modified sequence opt6 from Cetuximab_LightChain_variant
gacauauuacucacacaaucaccaguaauacuaucaguaagcccaggagaacgaguaucauucucaugcagagcaucccaaucaauaggaacaaacauacacugguaccaacaaagaacaaacggcucacccagacuacuaauaaaauacgcaucagaaucaauaucuggaauaccaucaagauucucaggaucaggaucaggcacagacuucacacuauccauaaacucaguagaaucagaagacauagcagacuacuacugccaacaaaacaacaacuggccaacaaccuucggagcaggaacaaaacuagaauuaaaacgaacaguagcagcaccaucaguauucauauuccccccaucagacgaacaacuaaaaucaggaacagcaucaguaguaugccuacuaaacaacuucuacccaagagaagcaaaaguacaauggaaaguagacaacgcauuacaaucaggaaacucacaagaauccguaacagaacaagacuccaaagacucaacauacucccuaucauccacauuaacauuaucaaaagccgacuacgaaaaacacaaaguauacgcaugcgaaguaacacaccaaggcuuaucaucaccaguaacaaaaucauucaaccgaggagaaugc

SEQ ID NO: 46010 - RNA, 675 nt, Artificial Sequence
  derived and/or modified sequence opt6 from Citatuzumab_bogatox_HeavyChain1
caucaccaccaucaucacgaaguacaauuaguacaaucaggaccaggacuaguacaaccaggaggaucaguaagaauaucaugcgcagcaagcggauacaccuucacaaacuacggaaugaacuggguaaaacaagcaccaggaaaaggacuagaauggaugggauggauaaacacauauacaggagaaucaacauacgcagacucauuuaaaggacgauucaccuucucacuagacacaucagcaucagcagcauaccuacaaauuaacagucucagagcagaagacacagcaguauacuacugcgcaagauucgcaauaaaaggagacuacuggggccaaggaacauuauuaacaguaucaucagcaucaacaaaaggaccaagcguauucccauuagcaccaucaucaaaaagcacaagcggaggaacagcagcacuaggaugcuuaguaaaagacuacuucccagaaccaguaacaguaucauggaacucaggagcauuaacaucaggcguacacacauucccagcaguacuacaaucaucaggccuauacucauuaucaaguguaguaacaguaccaucaucaucacuaggcacacaaacauacauauguaacguaaaccacaaaccaucaaacacaaaaguagacaaaaaaguagaaccaaaaucaugc

SEQ ID NO: 46011 - RNA, 1443 nt, Artificial Sequence
  derived and/or modified sequence opt6 from Citatuzumab_bogatox_LightChain1
gacauucaaaugacccaaucaccaucauccuuaagcgcaucaguaggagaccgcguaacaauaacaugcagauccacaaaaucacuacuacauuccaauggaauaaccuaccuauacugguaccaacaaaaaccaggaaaagcaccaaaauuacuaauuuaccaaaugagcaaucuagccucaggaguaccaucccgauucagcucauccggcucaggaacagacuucacacuaacaauaaguucauuacagcccgaagacuuugcaacuuacuauugugcccaaaaccuugaaauacccagaacauucggucaaggaacaaaagucgaacuaaaacgaacaguagcagcaccuuccguauucauauuucccccaucugacgaacaacucaaaucaggaaccgcaucagucguaugucucuuaaacaacuucuacccacgagaagcaaaaguacaauggaaaguagacaacgcauuacaaucaggaaauucucaagaaucaguaacugaacaagacucaaaagauucaacauauucauuaucuucaacauuaacacucucaaaagcugacuacgaaaaacacaaaguauaugcaugcgaagucacccaccaaggacuaucauccccaguaaccaaaucauucaaccgaggagagugcacacgacaucgccaacccagaggaugggaacaacuauauaacacaguuucuuucaacuuaggagaagcauacgaauauccaacauucauccaagaucuaagaaacgaacucgcaaaaggaacacccguuugccaacuaccuguaacucuacaaacaauagcagaugacaaaagauucguccuaguagacauaacaacaacuucuaaaaaaacaguaaaaguagcaauagauguaacagacguauacguagucggauaccaagacaaaugggacggaaaagauagagccgucuucuuagacaaaguacccacaguagcaacaucaaaacuauuuccaggaguaacaaacagaguuacacuuacauucgacggaucauaccaaaaacuaguaaacgcagcaaaagcugaucgaaaagcacuagaacuaggaguaaacaaacucgaauuuagcauagaagcaauacacggaaaaaccaucaauggacaagaagcagcaaaauucuuucuaaucguaauacaaaugguuagcgaagcagcuagauuuaaauacaucgaaacagaaguaguagauagaggauuauacggaucauucaaaccaaacuucaaaguauuaaaccuagaaaauaacuggggagacaucagugacgcaauccauaaaagcaguccacaauguacaacaauuaacccagcauuacaauuaauaucacccuccaacgaccccuggguaguaaacaaaguaucacaaaucucaccagacaugggaauacuaaaauucaaaucauccaaa

SEQ ID NO: 46012 - RNA, 1380 nt, Artificial Sequence
  derived and/or modified sequence opt6 from Cixutumumab_HeavyChain1
gagguccaacuaguacaaucaggagccgaagucaaaaaaccagguucuucaguaaaaguuagcugcaaagccagcggaggaacuuucucaucuuacgccaucucauggguaagacaagcaccuggucaaggacuagaauggaugggaggcauaauacccauauucggaacagcuaacuaugcucaaaaauuccaaggaagagucacaauaacagccgacaaaucuacauccacagcauacauggaacuaucaucacuaagaucugaagacacagcuguauauuacugugcaagggcaccauuaagauuucuagaauggucuacacaagaucacuacuacuacuacuacauggacguauggggcaaaggaacuacagucacaguaucaucugcaagcacaaaaggaccaucaguguuucccuuagccccaucauccaaaagcacuucaggcggaacagcagcacuaggcugcuuaguaaaagauuacuuuccagaaccaguaacaguaagcuggaauucaggagcacuaacaucaggaguacacacauuuccagcaguacuacaaaguucaggacuauacucauuaucaucagucguaacaguaccaucauccucacucggcacucaaacauauauaugcaacguaaaccauaaaccaucaaacacaaaaguagauaaaaaaguagaaccaaaaucaugcgacaaaacccacacuugcccucccugcccagcaccagaauuauuaggaggcccaucuguauuccuauucccaccaaaaccaaaagacacucuaaugauauccagaacaccugaaguaacaugcguaguuguugacguaucucacgaagacccugaaguuaaauuuaauugguauguagacggaguagaaguucacaaugcaaaaacaaaaccuagagaagaacaauacaauuccacauauagagugguuuccgucuuaacaguucuacaccaagacuggcuaaacgguaaagaauacaaauguaaagucucuaauaaagcacuaccagcuccaauagaaaaaacaauauccaaagccaaaggacaacccagagaaccacaaguauacacacuaccaccaucccgagaagaaaugaccaaaaaccaaguaucacucacaugccuuguaaaaggauucuacccaucagacauagcagucgaaugggaaucaaacggacaaccugaaaauaacuacaaaacaacaccaccaguauuagacucagacggguccuuuuuccuauacuccaaauuaacaguugacaaaucccgauggcaacaaggaaacguauucuccuguucaguaaugcaugaagcauuacauaaccacuauacacaaaaaucacuuucacuaucacccggaaaa

SEQ ID NO: 46013 - RNA, 642 nt, Artificial Sequence
  derived and/or modified sequence opt6 from Cixutumumab_LightChain1
ucaucagaacuaacacaagaccccgcaguaucaguagcacuaggucaaacagucagaauaacaugccaaggagacucacuaagaucauacuacgcaacaugguaucaacaaaaaccaggacaagcaccaauacuaguaauauauggagaaaacaaaagaccaucaggaauacccgacagauucucaggaagcucaucaggaaacacagcaucuuuaacaauaacaggagcacaagcagaagacgaagcagacuacuacugcaaaucacgcgacggaucaggacaacaccuaguauucggaggaggcacaaaauuaacaguacuaggacaaccaaaagcagccccaaguguaacacuauucccaccaucaucagaagaauuacaagcaaacaaagcaacacuaguaugcuuaauaucagacuuuuacccaggagcaguaacagucgcauggaaagcagacaguucaccaguaaaagcaggaguagaaacaacaacaccaucaaaacaaucaaacaacaaauacgcagcuuccucauaccuaucacuaacuccagaacaauggaaaucacacagauccuacucaugccaaguaacacacgaaggaucaacaguagaaaaaacaguagcaccagcagaaugcuca

SEQ ID NO: 46014 - RNA, 1350 nt, Artificial Sequence
  derived and/or modified sequence opt6 from Clazakizumab_HeavyChain1
gaaguacaauuaguagaaucaggaggaggcuuaguacaaccugguggcucauuaagacuaucaugcgcagcaucaggcuucucccuaucaaacuacuacguuacauggguaagacaagcaccaggaaaaggacuagaauggguaggaauaauauacggaucugacgaaacagcauacgcaacuucagccauaggccgauuuacaauaucacgagauaauucaaaaaauacacuauaucuacaaaugaacucucuaagagcagaagacacagcaguauacuacugcgcaagagaugacucaucagacugggacgcaaaauucaacuuauggggacaagguacauuagucaccguuucaucagcaucaacaaagggaccaucaguauucccuuuagcaccaucuucaaaaagcacaucaggaggaacagcagcacuaggaugccuaguaaaagauuauuuccccgaaccuguaacugucuccuggaacucaggcgcacuaacuuccggaguacacacauucccugcaguacuacaauccucuggacuauacuccuuaucaucaguaguuaccguacccucaucaagcuuaggaacccaaacauacauaugcaauguaaaucacaaaccaucaaauacaaaaguagacaaaagaguagaaccaaaauccugcgacaaaacucacacaugcccaccaugccccgcaccagaacuacuagguggccccucaguauuuuuauuuccaccuaaaccuaaagacacacuaaugauaucaagaacacccgaaguaacaugcguaguaguagacguaucacacgaagauccugaaguuaaauucaauugguacguugacggaguagaaguccauaacgcaaaaacaaaaccaagagaagaacaauaugcaucaacauacagaguuguaucaguauuaaccguauuacaccaagauuggcuaaacggcaaagaauacaaaugcaaaguuuccaacaaagcacucccagcccccauagaaaaaacaauaucaaaagcaaaaggucaaccaagagaaccacaagucuauacauuaccaccaagcagagaagaaaugacaaaaaaccaaguaucccuaaccugcuuaguaaaagguuucuacccaucagacauagcaguagaaugggaauccaacggacaaccugaaaauaacuauaaaacaacaccacccguucuagauucagaugguucuuuuuuuuuauacucaaaauugacaguugacaaaucacgauggcaacaaggaaaugucuuuucuugcucaguaaugcacgaagcauuacacaaccauuauacacaaaaaagcuuaucacuaaguccuggaaaa

SEQ ID NO: 46015 - RNA, 651 nt, Artificial Sequence
  derived and/or modified sequence opt6 from Clazakizumab_LightChain1
gcaauacaaaugacacaaucaccauccucauuaucagcaucaguaggagacagaguaaccauaacaugucaagcaucacaaucaauaaauaacgaacuaucaugguaccaacaaaaaccaggaaaagcaccaaaauuacuaauauacagagcaucaacauuagcaucaggaguaccaucaagauucucaggaucaggaucaggaacagacuuuacauuaaccauaucaucacuacaaccagacgacuucgcaacauacuacugccaacaaggauacucauuaagaaacauagacaacgcauucggaggaggaacaaaaguagaaauaaaaagaacaguagcagcaccaagcguauucauauucccaccaucagacgaacaacuaaaauccggaacagcaucaguaguaugucuacuaaacaacuucuacccaagagaagcaaaaguacaauggaaaguagacaacgcacuacaauccggaaacucacaagaaucaguaacagaacaagauuccaaagacucaacauacucacuaucaucaacauuaacacuaagcaaagcagacuacgaaaaacauaaaguauacgcaugcgaaguaacacaccaaggauuaagcuccccaguaacaaaaucauucaacagaggagaaugc

SEQ ID NO: 46016 - RNA, 1347 nt, Artificial Sequence
  derived and/or modified sequence opt6 from Clivatuzumab_tetraxetan_HeavyChain1
caaguccaauuacaacaaucaggagcagaaguaaaaaaacccggcgcaucaguaaaaguaucaugcgaagccucaggauacacuuucccuagcuacguucuacacuggguaaaacaagcaccaggacaagguuuagaauggauaggauacauaaacccauacaacgacggaacacaauacaaugaaaaauuuaaaggaaaagcaacacuaacccgugauacauccaucaauacagcuuauauggaacuaucaagacuacgaagcgacgacacagcuguauauuacugcgcaagagguuucggaggcuccuacggauucgcuuacuggggccaaggcacauuaguaacaguaaguuccgcaucaacaaaaggucccuccguauucccauuagcaccaucuuccaagucaacaucaggaggaacagcugcucuaggauguuuagucaaagacuacuuccccgaaccaguuacagucucauggaacucaggagcacucacaucaggaguacauacauuuccagccguucuacaaucuucaggauuauacucacuuucaucaguaguuaccguaccaucaucaucauuaggaacacaaacauauauaugcaacguuaaccauaaaccaucaaauacaaaagucgauaaaagaguagaaccaaaaucaugugacaaaacacauaccugcccacccugcccagcaccugaacuucuaggcggaccuucaguauucuuauucccuccaaaacccaaagacacccuaaugaucucccgaacaccagaaguaacaugcguaguagucgacguaucacacgaagauccugaaguaaaauucaauugguaugucgacggagucgaaguacacaaugcuaaaacaaaaccaagagaagaacaauacaacucaacauaccguguagucucaguacuaacaguccuacaccaagacuggcuaaauggaaaagaauauaaaugcaaaguaucaaacaaagcauuaccagcucccaucgaaaaaacaauaucaaaagcaaaaggacaaccaagagaaccccaaguauacacauuaccaccaucaagagaagaaaugacaaaaaaucaagucucucuaacuugcuuaguaaaaggauucuacccaucagacaucgcagucgaaugggaaucaaacggacaaccagaaaacaacuacaaaacaacaccaccuguauuagacucagacggcucauucuucuuauacucaaaacuaacaguagauaaaucucgauggcaacaaggaaacguauuuucaugcagcguuaugcaugaagcccuacauaaucacuacacccaaaaaucacuaucccuaucuccaggcaaa

SEQ ID NO: 46017 - RNA, 645 nt, Artificial Sequence
  derived and/or modified sequence opt6 from Clivatuzumab_tetraxetan_LightChain1
gacauacaacucacacaaucaccaucaucauuaucagcaucaguaggagaccgagucacaaugacaugcucagcuucaucaagcguaucaucaucauaucuauacugguaccaacaaaaaccaggaaaagcacccaaacuauggauauacucaacauccaacuuagcaucaggaguaccagcaagauucucaggaucaggaucaggaacagacuuuacauuaaccauaucaucccuacaaccagaagacucagccucauacuucugccaccaauggaaccgauacccauacacauucggaggaggaacaagacuagaaaucaaaagaacaguagcagcaccaucaguauucauauucccaccaucagacgaacaacuaaaaucaggaacagcaagcguuguaugucuacuaaacaacuucuacccaagagaagcaaaaguccaauggaaaguagauaacgcauuacaaucaggaaauucacaagaaucaguaacagaacaagacucaaaagacucaacauacucacuaucauccacacuaacacuaucaaaagcagacuacgaaaaacacaaaguauacgcaugcgaaguaacacaccaaggacucuccucacccguaacaaaaucuuucaaccgcggagaaugc

SEQ ID NO: 46018 - RNA, 1335 nt, Artificial Sequence
  derived and/or modified sequence opt6 from Codrituzumab_HeavyChain1
caaguacaacuaguccaaucaggagccgaaguaaaaaaaccaggagccucaguaaaaguaucaugcaaagcaagcggauacacauuuacagacuaugaaaugcacuggguacgacaagcaccaggacaaggacuagaauggaugggagcauuagaccccaaaacuggugacacagcauacagccaaaaauucaagggacgaguaacacuaacagccgacaaaucaacaagcacagcauauauggaauuauccucuuuaacuucagaagauacagcugucuacuacuguacaagauucuacucauauacauacuggggacaaggaacauuaguaacaguuucaucagcaaguaccaaaggaccaucaguauucccauuagcaccaucauccaaaucaacaucaggagggacugcagcacuaggcugcuuaguaaaagauuacuuuccagaaccuguuacaguaucauggaacucaggagcacuaacaucaggaguacacacauucccagcaguacuacaaucaucaggacuuuauucauuaucaucagucguaacuguaccaucuucaucacuaggaacacaaacauacauauguaacguaaaccacaaacccucaaauacaaaaguugauaaaaaaguugaacccaaaaguugugacaaaacacacacaugucccccauguccagcaccagaacucuuaggaggcccaucaguauucuuauucccccccaaaccaaaagauacacuuaugauaucaagaacaccagaagucaccugcguaguaguagacgucucacaugaagaccccgaaguaaaauucaacugguacgucgaugguguagaaguucacaaugcaaaaacaaaaccaagagaagaacaauacaacuccacauauagagucguaucaguccuaacaguuuuacaccaagacuggcuaaacggcaaagaauauaaaugcaaaguuucaaacaaagcacuaccagcaccaauagaaaaaacaauuucaaaagcaaagggacaaccaagagaaccgcaaguauacacauuaccaccaucaagagacgaauugacaaaaaaccaaguaaguuuaacaugcuuaguaaaaggauuuuaccccucagauauagcagucgaaugggaaucaaacggacaaccugaaaacaacuacaaaacaacuccaccaguccuugacucagacggcucauucuuucuauacucaaaacuaacaguagacaaaucaagauggcaacaaggaaacguauucucuuguuccguaaugcacgaagcacuacacaaucauuacacucaaaaaucccuaucccuuuccccaggaaaa

SEQ ID NO: 46019 - RNA, 657 nt, Artificial Sequence
  derived and/or modified sequence opt6 from Codrituzumab_LightChain1
gacguaguaaugacacaaucaccacuaucccuaccaguaacaccaggagaaccagcaucaaucucaugcagaucaucacaaucacuaguacacucaaacagaaacacauacuuacacugguaccuacaaaaaccaggccaaucaccacaacuauuaauauacaaaguaucaaacagauucuccggaguaccagacagauucucaggaucaggaucaggaacagacuucacacuaaaaauauccagaguagaagcagaagacguaggaguauauuacugcucucaaaacacacacguaccaccaacauucggacaaggcacaaaauuagaaauaaaaagaacaguagcagcaccaucaguauucauauucccaccaucagacgaacaacuaaaaucagguacagcaucaguaguaugccuacuaaacaacuuuuacccaagagaagcaaaaguacaauggaaaguagacaacgcacuacaauccggaaacucacaagaauccgucacagaacaagacucaaaagacucuacauacucacuaucaucuacccuaacccuaucaaaagccgacuacgaaaaacauaaaguauacgcaugcgaaguaacacaccaaggacuaucaucaccaguaacaaaaucauucaacagaggagaaugc

SEQ ID NO: 46020 - RNA, 1350 nt, Artificial Sequence
  derived and/or modified sequence opt6 from Coltuximab_ravtansine_HeavyChain1
caaguacaacuaguccaaccaggagccgaaguuguuaaaccuggagcauccguuaaacuaucuugcaaaacauccggauacaccuuuacaucuaauuggaugcacuggguaaaacaagcaccuggacaaggcuuagaauggauaggagaaauagauccaucugauucauacaccaauuacaaccaaaacuuccaagguaaagcaaaacuaacaguagacaaaucuacaaguaccgccuacauggaaguuaguucacucagaagcgacgacacagcaguauacuacugcgcaaggggcucaaacccauacuacuaugcuauggacuauuggggucaaggaaccuccguaacaguaucaagugcaucaacaaaaggcccauccguauuuccacucgcaccaucaucaaaaucaacauccggaggaaccgcagcacuuggcugccucguaaaagacuauuucccagaaccagucacaguuucuuggaacucaggagcacuaacaucagguguacacacauucccagcaguauuacaauccucaggccuauauucauuaucaagcguaguuacggucccgucaucaucauuagguacccaaacauacaucugcaauguaaaccacaaaccaucaaacacaaaaguagacaaaaaaguagaaccaaaauccugcgacaaaacacacacaugcccaccaugccccgcaccugaauugcuaggcggaccaucaguauucuuauucccaccaaaaccaaaagauacacuaaugauaucaagaacaccagaagucacuugcguaguuguagacguuucccacgaagauccagaaguaaaauucaauugguauguagacggaguagaaguacauaaugcaaaaaccaaaccacgagaagaacaauacaacucaacauacagagucguuucaguacuuaccgucuuacaucaagacuggcuaaacggaaaagaauacaaauguaaaguaucaaacaaagcucuacccgcaccuauagaaaaaacaaucagcaaagcaaaaggacaaccacgagaaccacaaguauacacacuaccuccuuccagagaugaacuaacaaaaaaccaaguauccuuaacaugucuaguaaaaggauucuacccaucagacauagccguagaaugggaaucaaacggucaaccagaaaacaacuacaaaacaacuccaccaguacuagauucugacgguuccuucuuccuauacucaaaacuaacaguagacaaaucuagauggcaacaaggaaacguauucucaugcucaguaaugcacgaagcacuccauaaccacuacacacaaaaaagcuuaucucuauccccaggaaaa

SEQ ID NO: 46021 - RNA, 633 nt, Artificial Sequence
  derived and/or modified sequence opt6 from Coltuximab_ravtansine_LightChain1
gaaauaguacuaacacaaucaccagcaauaaugagugcaucaccaggagaacgaguaacaaugacaugcucagcaucaucaggaguaaacuacaugcacugguaucaacaaaaacccggaacaucaccaagaagauggauauacgacacaucaaaacuagcaucaggaguaccagcaagauucucaggaucaggaagcggcacagacuacucauuaacaauaucaagcauggaaccagaagacgcagcaaccuauuacugccaccaacgaggaucauacacauuuggaggaggaacaaaacuagaaauaaaaagaacaguagcagcaccaucaguauucauauuccccccaucagacgaacaauuaaaaagcggaacagcaucaguaguaugccuauuaaacaacuucuacccaagagaagcaaaaguacaauggaaaguagacaacgcacuccaaucaggaaacucacaagaaaguguaacagaacaagacucaaaagacucaacauacucauuaucaagcacauuaacacuaucaaaagcagacuacgaaaaacacaaagucuacgcaugcgaaguaacacaccaaggauuaucaaguccaguaacaaaaucauuuaauagaggagaaugu

SEQ ID NO: 46022 - RNA, 1356 nt, Artificial Sequence
  derived and/or modified sequence opt6 from Conatumumab_CV_HeavyChain
caaguacaauuacaagaaucaggccccggucuaguaaaaccaucacaaacauuaucacuaacaugcacaguauccggaggaucaauauccucaggagacuacuucuggucauggauaagacaacuaccaggaaaaggauuagaauggauaggacauauucacaauuccggaaccaccuacuauaauccaagccuuaaaucacgaguaacaauaucagucgauacaucuaaaaaacaauucucacuaagacuaucaucaguaacagcagcagauacagcagucuauuacugcgcuagagauagaggaggagauuacuacuacggcauggauguauggggacaaggaacuacagucacagucucaucagcaagcacaaaaggacccucuguuuucccacuagcccccucuucuaaauccacaucaggagguacagcugccuuaggcugucuaguaaaagacuacuuccccgaaccgguaaccgucucauggaacucaggagcacuaacaucuggaguacacacauuucccgcaguauuacaauccucuggauuauacucccuuuccuccguagucacuguaccuuccucaucccuaggaacacaaacauacauaugcaauguaaaccacaaaccaucaaacaccaaaguagacaaaagaguagaaccaaaaucuugcgacaaaacacacacauguccaccaugcccagcuccagaauuacuagguggaccaucagucuucuuauuccccccaaaaccaaaggauacacucaugauaucccgcacuccagaagucacaugcgucguaguagaugucucacacgaagaccccgaaguaaaauuuaauugguacguagauggaguagaaguacacaacgcaaaaacaaaaccaagagaagaacaauacaacaguacauauagaguaguauccguacucacaguauuacaucaagauuggcuaaacggaaaagaauacaaauguaaaguaucaaacaaagcauuacccgcacccauugaaaaaacaauaucaaaagcaaaaggacaaccaagagaaccacaagucuacacauuaccaccaucaagagaagaaaugacaaaaaaccaaguaucauuaaccuguuuaguaaaaggauucuauccaucugauaucgcaguagaaugggaaucuaacggucaacccgaaaauaacuacaaaaccaccccaccaguacuagacucagacggauccuuuuuuuuauacucaaaacuaacuguagauaaaaguagauggcaacaaggcaacguauucuccuguucuguaaugcacgaagcucuacauaaccauuacacacaaaaaucacuaucccucucacccggaaaa

SEQ ID NO: 46023 - RNA, 645 nt, Artificial Sequence
  derived and/or modified sequence opt6 from Conatumumab_CV_LightChain
gaaauaguccuaacacaaucaccaggaacacuaucacuaucaccaggagaaagagcaacacuaucaugcagagcaucccaaggaauaucaagaucauacuuagcaugguaccaacaaaaaccaggacaagcaccaucacuauuaaucuacggagcaucaucacgagcaacaggaauaccagacagauucucaggauccggcucaggcacagacuucacacuaacaauuagcagacuagaaccagaagacuuugcaguauacuacugccaacaauucggaucaucaccauggacauucggacaaggcacaaaaguagaaauaaaacgaacaguagcagcaccuucaguauucauauucccaccaucagacgaacaauuaaaauccggaacagcaucaguaguaugcuuacuaaacaacuucuacccccgagaagcaaaaguacaauggaaaguagacaacgcacuacaaucaggaaacucacaagaaucaguaaccgaacaagauucaaaagacucaacauacucacuaucaucaacauuaacacuaagcaaagcagacuaugaaaaacacaaaguauacgcaugcgaaguaacacaccaaggauuauccucaccaguaacaaaaucauucaacagaggagaaugc

SEQ ID NO: 46024 - RNA, 1356 nt, Artificial Sequence
  derived and/or modified sequence opt6 from Conatumumab_HeavyChain1
caaguacaacuucaagaaucugggccaggauuaguaaaaccaucucaaacacuaucacuaaccugcaccguaucuggagggagcauaucaucaggagauuacuucuggucauggauacgacaauuaccugggaaaggccuagaauggauaggucacauacacaacucaggcacaacuuauuacaacccaucccucaaaucaagagugaccauaucaguagauacauccaaaaaacaauuuucucuaagauuaucaucagucacagcagcagacacagcaguauauuacugcgcaagagacagaggaggugacuauuacuacggaauggacguauggggucaaggcacuacuguaacaguaucauccgccucaaccaaaggaccauccguauucccauuagcaccaucuucaaaauccacaaguggaggaaccgcagcacuaggaugccucguaaaagauuacuuccccgaaccuguaacaguaucauggaacucaggggcacuaacaucaggaguacacacauuccccgcagucuuacaaucuuccggacuguacucauugucaucagucguaaccguaccauccucuaguuuaggaacccaaacuuauauuugcaacguaaaccacaaacccucaaacacaaaaguagacaaacguguugaaccaaaaucuugcgacaaaacacauacaugcccacccuguccagcacccgaacuucuaggaggaccaaguguauucuuauucccaccaaaaccaaaagauacacuaaugauaucccgaacaccagaaguaacauguguaguaguagacguuucucaugaagaccccgaaguaaaauuuaauugguacguugacggaguagaaguacacaaugcaaaaaccaaaccuagagaagaacaauacaacucuacauacagaguagucuccguacuuacaguauuacaccaagauugguuaaauggaaaagaauacaaaugcaaaguaagcaauaaagcuuuacccgcaccaauugaaaaaacaauauccaaagcaaaaggacaaccaagagaaccucaaguauacacacuuccaccaucacgagaagaaaugacaaaaaaucaagucucauuaacauguuuaguaaaaggauucuaccccucagauauagcaguagaaugggaaucaaacggccaaccagaaaauaacuacaaaaccacaccuccaguacuagacuccgacggaucuuucuucuuauacucaaaacuaacagucgacaaaucaagauggcaacaaggaaacguauuuuccuguucaguaaugcacgaagcacuccauaaucacuauacacaaaaaucacuuucccuaucaccagguaaa

SEQ ID NO: 46025 - RNA, 1356 nt, Artificial Sequence
  derived and/or modified sequence opt6 from Conatumumab_HeavyChain
caaguacaacuacaagaaucaggaccaggacuuguaaaaccaucucaaacacucucuuuaaccuguacaguauccggcggaucaauauccucaggcgacuacuucuggucauggauaagacaauuaccaggaaaaggccuagaauggauaggacacauccacaacucugguaccaccuauuauaaccccucauuaaaaucaagaguuacaauaucaguagacacauccaaaaaacaauucucacuaagauuauccucagucacagcugccgacaccgcaguauauuacugcgcaagagacagagguggagauuacuacuacggaauggacguauggggacaaggaacuacaguaacaguaaguucagcaucuacaaaaggcccauccguauuuccacuagcuccaucuucaaaaucaacaucaggagguacagcagcacucggaugucuagucaaagauuauuucccagaaccaguaacugucuccuggaauucaggagcccuaacuucaggaguacacacauucccagcaguccuacaaucuucuggccucuacucucuaucaucaguaguaaccguaccaucaucuagcuuaggaacacaaacauauauuugcaaugucaaucauaaaccauccaacaccaaaguagacaaaagaguagaaccaaaauccugugauaaaacacauaccuguccaccuugucccgcaccagaacuauuagguggaccaucagucuuucuuuucccuccuaaaccaaaagauacacuaaugauaucacgaacaccugaagucacaugcgucguaguagauguaucucacgaagacccagaaguaaaauucaacugguacguugacggaguugaaguacacaaugcgaaaacaaaaccaagagaagagcaauacaauucaaccuaccgcguaguaagcguccuuacaguucuacaccaagacuggcucaacggaaaagaauauaaauguaaaguaucaaacaaagcauuaccugcgcccauugaaaaaacaauauccaaggcuaaaggacaaccuagagaaccccaaguauacacauuaccaccaucaagagaagaaaugacuaaaaaucaaguaucauuaacaugucuaguuaaaggcuucuauccaucagacauagcagucgaaugggaaucuaauggacaaccagaaaauaacuacaaaacaacaccucccguauuagacucagacggcucauucuuuuuauacucaaaacuaacagucgacaaaucacguuggcaacaaggaaauguauuuucaugcucaguaaugcacgaagcacuacacaaccauuacacacaaaaaucacuuucacuaagccccggaaaa

SEQ ID NO: 46026 - RNA, 645 nt, Artificial Sequence
  derived and/or modified sequence opt6 from Conatumumab_LightChain1
gaaauaguccuaacacaaucaccaggaacauuaucacucucaccaggagaaagagcaacacuaucaugccgcgccucacaaggaauaucaagauccuaccuagcaugguaucaacaaaaaccaggacaagcaccaucacuacuaauauacggagcauccucacgcgcaacaggaauaccagacagauucucaggcucuggaucaggaacagacuucacacuaaccauauccagauuagaaccagaagauuucgcaguauacuacugccaacaauucggaucauccccauggacauucggacaaggaacaaaaguagaaauaaaaagaacaguagcagcaccaucaguauucauauucccaccaucagaugaacaauuaaaaucaggaacagcaucaguaguaugucuacuaaacaacuucuacccacgagaagcaaaaguacaauggaaaguagacaacgcacuacaaucaggaaauucacaagaaucaguaacugaacaagacucaaaagacucaacauacucacuaucaucaacccuaacacucucaaaagcagacuacgaaaaacacaaaguauacgcaugugaaguaacacaccaaggacuaucaucaccaguaacaaaaucauucaacagaggagaaugc

SEQ ID NO: 46027 - RNA, 645 nt, Artificial Sequence
  derived and/or modified sequence opt6 from Conatumumab_LightChain
gaaauaguacuaacacaaucaccaggaacacuaucacuaucaccaggagaaagagcaacacuaucauguagagcaucacaaggaauaucaagauccuaccuagcaugguaccaacaaaaaccaggacaagcaccaucauuacuaauauacggagcaucaucaagagcaacaggaauaccagacagauucucaggcucaggaucaggaacagacuucacauuaacaauaagcagauuagaacccgaagacuucgcaguauacuacugccaacaauucggaucaagcccauggacauucggacaaggaacaaaaguagaaauaaaaagaacaguagcagcaccaucaguauucauauucccaccaucugacgaacaacuaaaaucaggaacagcaucaguaguaugccuacuaaauaacuucuacccaagagaagcaaaaguacaauggaaaguagacaacgcacuacaaucaggaaacucacaagaaucaguaacagaacaagacucaaaagacucaacauauucccuaucauccacauuaacacuuucaaaagcagacuacgaaaaacacaaaguauacgcaugcgaaguaacacaccaaggacuaucaucaccaguaacaaaauccuuuaauagaggagaaugc

SEQ ID NO: 46028 - RNA, 1344 nt, Artificial Sequence
  derived and/or modified sequence opt6 from Concizumab_HeavyChain1
gaaguacaauuaguagaaaguggaggaggauuaguaaaaccaggaggcucccucagacuauccugugcagcaucuggauuuacuuucucaaacuaugcaaugucauggguaagacaaacaccagaaaaaagacuagaauggguagcaacuaucucuagaagcggcuccuacucauacuuucccgauucaguacaaggaagauuuacaauaucaagagacaaugcaaaaaauagccuuuaucuucaaaugaauucccuaagagccgaagacacagcuguauacuauugugcaagacuaggaggauaugacgaaggagaugcaauggauagcuggggccaaggaacaaccguaacaguaucaucagcuucaacaaaaggacccucaguauuuccauuagcacccugcucaagaucaacaucagaaucuacagcagcucuaggaugccuaguuaaagauuauuuuccagaaccaguaacaguuucauggaauagcggugcacuaacuucaggcguacacacauucccagcaguacuacaaucauccggucucuauucacucuccucaguaguuacaguacccuccucaagucuagguacaaaaacauacacauguaacguagaucauaaaccaucaaauacuaaaguugacaaacgagucgaauccaaauacggaccaccaugcccaccauguccagccccagaauuccuaggcggaccaucaguauuuuuauuccccccuaaaccaaaagacacacuaaugauuucaagaacaccagaaguuaccuguguaguaguagaugucucucaagaagacccagaaguacaauuuaacugguacguagacggagucgaaguacauaaugccaaaacaaaaccaagagaagaacaauuuaauucaacuuacagaguagucuccguacuaaccguacuacaccaagacugguuaaauggcaaagaauauaaauguaaagucucaaacaaaggacuaccuucaucaauagaaaaaacaauaucaaaagccaaaggacaaccaagagaaccacaaguguauacauuacccccaucacaagaagaaaugacaaaaaaccaaguaucacucacauguuuagucaaaggauucuauccaucagacauagcagucgaaugggaaucuaacggacaacccgaaaacaacuauaaaacuacaccacccguacucgacucagauggaaguuucuuucucuacucaagacuuacagucgacaaaucaagauggcaagaagguaauguauuuagcuguucaguaaugcaugaagcauuacauaaccacuacacacaaaaaucauuaucacuaucacugggaaaa

SEQ ID NO: 46029 - RNA, 657 nt, Artificial Sequence
  derived and/or modified sequence opt6 from Concizumab_LightChain1
gacauaguaaugacacaaacaccacuaucccuaucaguaacaccaggacaaccagcaucaauaucaugcaaaagcucacaaucacuacuagaaucagacggaaaaacauaucuaaacugguaccuacaaaaaccaggacaaucaccacaacuacuaaucuaccuaguaucaauauuagacucaggaguaccagacagauucucaggauccggaucaggaacagacuucacauuaaaaauauccagaguagaagcagaagacguaggagucuauuacugccuacaagcaacacacuucccacaaacauucggaggcggaacaaaaguagaaauaaaacguacaguagcagcaccaucaguauucauauuuccacccucagaugaacaacuaaaaucaggaacagcuucaguaguaugccuauuaaauaacuucuacccaagagaagcaaaaguucaauggaaaguagacaacgcacuacaaucaggaaacucacaagaaucaguaacagaacaagacucaaaagacucaacauacucacuaucaucaacacuaaccuuaucaaaagcagacuacgaaaaacacaaaguauacgcaugcgaagucacacaccaaggacuaucaucaccagucacaaaaagcuucaauagaggagaaugu

SEQ ID NO: 46030 - RNA, 1314 nt, Artificial Sequence
  derived and/or modified sequence opt6 from Crenezumab_HeavyChain1
gaaguacaacuaguugaaagcggaggaggauuaguccaaccaggaggaagccuaagacuaucaugcgccgcaucgggauucacuuuuagcucuuacggaaugucaugggucagacaagcaccuggaaaaggccuagaauuagucgcaucaauaaacucgaacggaggaucaacauauuauccagauucaguaaaaggaagauucacaauaaguagagauaacgcaaaaaacucacuauaccuacaaaugaacucacuaagagcagaagacacagcaguuuauuacugcgccaguggagauuauuggggacaaggaacaaccguaacuguaucuucagcaucaacuaaaggcccuuccguauuuccauuagcaccaugcucacgaaguaccagcgaaucaacagccgccuuaggauguuuaguaaaagauuacuuuccagaaccaguaacagucucauggaacaguggagcucuaacgucaggaguucauacauuuccagcuguacuacaaucaucagggcucuauucauuaucuucaguaguuacaguacccucuagcucauuaggaacuaaaaccuacacauguaacguagaccauaaaccauccaauacaaaaguagauaaaagaguagaaucaaaauacgguccuccaugcccaccauguccagcaccagaauuucuuggaggaccaucagucuuucuauuuccaccuaaaccaaaagacacauuaaugaucucaagaacaccagaaguaacauguguuguuguagacguaagccaagaagacccagaaguacaauuuaacugguauguagacggaguagaaguucacaaugcaaaaacaaaaccaagagaagaacaauucaauuccacauauagaguaguaucaguacuaacuguccuucaccaagacuggcuaaauggaaaagaauauaaauguaaaguuucaaauaaaggauuaccuucaaguauagaaaaaacuaucucuaaagcuaaaggccaaccaagagaaccacaaguauacacauuaccaccaucucaagaagaaaugacuaaaaaucaaguaucacuaacguguuuaguaaaaggauuuuacccaucagacauagcagucgaaugggaaucuaauggucaaccagaaaacaacuauaaaacaacaccaccaguacuagauucagauggauccuuuuuuuuauacucaagacuaacagucgauaaauccagauggcaagaaggaaauguauuuucauguuccguuaugcacgaagcacuacauaaccacuacacacaaaaaucucuaagucuaucacuaggc

SEQ ID NO: 46031 - RNA, 657 nt, Artificial Sequence
  derived and/or modified sequence opt6 from Crenezumab_LightChain1
gacauaguaaugacacaaucaccauuaucacuaccaguaacaccaggagaaccagcaucaauaucaugcagauccucacaaucacuaguauacucaaacggagacacauaccuacacugguaccuacaaaaaccaggacaaucaccacaacuacuaauauacaaaguaucaaaccguuucucuggaguaccagacagauucucaggauccggcucaggaacagacuucacacuaaaaauaagcagaguagaagccgaagacguaggaguauacuacugcucacaaucaacacacguaccauggacauucggacaaggaacaaaaguagaaaucaaaagaacaguagcagcaccaucaguauucauauucccaccaucagacgaacaauuaaaaucaggaacagcaucaguaguauguuuacuaaacaacuucuacccaagagaagccaaaguccaauggaaaguugacaacgcauuacaaucaggaaacucacaagaaucaguaacagaacaagauucaaaagacucaacauacuccuuauccucaacauuaacacuaucaaaagcagacuacgaaaaacacaaaguauacgcaugcgaaguaacacaccaaggauuaucaucaccaguaacaaaaucauucaacagaggagaaugc

SEQ ID NO: 46032 - RNA, 1365 nt, Artificial Sequence
  derived and/or modified sequence opt6 from Crotedumab_HeavyChain1
gaaguccaauuaguagaaucuggcggugguuuaguacaaccaggaggaucauuacgauuauccugcgcagccucaggauuuacauuuucaaauuaucuuaugaacuggguaagacaagcaccaggaaaaggauuagaaugguuagcaaacauucaagaagacggcaucgaaaaauacuacguagauucuguaaaagguagauuuacaaucucgagagauaacgcaaaaaacucauuauaucuacaaaugaacucauuacgcgcagaagacacagcaguauacuauugcgcaagagaaccaucacacuacgacauauuaacuggauacgacuauuacuauggaauggacguauggggacaaggaaccacaguaacaguaucaagcgccuccacaaaaggaccaucaguauuuccauuagcaccaugcucaagaucaacaucagaaucaacagcagcacuaggaugucuaguaaaagacuauuuccccgaaccaguaacaguuucaaauaacuccggagcuuuaacuagcggaguccacacauuuccagcaguacuacaaucgucaggauuauacucacuaucaucuguaguaacaguucccucaagcucacuaggcacaaaaacauauacauguaacguagaccacaaaccauccaauacaaaaguagauaaaagaguagaaagcaaauacggaccaccaugcccaccaugucccgcaccagaauuucuaggaggaccuuccguauuuuuauuuccacccaaaccaaaagauacauugaugauuucaagaacacccgaaguuacaugugucgucguagauguaagccaagaagacccagaaguacaauucaacugguauguagacggagucgagguacauaacgcaaaaacaaaaccuagagaagaacaauuuaauagcaccuauagaguaguaucaguacuaacaguacuacaucaagauugguuaaauggaaaagaauauaaauguaaaguaucaaauaaaggacuaccaagcaguauagaaaaaacaauaucaaaagcaaaaggccaaccaagagaaccacaaguauauacauuaccaccaagccaagaagaaaugacaaaaaaucaaguaagcuuaacaugucuaguuaaaggauuuuauccauccgacauagccguugaaugggaaucuaacggacaaccagaaaacaacuacaaaaccacaccaccaguauuagauagcgauggaucauucuuuuuauauuccagacucacagucgauaaauccagauggcaagaaggaaacguauucucaugcucaguaaugcacgaagccuuacauaaccacuacacacaaaaaucacucucacuuagccucggaaaa

SEQ ID NO: 46033 - RNA, 1365 nt, Artificial Sequence
  derived and/or modified sequence opt6 from Crotedumab_HeavyChain2
gaaguacaauuaguugagucaggaggaggacuaguacaaccagguggcucacuacauuuaagcugugccgcaagcggauuuacauuuuccaauuauuuaaugaauuggguaagacaagcaccuggaaaaggacuagaauggcuagcuaacauccaagaagacggaauagaaaaauacuacguagacucaguaaaaggaagauucacaauaucuagagauaacgcaaaaaauuccuuauaccuucaaaugaacucucuaagagcagaagacacagcgguuuauuacugcgccagagaaccaucacauuacgacauauuaacaggauaugacuauuacuauggaauggacguuuggggacaagguacaacaguaacaguauccucagcaucaacaaaagguccauccguauuuccacuagcacccugcucaagaucaacaucagaaaguacagcagcacuaggcugucucguuaaagauuauuucccagaaccaguaacagucucaaauaacucaggagcucuaacuuccgggguacacacauucccagcaguauuacaaucuucgggauuauauucauuaucauccguaguaacaguaccaucuucaucacuaggaacaaaaaccuauacaugcaacguagaccacaaaccaucaaacaccgaaguagaugaaagaguagaaucaaaauaugguccaccaugcccacccuguccagcaccagaauuucuaggagguccaucaguauuuuuauuuccaccaaaaccaaaagauacacuaaugauuagcagaacaccugaaguaaccuguguaguuguagauguaucacaagaagacccagaaguccaguuuaacugguacguagacggaguagaaguacauaaugcaaaaaccaaaccaagagaagaacaauucuggucaaccuaccguguaguuucaguacuaaccguacuccaccaagauuggcuaaauggaaaagaauacaaaugcaaaguuucaaauaaaggacuaccaucaucaauagaaaaaacaauuucaaaagccaaaggacaacccagagaaccucaaguguacacacuaccaccaucacaagaagaaaugacaaaaaaccaaguuucacuaacauguuuaguuaaaggauuuuauccaucagauauagcaguagaaugggaaucaaacggacaaccagaaaacaacuauaaaacaaccccaccaguauuagauucggauggaucuuucuucuuauauucaagacuaacaguagacgaaucacgauggcaagaacacaauguauuuagcugcuccguuaugcaugaagcacuacauaaccauuauacccaaaaaucucuaucauuaucacuagguaaa

SEQ ID NO: 46034 - RNA, 642 nt, Artificial Sequence
  derived and/or modified sequence opt6 from Crotedumab_LightChain1
gacauacaaaugacacaaucaccauccagcuuaucagcaucaguaggagaccgcguaacaauaacaugcagagcaucacaaggaauaagaaacgaccuaggaugguaccaacaaaaacccggaaaagcaccaaaacgauuaauauacgccgcaucaucacuacaaagcggaguaccaucaagauucuccggaucaggaucaggaacagaauucauacuaacaguaucaucacuacaaccagaagacuucgccacauauuacugcuuacaauacaacgaaaacccauucacauucggacccggaacaaaaguagacauaaaaagaacaguagcagcacccaguguauucauauucccaccauccgacgaacaauuaaaaucaggaacagcaucaguaguaugcuuacuaaacaacuucuacccaagagaagcaaaaguccaauggaaaguagacaacgcacuacaauccggaaacucacaagaaucaguaacagaacaagacagcaaagacucaacauacucauuaagcucaacauuaacacuaucaaaagcagauuacgaagaacacaaaguauacgccugcgaaguaacacaccaaggacuaucaucaccaguaacaaaaucauucaacagaggcgaaugc

SEQ ID NO: 46035 - RNA, 642 nt, Artificial Sequence
  derived and/or modified sequence opt6 from Crotedumab_LightChain2
gacauacaaaugacacaaucaccaucaucacuaagugcauccguaggagacagaguaacaauaacaugucgagcaucacaaggaauaagaaaugaccuaggcugguaccaacaaaaacccggaaaagcaccaaaaagauuaauauacgccgcuuccucacuccaaucaggaguaccaucaagauucuccggaucaggcucuggaacagaauucauacuaacaguauccucacuacaaccagaagacuuugccacauacuacugcuuacaauauaacucaaacccauucacauucggaccaggaacaaaaguagacauaaaacgaacaguagcagccccaucaguauucauauucccaccaucagacgaacaacuaaaauccggaacagcaucaguaguaugcuuacuaaacaacuucuacccaagagaagcaaaaguacaaaacaaaguagacaacgcacuccaaucaggaaacucacaagaaucaguaacagaacaagacucaaaagacucaacauacucccuaagcuccacauuaacacuaucagaagcagauuacgaaaaacacaaaguauacgcaugcgaaguaacacaccaaggucuaucaucaccagucacaaaauccuucaaccgaggagaaugc

SEQ ID NO: 46036 - RNA, 1332 nt, Artificial Sequence
  derived and/or modified sequence opt6 from Dacetuzumab_HeavyChain1
gaaguacaauuaguagaaucaggcggaggucuaguacaaccagguggaucccuaagacuaucaugcgcagccucaggcuauaguuuuacaggauauuacauacauuggguaagacaagcaccaggaaaaggacuagaauggguagcacgaguaauaccaaaugcaggaggaacaagcuauaaccaaaaauuuaaaggaagauuuacauuaucaguagauaauaguaaaaauacagcauacuuacaaaugaacucucucagagcagaagacacagcaguauauuauugcgcaagagaaggaauauauugguggggucaaggcacgcuaguaacaguaucaucagcaaguacaaaaggaccaucuguauucccacuugcacccucaucaaaaucaacaucaggaggcaccgcagcacuaggcugcuuaguaaaagacuacuucccagaaccaguaacaguaaguuggaauagcggagcccuaacuagcggaguacauacauuucccgcgguauuacaaagcuccggauuauacucacuaagcucaguaguaacaguaccaucaaguaguuuaggcacacaaacauauauaugcaacguaaaccacaaaccaucaaauacaaaaguagauaaaaaagucgaaccaaaaucaugugacaaaacacacaccugcccaccaugcccagccccagaacuucuaggugguccaucaguauuccuauuuccaccaaaaccaaaagacacccuaaugauauccagaaccccugaaguaacaugcguaguuguagacguaagccaugaagacccagaaguuaaauuuaacugguauguugacggaguagaaguacauaaugcaaaaacuaaaccuagagaagaacaauacaauucaacauauagaguaguaucaguauuaacaguacuccaucaagacuggcuaaacgguaaagaauacaaaugcaaaguaaguaacaaagcauuaccugccccaauugaaaaaacgauaucaaaggcaaagggccaaccuagggaaccacaaguauacacauuaccaccaaguagagaagaaaugacaaaaaaccaaguaucacuaacuugcuuagugaaaggauucuacccaagugacauagcaguagaaugggaaagcaacggucaaccagaaaauaauuacaaaaccacuccaccuguacuagacagcgacggauccuucuuuuuauacaguaaauuaacaguagacaaaucaagauggcaacaaggaaacguauucuccuguaguguaaugcaugaagcucuacauaaucauuacacacaaaaaucacuaucauuaaguccaggaaaa

SEQ ID NO: 46037 - RNA, 657 nt, Artificial Sequence
  derived and/or modified sequence opt6 from Dacetuzumab_LightChain1
gacauacaaaugacacaaucaccaucaucacuaucagcaucaguaggagaccgaguaacaauuaccugcagaucaucacaaucacuaguacacucaaacggaaacacauucuuacauugguaccaacaaaaaccaggaaaagcaccgaaacuacuaauauacacaguaucaaacagauucucuggcguaccaucaagauuuucaggauccggauccggaacagacuucacacucacaauauccucacuccaaccagaagacuucgcaacauacuucugcucccaaacaacacacguaccauggacauucggacaaggaaccaaaguagaaauaaaaagaacaguagcagcaccauccguauucauauucccaccauccgacgaacaacuaaaaucaggaacagcuucaguuguaugccuauuaaauaacuucuacccaagagaagcaaaaguacaauggaaaguagacaacgcauuacaauccggaaacucacaagaaucaguaacagaacaagacucaaaagauucaacauacucauuaucaucaacacuaacacuaagcaaagcagacuacgaaaaacacaaaguauacgcaugcgaaguaacacaccaaggauuaucaucaccaguaacaaaaucauucaacagaggagaaugc

SEQ ID NO: 46038 - RNA, 318 nt, Artificial Sequence
  derived and/or modified sequence opt6 from Dacliximab_LightChain_VJ-Region
gacauacaaaugacacaaucaccaucaacacuaucagcaucaguaggagacagaguaacaauaacaugcucagcaucaucaucaauaucauacaugcacugguaccaacaaaaaccaggaaaagcaccaaaauuacuaauauacacaacaucaaaccuagcaucaggaguaccagcaagauucucaggaucaggaucaggaacagaauucacacuaacaauaucaucacuacaaccagacgacuucgcaacauacuacugccaccaaagaucaacauacccacuaacauucggacaaggaacaaaaguagaaguaaaa

SEQ ID NO: 46039 - RNA, 348 nt, Artificial Sequence
  derived and/or modified sequence opt6 from Dacliximab_gamma2-Chain_VDJ-Region
caaguacaauuaguacaaagcggagcagaaguaaaaaaaccaggaucaagcguaaaaguaagcuguaaagcaagcggauacacauucacaagcuauagaaugcacuggguaagacaagcaccaggacaaggacuagaauggauaggauauauaaauccaucaacaggauauacagaauauaaccaaaaauuuaaagauaaagcaacaauaacagcagacgaaagcacaaacacagcauauauggaacuaucaagcuuaagaucagaagauacagcaguauauuacugugcaagaggaggaggaguauucgauuacuggggacaaggaacacuaguaacaguaagcuca

SEQ ID NO: 46040 - RNA, 1326 nt, Artificial Sequence
  derived and/or modified sequence opt6 from Daclizumab_HeavyChain
caagugcaacuaguacaaaguggugcagaaguaaaaaaacccggaucaucaguaaaaguaaguuguaaagcaucagguuacacauucacaagcuacagaaugcauuggguaagacaagcuccaggacaagguuuagaauggaucgguuauauuaauccaucaacaggauacacagaauacaaccaaaaauucaaagauaaagcgacaaucacagcagacgaaucaacuaacacugcauauauggaacuaucaucacucagaagcgaagacacagcaguuuacuacugugcaagaggagguggugucuucgauuacuggggccaaggcacaacacuaacagucagcaguggcccaucaguuuuuccacuagcaccaucaucaaaaagcacaagcggaggaacagcagcacuagguuguuuaguaaaagauuauuuuccugaaccaguuacagugucuuggaauagcggagcauuaacaucaggaguacacacauuuccagcaguauuacaaucuucuggccuauacucccuauccucaguuguaacaguaccaagcucaagccuaggaacacaaacauauauauguaauguaaaucacaaacccucaaauaccaaaguagacaaaaaagcagaaccaaaauccugcgacaaaacacacacaugcccaccaugcccagcaccugaguuacuaggaggaccaucaguuuuccuauuuccaccaaaaccaaaagacacacuaaugauaucacgaacacccgaaguaacuuguguaguaguagauguaucccacgaagacccugaaguaaaauucaacugguacguagauggcguagaaguacauaaugcaaaaacaaaaccacgagaagaacaauacaauucuacauacagaguaguuucaguucuaacaguccuacaccaagacuggcuaaauggaaaagaauauaaaugcaaaguaucaaauaaagcucuaccagcaccgauagaaaaaacaauaucuaaagcaaaaggccaaccaagagaaccacaaguauacaccuuaccaccaucaagagaugaacucacgaaaaaccaaguaucauuaacaugccucguaaaaggauucuauccaucagacauagccguagaaugggaaucaaacggacaaccagaaaacaacuauaaaacuacaccaccaguacucgauuccgauggaucauucuuccuuuacucaaaacuaacaguagauaaaucaagauggcaacaaggcaacguauuuucauguaguguaaugcaugaagcauuacacaaucauuacacacaaaaaagccuuucacuaucaccagguaaa

SEQ ID NO: 46041 - RNA, 630 nt, Artificial Sequence
  derived and/or modified sequence opt6 from Daclizumab_LightChain
gacauccaaaugacacaaucuccaucaacacuaucagcaucagucggagacagaguaacaauaacaugcucagcaucaucaucaauaucauacaugcacugguaccaacaaaaaccaggcaaagcacccaaacuacuaauauauacaacaucuaacuuagcaucaggaguuccagcaagauucucaggcucaggaucaggaacagaauucacacuaacaauaucaucauuacaacccgaugacuucgcaacauacuacugccaccaaagaucaacauacccccuaacauucggaucaggaacaaaaguagaaguaaaaagaaccguagcagcaccaucaguauucauauucccaccaucagacgaacaacuaaaaucaggaacagcaucagucguaugccuauuaaauaacuucuacccaagagaagcaaaaguacaauggaaaguagauaacgcacuacaauccggaaauucacaagaaucuguaacagaacaagacuccaaagauucaacauacucacuauccucaacacuaacacuauccaaagcagacuacgaaaaacacaaaguauacgcaugcgaaguaacacaucaaggacuaucaucaccaguaaccaaaucauucaacaga

SEQ ID NO: 46042 - RNA, 1341 nt, Artificial Sequence
  derived and/or modified sequence opt6 from Dalotuzumab_HeavyChain1
caaguacaauuacaacaaaguggaccaggauuagucaaaccuucacaaacucuaucucuaacaugcacaguaucaggauggucaaucucagguggcuggcuauggaauuggauaagacaaccuccaggaaaaggacuucaauggauaggauggauauccugggacggaacaaacaacuggaaaccaucccuuaaagauagaguaacaauauccguagacacaucaaaaaaucaauucucuuuaaaacuuucaaguguaacagcagcugacacagccguaugguggugugcacgaugggguagaguauuuuucgauugguggggucaagguacacucguaacagucaguagugcuucaaccaaaggcccauccguauucccauuagcccccuccucaaaaucaacaucaggaggaacagcagcucuaggaugucuaguuaaagacuacuucccagaaccaguaacaguaucauggaacucaggagcauuaacaucaggaguacacacauuucccgcaguuuuacaaucaucaggacuauacucacuaucaucuguagucacaguaccaucaucuucuuuaggaacacaaacauacauaugcaacgugaaucauaaaccaucaaauacaaaagucgauaaaagaguagaaccaaaauccugugacaaaacccauacuugcccaccauguccagccccagaacuacuaggaggaccaucaguuuuccuauucccaccaaaaccaaaagacacccuaaugauaucaagaacaccagaaguaacauguguagucguagauguaucacacgaggacccagaagucaaauucaauugguauguagauggaguagaaguacacaaugcaaaaacaaaaccaagagaagaacaauauaacucuacauauagaguaguaucagucuuaaccguucuacaucaagacugguuaaauggcaaagaauacaaaugcaaaguuucaaauaaagcuuuaccugcaccaauugaaaaaacaauaucuaaagccaaaggacaacccagagaaccacaaguuuauacauuaccaccuucaagagaagaaaugacaaaaaaccaagucucacuaacaugucuagucaaaggauucuauccaucagauauagcaguagagugggaaucaaacggacaaccagaaaacaacuacaaaaccacaccccccguuuuagacucagacggaaguuucuuucuuuacucaaaacuuacaguagauaaaucaagauggcaacaaggcaauguauucucaugcagcgucaugcacgaagcauuacacaaucacuacacccaaaaaucuuuaucacuaucaccaggaaaa

SEQ ID NO: 46043 - RNA, 657 nt, Artificial Sequence
  derived and/or modified sequence opt6 from Dalotuzumab_LightChain1
gauauaguaaugacacaauccccauuaucauuaccaguaacaccuggacaaccagccucaauaucaugcagaucaucacaaucaauaguacacucaaacggaaauacaugguuacaaugguggcuacaaaaaccaggacaaucaccacaacuacuaauauggaaaguaucaaacagacuauggggaguaccagacagauucucaggaucaggaucaggaacagacuucacacucaaaauaucaagaguccaagcucaagauguaggaguaugguggugcuuccaaggaucacacguacccuggaccuucggacaaggaacaaaaguacaaauaaaacgaacagucgcagccccaucaguauuuauauucccacccucagacgaacaacuaaaaucaggaacagcaucaguaguaugccuacuaaacaacuucuacccaagagaagcaaaaguacaauggaaaguagacaacgcacuacaaagcggaaacucacaagaaucaguaacagaacaagacucaaaagacucaacauacucauuaucaucaacacuaacacuaucaaaagccgacuacgaaaaacacaaaguauacgcaugcgaaguaacacaucaaggacuaucaucaccaguaacaaaaucauucaacagaggagaaugu

SEQ ID NO: 46044 - RNA, 687 nt, Artificial Sequence
  derived and/or modified sequence opt6 from Dapirolizumab_pegol_HeavyChain1
gaaguacaauuaguagaaaguggaggaggacuaguacaaccaggaggaagucuacgauuaagcugugcaguaucaggauucucaagcacaaauuaucacguacacuggguaagacaagcaccaggaaaaggauuagaauggaugggaguaauauggggagacggagauacaucauacaauagcguauuaaaaaguagauucacaauaucacgagauacaucaaaaaauacaguauacuuacaaaugaacucauuaagagcagaagacacagccguauauuauugcgcaagacaacuaacacauuauuacguauuagcagcauggggacaaggaacucucguaacaguaaguucagcaucaacuaaaggaccaaguguguucccacuagcacccucaagcaaaagcacaaguggaggaacagccgcauuaggaugucuaguaaaagacuauuucccagaaccaguaacaguaucauggaauagcggagcauuaacaucaggcguacacacauucccagcaguacuacaaagcucaggccuauacucauuaucaagcguaguaacaguaccuaguucaagcuuaggaacgcaaacauacauauguaauguaaaucacaaaccuucaaacacaaaaguagauaaaaaaguagaaccaaaaucaugcgauaaaacacacacaugcgcagca

SEQ ID NO: 46045 - RNA, 642 nt, Artificial Sequence
  derived and/or modified sequence opt6 from Dapirolizumab_pegol_LightChain1
gauauacaaaugacacaaucacccucaucacuaucagcaucaguaggagacagaguaaccaucacaugcagagcaucagaagaccuauacuacaaucuagcaugguaccaaagaaaaccaggaaaagcaccaaaacuacuaauauacgacacauacagauuagcagauggaguaccaagcagauucucaggaucaggaucaggaacagacuacacauuaacaauaagcucacuacaaccagaagacuucgcaucauacuacugccaacaauacuacaaauucccauucacauuuggacaaggaacaaaaguagaaauaaaaagaacaguagcagcaccauccguauucauauuccccccaucagacgaacaacuaaaaucaggcacagcaucaguaguaugcuuacuaaacaacuuuuacccaagagaagcaaaaguacaauggaaaguagacaacgcauuacaaucagguaacucacaagaaucaguaacagaacaagacucaaaagacucaacauacucacuaucaucaacauuaacacuaagcaaagcagacuacgaaaaacacaaaguauacgcaugcgaagucacacaccaaggauuaucaucaccaguaacaaaaucauucaacagaggagaaugc

SEQ ID NO: 46046 - RNA, 1356 nt, Artificial Sequence
  derived and/or modified sequence opt6 from Daratumumab_HeavyChain1
gaaguacaauuacuagaaucaggcggaggacuaguacaaccaggaggaucccuaagauuaucaugugccguaucugguuucacauucaauucauuugcaaugucauggguaagacaagccccagguaaaggcuuagaauggguaagcgcaauuucaggaucuggaggaggaacuuacuaugcagacucaguaaaaggaagauuuaccauaucacgcgacaauucaaaaaacacuuuauacuuacaaaugaauucauuacgcgcagaagacacagcaguauauuucugugcaaaagacaaaauauuaugguucggagaaccuguauucgauuacuggggucaaggaacauuaguaacagucucaucagcuucaacaaaaggaccaucuguauuuccauuagcaccuucauccaaaucuacaucagguggaacugcagcauuaggauguuuagucaaagauuauuucccagaaccuguaacuguaucauggaauucaggcgcacuuacuucaggcguccacacauucccagcaguccuacaaucauccgguuuauacucccuaucaucaguaguaacgguuccuucaucuucacuaggaacacaaacuuacauauguaaugucaaucacaaaccaucaaacacaaaaguugauaaaagaguagaaccuaaaucaugugauaaaacacacacuugcccaccauguccagcaccagaacuacuugguggcccaucaguuuuucuauucccaccaaaaccaaaagauacacuaaugauaagcagaacaccagaaguaacauguguaguaguagacguuucacacgaagaucccgaaguaaaauucaauugguacguugacggaguagaaguacauaacgcaaaaaccaaaccacgagaagaacaauauaauucaacauaccgaguaguaucaguccuaacaguauugcaucaagauugguuaaacgguaaagaauauaaauguaaagucucaaacaaagcacuaccagcaccuauagaaaaaacaaucucuaaagccaaaggacaacccagagaaccucaagucuacacauuaccaccaaguagagaagaaaugacaaagaaucaaguaucauuaacuugucuugucaaagguuuuuaucccucugacauugcaguagaaugggaaucaaauggacaaccugaaaacaauuauaaaacuacuccccccguuuuagacagugacggaucuuuuuuucuauacucgaaacuaacaguagacaaaucuagauggcaacaagguaauguauuuucuuguucaguuaugcaugaagcauuacauaaccauuacacacaaaaaucauuaucauuaucaccuggaaaa

SEQ ID NO: 46047 - RNA, 642 nt, Artificial Sequence
  derived and/or modified sequence opt6 from Daratumumab_LightChain1
gaaauaguauuaacacaaucaccagcaacauuaucauuaucaccaggagaaagagcaacauuaucaugcagagcaucacaaagcguaucaucauaccuagcaugguaccaacaaaaaccaggacaagcaccaagauuauuaauauacgaugcaucaaauagagcaacaggaauaccagccagauucucaggcucaggaucaggaacagacuucacccuaacaauaucaucacuagaaccagaagacuucgcaguauauuacugccaacaaagaucaaacuggccaccaacauucggacaaggaacaaaaguagaaaucaaaagaacaguagcagcaccaucuguauucauauucccaccaucagacgaacaacuaaaaucaggaacagccucuguaguaugccuacuaaacaacuucuacccaagagaagcaaaaguacaauggaaaguagacaacgcacuacaaagcggaaacucacaagaaucaguaacagaacaagauucaaaagacucaaccuacucacuaaguucaacacuaacauuaagcaaagcagacuacgaaaaacauaaaguauacgcaugcgaaguaacacaccaaggauuaucaucucccguaaccaaaucauucaacagaggagaaugc

SEQ ID NO: 46048 - RNA, 1350 nt, Artificial Sequence
  derived and/or modified sequence opt6 from Dectrekumab_HeavyChain1
gaaguucaacuagucgaaucaggcgguggaguaguacaaccaggcagaucccuaagacuaucaugcgcagcaucagguuucacauuuucaagcuacggaaugcauuggguacgacaagcaccaggaaagggauuagaauggguagcuaucauaugguacgacgguucuaacaaauauuacgcugacucuguaaaaggacgauucacaauaucaagagacaauucaaaaaacacauuauauuuacaaaugaacucacuaagagccgaagacacagcaguauacuacugcgcacgcuuaugguucggagacuuagacgcauucgauauauggggacaaggaacaaugguaacagucucauccgcaucaacaaaaggaccaucuguauucccauuagcaccuuccuccaaaucaaccucagguggaacagcagcacucggaugccuaguaaaagacuacuuucccgaaccuguaacaguaucauggaacucaggagcacuaacuagcggcguccacaccuuuccagcuguacuacaaucaucuggucuauauucacuaaguucaguagucacaguaccauccucaucacuaggaacucaaaccuauauaugcaacguaaaccacaaaccauccaacaccaaagucgauaaaagagucgaaccaaaaucaugcgacaaaacacauacaugcccacccugcccagcaccagaacuacuuggagguccaucagucuuuuuauucccuccaaaaccaaaagacacucuaaugauauccagaacuccagaaguaacuugcguagucguagacguuagccacgaagaucccgaaguaaaauuuaacugguacgucgacggaguagaaguacacaaugcaaaaacaaaacccagagaagaacaauacaauucaaccuacagaguaguaucaguauuaaccguauuacaucaagacugguuaaauggaaaagaauacaaaugcaaaguaucaaauaaagcauuaccagcaccaauagaaaaaacaauauccaaagccaaaggccaaccacgagaaccacaaguauauacauuaccaccuucaagagaagaaaugaccaaaaaccaaguaagccucacuugcuuaguaaaaggauucuauccaucagacauagcaguagaaugggaauccaacggacaaccagaaaacaauuacaaaacaacucccccaguacuugacucugacggaucauuuuuccucuacucaaaacuaaccguagacaaaucaagauggcaacaaggaaauguauucagcugcucuguaaugcacgaagcauuacacaaucacuacacucaaaaaucccuaucauuaucaccaggcaaa

SEQ ID NO: 46049 - RNA, 648 nt, Artificial Sequence
  derived and/or modified sequence opt6 from Dectrekumab_LightChain1
gaaauaguauuaacacaaucaccagcaacacuaagccuaucaccaggagaacgagcaaucuuaucauguagagcaggacaaucaguaucaucuuacuuagucugguaccaacaaaaacccggacaagcaccaagacuacuaauauaugacgcaagcaaccgagcaacaggaauaccugcaagauucucaggaucaggcucagguacagacuuuacauuaacaauaucaucacuagaaccagaagacuuugccguauacuacugccaacaaagaagcucauggccaccaguuuacacauucggacaaggaaccaaacuagaaauaaaacgaacaguagcagcaccaagcguauucauauucccaccaucagacgaacaauuaaaaucaggaacagcaucaguaguaugcuuacuaaauaacuuuuacccaagagaagcaaaaguacaauggaaaguagauaacgcacuacaaagcggaaacucacaagaaagcguuacagaacaagacucaaaagacucaacauauagccuaucaucaacauuaacacuaucaaaagccgauuacgaaaaacacaaaguauacgccugugaaguaacacaccaaggcuuaagcucaccaguaaccaaaucauucaacagaggcgaaugc

SEQ ID NO: 46050 - RNA, 1332 nt, Artificial Sequence
  derived and/or modified sequence opt6 from Demcizumab_HeavyChain1
caaguacaauuaguacaauccggagcagaaguaaaaaaaccaggagcaucuguaaaaauaaguuguaaagcaucuggauacucauucacagcauauuacauacacugggucaaacaagcaccaggacaaggauuagaauggauaggauacauaucaagcuacaacggagccacuaauuacaaccaaaaauucaaagguagaguaacuuucacaaccgacacaucaaccucuacagccuauauggaauuaagaucucuacgaucagacgacacagcaguauauuacugugcaagagacuacgacuacgacguuggaauggacuacuggggacaaggaacauuagucacaguaucaucagcaucaaccaaaggaccaucaguauuuccacuagcacccugcuccagaucaacaucugaaucaacagcagcucucggaugccuaguaaaagacuacuucccugaaccaguaacagucucauggaauuccggugcacuaacaucaggaguccacaccuucccagcaguucuacaaucaucaggauuauacucacuuucaucaguaguaaccgucccauccucaaacuucggaacacaaacauauacuugcaacgucgaucauaaaccaucaaauacuaaaguugauaaaaccguagaacgcaaauguugcguagaaugcccuccaugccccgcaccuccaguagcaggaccaucagucuuccuauucccaccuaaaccaaaagacacacuaaugaucucaagaaccccagaagucaccuguguaguuguugacguaucacacgaagacccagaaguacaauucaacugguacguagacggcguagaaguacacaacgcaaaaacaaaaccaagagaagaacaauucaauucuacuuucagaguaguaucaguauuaacaguaguacaccaagauugguuaaacgguaaagaauacaaaugcaaagucuccaacaaaggccuaccagcgccaauagaaaaaacuauaucaaaaacuaaaggucaaccaagagaaccacaaguauacacauuaccaccaucaagagaagaaaugacaaaaaaccaagucuccuuaacuuguuuaguaaaaggauucuaccccucagauauagcagucgaaugggaauccaacggccaaccugaaaacaauuacaaaaccacaccaccaauguuagauucagacggaucuuucuucuuauacagcaaacuaacagucgacaaaucaagauggcaacaaggaaauguauucucuugcucaguaaugcacgaagcauuacacaaccacuacacacaaaaaucucuauccuuaucucccgga

SEQ ID NO: 46051 - RNA, 654 nt, Artificial Sequence
  derived and/or modified sequence opt6 from Demcizumab_LightChain1
gauauaguaaugacacaaucaccugauaguuuagcaguaagccuaggagaaagagcaacaauaagcuguagagcaagugaaagcguagacaauuacggaauaucauucaugaaaugguuccaacaaaaaccaggacaaccaccaaaacuauuaauauaugcagcaagcaaucaaggaucaggaguaccagacagauucucaggaucaggaucaggaacagacuuuacauuaacaauaagcucauuacaagcagaagacguagcaguauacuauugccaacaaucaaaagaaguaccauggacauucggaggaggaacaaaaguagaaauaaaaagaacgguagcagcaccaagcguauucauauucccaccaucagacgaacaauuaaaaucaggaacagcaucaguaguaugcuuacuaaauaacuuuuacccaagagaagccaaaguucaauggaaaguagauaacgcacuacaaagcggaaacucacaagaaaguguaaccgaacaagacaguaaagacucaacauauagcuuaagcucaacauuaacauuaagcaaagcagauuacgaaaaacauaaaguauacgcaugugaaguaacacaccaaggacuaagcucaccaguaaccaaaagcuuuaacagaggagaaugc

SEQ ID NO: 46052 - RNA, 1350 nt, Artificial Sequence
  derived and/or modified sequence opt6 from Denintuzumab_mafodotin_HeavyChain1
caaguucaacuacaagaaucaggacccggauuaguaaaaccaucccaaacacuauccuuaacuugcacuguauccggaggauccauaaguacaucaggaaugggaguaggauggauaagacaacacccaggcaaaggacuagaauggauaggacacauauggugggaugacgauaaaagauacaauccugcacuaaaaucaagaguaacaauaucaguugacacaagcaaaaaccaauuuucuuuaaaacuaucaucuguaacagcagcagacacagcagucuauuacugcgcaagaauggaauuauggucauacuacuucgacuacuggggccaaggcacuuuagucacaguuagcucagcaucaaccaaaggaccauccguauucccacucgcaccaucauccaaaagcacaucuggaggaaccgccgcacuaggaugccuaguuaaagacuacuuuccagaaccagucacugucucauggaauaguggagcacuaacaucuggaguacauacauuccccgccguacuacaaucaucaggccuauacucauuaagcucaguaguaacaguaccaucaucauccuuaggaacacaaacauacauauguaacgucaaucacaaaccaucaaacacaaaaguagacaaaaaaguagaaccaaaaucaugcgauaaaacacacacaugucccccauguccagcaccagaacuccuaggaggaccauccguauuccuauuuccuccuaaacccaaagauacauuaaugauauccagaacaccagaagucacaugcguaguaguugacguaucccaugaagacccagaaguaaaauucaacugguacguagacggaguagaaguacacaaugccaaaacaaaaccaagagaagaacaauacaauagcacauaucgaguaguaucaguauuaacaguauuacaucaggacuggcuaaaugguaaagaauacaaauguaaagucucaaacaaagcccuaccagccccaauagaaaaaaccauaagcaaagcaaaaggacaaccaagagaaccucaaguauauacacuaccaccuuccagagaugaauuaacaaaaaaccaagucaguuuaacaugucucguaaaaggauuuuaccccucagacauagccguagaaugggaaucaaacggacaacccgaaaauaacuacaaaacaacaccaccaguucuagauucugacggaucauucuuucuuuacuccaaacuaacagucgauaaaucaagauggcaacaaggaaauguauuuuccugcagcguaaugcaugaagcacuacauaaucacuauacacaaaaaucauuaucccuaucaccagguaaa

SEQ ID NO: 46053 - RNA, 639 nt, Artificial Sequence
  derived and/or modified sequence opt6 from Denintuzumab_mafodotin_LightChain1
gaaauaguacuaacacaaucaccagcaacauuaucacuaucaccaggagaaagagcaacacuuucaugcucagccuccucaucaguaucauacaugcacugguaccaacaaaaacccggacaagcaccacgacuacuaauauacgacacaucaaaauuagcaucaggaauaccagcaagauucucaggaucagguucaggaacagacuucacacuaacaauaucaucacuugaaccagaagacguagcaguauacuacugcuuccaaggaucaguauacccauucacauuuggacaaggaacaaaacuagaaauaaaaagaacaguagcagcaccaucaguauucauauuuccacccucagacgaacaacuaaaaucagguacagcaucaguaguaugccuacuaaacaacuucuacccaagagaagcaaaaguucaauggaaaguagacaacgcacuacaaucaggaaacucacaagaauccguaaccgaacaagacucaaaagacuccacauacucccuaucaucaacacuaacacuaucaaaagcagacuacgaaaaacacaaaguauacgcaugcgaaguaacacaucaaggacuaucaucaccaguaacaaaaucauucaaccgaggagaaugu

SEQ ID NO: 46054 - RNA, 1356 nt, Artificial Sequence
  derived and/or modified sequence opt6 from Denosumab_HeavyChain
gaaguccaacuuuuagaaucagguggcggacuaguacaaccaggaggaagccuaagacuaucuugugcagcuucaggauuuacauuuuccucauacgcuauguccuggguaagacaagcacccggaaaaggauuagaauggguaucaggaaucacagguucuggaggaucaacauacuacgcagauagcguaaaaggacguuucacaauauccagagacaacucaaaaaacacccuauaucuccaaaugaauuccuuaagagcagaagauacagccguauauuacugcgcaaaagacccaggcacuacaguaauaaugaguugguuugaccccuggggacaagggacauuaguuaccguaucaucagcauccacaaaaggucccucaguuuucccacuagcaccaucaucaaaaucaacaucaggcggaacagcagcauuaggaugcuuaguaaaagacuauuuuccagaaccaguaacaguaucauggaacucaggagcauuaacauccggcguacauacauuccccgcaguauuacaaucaucuggucuuuacucacucucaucaguaguaacuguaccaucauccucauuaggaacacaaaccuacauauguaauguaaaccauaaacccucaaacacuaaaguagacaaaaaaguagaacccaaaucuugugauaaaacucacacaugcccacccugcccagcccccgaacuauuaggagguccuucaguauuccucuucccaccaaaaccaaaagauacauuaaugauaucacgaacaccagaaguaaccugcguaguaguagacguaucacacgaagauccagaagucaaauuuaacugguauguagacggaguagaaguacacaaugcuaaaaccaaaccaagagaagaacaauacaacucuacauacagaguuguaucaguacuaaccguacuccaccaagacuggcuaaacggaaaagaauacaaauguaaaguaucaaacaaagcacuaccagcaccaauagaaaaaaccauaucaaaagcaaaaggacaaccacgagaaccccaaguauauacccuaccuccaucacgagacgaacuaaccaaaaaucaagucagccuaacaugucuaguuaaagguuucuaucccucagacauagcuguagaaugggaauccaauggccaaccagaaaacaacuacaaaacaacaccaccagucuuagauucagacggcucauucuucuuauauucaaaauuaacaguagauaaaucucgauggcaacaaggcaauguauucucauguucuguuaugcacgaagcacuacacaaccauuauacacaaaaaagucuaucauuauccccaggaaaa

SEQ ID NO: 46055 - RNA, 645 nt, Artificial Sequence
  derived and/or modified sequence opt6 from Denosumab_LightChain
gaaauaguacuaacacaaucaccagguacauuaucacuaucaccaggagaaagagcaacacuaucaugcagagcaucacaauccguaagaggaagauaccuagccugguaccaacaaaaaccaggacaagcaccaagacuacuaauauacggagcaucaucacgagccacaggaauaccagacagauuuucaggaucaggaucaggaacagacuucacacuaaccauaucaagacuagaaccagaagacuucgcaguauucuacugccaacaauacggaucaagcccaagaacauucggccaaggaacaaaaguagaaauaaaaagaacaguagcagcaccaucaguauucauauuuccaccaucagacgaacaacuaaaaucaggaacagcaucaguaguaugcuuacuaaacaacuucuacccaagagaagcaaaaguacaauggaaaguagacaacgcacuacaaucaggaaacucacaagaaucaguaaccgaacaagacucaaaagacucaacauacucacuauccuccacauuaaccuuaucaaaagcagauuacgaaaaacacaaaguauacgcaugcgaaguaacacaccaaggcuuaagcucacccguaacaaaaucauucaacagaggagaaugc

SEQ ID NO: 46056 - RNA, 1338 nt, Artificial Sequence
  derived and/or modified sequence opt6 from Depatuxizumab_HeavyChain1
caaguacaacuacaagaaucaggaccaggacucguuaaaccaagccaaacauuaucacuaacaugcacaguuaguggcuauucaauaaguucugauuucgcauggaauuggauacgucaaccacccggaaaaggacuagaauggaugggauacauaucuuacucaggaaauacaagauaccaaccaagccuaaaaucuagaauaaccauaucaagagacaccucaaaaaaucaauucuuccuaaaacuaaacuccguaacagcagccgacacagccacuuacuauugcguuacagcaggaagaggauucccauauuggggacaaggaacauuaguaacgguauccucugcaucuacaaaaggaccauccgucuucccuuuagcaccaucuuccaaaucaacaucaggaggaacagccgcccucgguugccuaguaaaagacuacuucccagaaccagucacaguauccuggaauucaggagcacuaaccaguggaguccauacauuccccgcuguacuacaaagcucaggacuauauuccuuaucauccguaguaacuguaccaucauccucacuaggaacacaaacauauauauguaacguaaaucacaagcccucaaacaccaaaguugacaaaaaaguagaacccaaaucuugcgauaaaacacacacaugccccccaugucccgcaccagaacuacuaggaggaccaucaguauuucucuuuccaccaaaaccuaaagacacacuaaugaucucaagaacaccugaaguaacaugcguaguugucgaugucucacacgaagauccagaaguaaaauucaacugguauguagauggagucgaaguacauaacgcuaaaacaaaaccaagagaagaacaauacaacucaaccuaccgaguagucucaguacuaacuguauuacaucaagacugguuaaacggcaaagaauacaaaugcaaaguaucaaauaaagcauuaccagcuccaauagaaaaaacaauaucaaaagcaaaaggacaaccuagagaaccccaaguauacaccuuaccaccaucaagagacgaauuaacuaaaaaucaaguaaguuuaacaugccuaguaaaaggauucuacccaagcgauauagcaguagaaugggaauccaacggacaaccagaaaacaauuacaaaacaacacccccuguacuagacagcgauggaucguuuuucuuauauucaaaacuaacuguagauaaaucaagauggcaacaaggaaacguauucuccuguucaguaaugcaugaagcacuucacaaucauuacacacaaaaaucacuaucuuuaucaccaggaaaa

SEQ ID NO: 46057 - RNA, 642 nt, Artificial Sequence
  derived and/or modified sequence opt6 from Depatuxizumab_LightChain1
gauauacaaaugacacaaucacccucauccaugucaguaagcguaggagaccgaguaacaauaacaugccacucaagucaagacauaaacucaaacauaggauggcuacaacaaaaaccaggaaaaucauucaaaggacuaauauaccacggaacaaaccuagacgacggagucccaucaagauucucaggaucuggaucaggaacagacuacacacuaacaauaucaucacuacaaccagaagacuucgcaacauacuacugcguacaauacgcacaauucccauggacauucggcggaggaacaaaacuagaaauaaaaagaacaguagcagcaccaucagucuucauauucccaccaucugacgaacaacuaaaaucaggcacagcuucaguagucugccuauuaaacaacuucuauccaagagaagcaaaaguacaauggaaaguagauaacgcacuacaauccggaaacucacaagaaucaguaacagaacaagacucaaaagacucaacauacucacuaucaucaacacuaacauuaagcaaagcagacuacgaaaaacauaaaguauacgcaugugaaguaacacaucaaggacuaucaucaccaguaacaaaaucauuuaauagaggagaaugc

SEQ ID NO: 46058 - RNA, 1338 nt, Artificial Sequence
  derived and/or modified sequence opt6 from Depatuxizumab_mafodotin_HeavyChain1
caaguccaacuucaagaaucaggaccaggauuaguaaaaccaucacaaacauuaucauuaacuugcaccguauccggauauucaauaucaucagacuucgcauggaauuggauaagacaaccacccggaaaaggacuagaauggaugggauacauaucuuauucuggaaauacacgauaccaaccaucauuaaaaucaagaauaacaauaucaagagacacgucuaaaaaccaauuuuuccucaaacuaaauuccgucacagcagcugauacagcaacauacuauugcguaacagcaggaagaggauuccccuacuggggacaaggaacacuaguaaccguaaguucagcaucaacaaaaggaccuagcguauucccauuagcaccaucaucuaaaucuacaucaggcggaacagccgcacuaggcugccucguuaaagacuacuucccagaacccgucacaguaagcuggaacuccggcgccuuaacaucagguguccacacuuuucccgcaguccugcaaagcucuggacuauacucauuauccucaguaguaaccguaccaaguuccucacuaggaacacaaacauacaucugcaacguaaaccacaaaccuuccaacacaaaaguugacaaaaaaguagaaccaaaauccugcgauaaaacacacacaugcccaccaugcccagcaccugaacuauuaggaggaccuucaguauuccuauucccuccaaaacccaaagacacucuuaugauaucacgaacaccagaaguuacauguguuguagucgacgucucacacgaagaccccgaaguaaaauucaacugguacguugacggaguagaaguccacaacgccaaaacaaaaccaagagaagaacaauauaauuccacauacagaguaguuaguguccucacagucuuacaccaagacuggcuaaacggaaaagaauacaaaugcaaaguaucaaacaaagccuuaccagccccaaucgaaaaaacaauauccaaagccaaaggacaaccaagagaaccucaaguauacacacuacccccaucuagagacgaacuaacaaaaaaccaaguaucauuaacauguuuaguaaaaggauucuacccuucagacauugcaguagaaugggaaagcaacggacaaccagaaaauaacuacaaaacaacuccaccaguauuagacuccgauggaucauucuuccuauauucaaaauuaacaguagacaaaucaagauggcaacaaggaaauguauuuucaugcagcguaaugcacgaagcacuacacaaucacuauacacaaaaaucauuaucacuaucaccuggaaaa

SEQ ID NO: 46059 - RNA, 642 nt, Artificial Sequence
  derived and/or modified sequence opt6 from Depatuxizumab_mafodotin_LightChain1
gacauacaaaugacacaaucaccaucaucaaugucaguauccguaggagacagaguaacaauaacaugccacucaucccaagacauaaacucaaacauaggauggcuacaacaaaaaccaggaaaaucauuuaaaggacuaauauaccacggcacaaaccuagacgacggagucccaucacgauucucaggaucaggcucaggaacagauuacacacuaacaauaucaucacuacaaccagaagacuucgcaacauacuacugcguacaauacgcacaauuuccauggacauucggaggcggaacaaaacuagaaauaaaacgaacaguagcagcaccauccguauucauauucccaccaucagacgaacaauuaaaaucaggaacagcaucaguaguaugcuuacuaaauaacuucuacccacgagaagcaaaaguacaauggaaaguagacaacgcacuacaaucaggaaacucacaagaaucaguaacagaacaagacuccaaagacuccacauacagcuuauccucaacacuaacacuaucaaaagcagacuacgaaaaacacaaaguauacgcaugcgaagucacacaccaaggccuaucaucaccaguaacaaaaucauucaacagaggagaaugc

SEQ ID NO: 46060 - RNA, 1329 nt, Artificial Sequence
  derived and/or modified sequence opt6 from Dinutuximab_beta_HeavyChain1
gaaguccaacuacuacaauccggaccagaauuagaaaaaccaggagccucaguaaugauaaguuguaaagcaagcggaucaucuuucacagguuauaacaugaacuggguaagacaaaacauaggaaaaucacuagaauggauaggagcaaucgacccauacuacgguggaacaagcuauaaccaaaaauucaaagguagagcaacacuaacugucgauaaaucaucgucaacugccuacaugcacuuaaaauccuuaaccucagaagacucagcaguauacuacugugucucaggaauggaauacuggggccaaggaacaaguguaacagucucuucagcaagcacuaaaggaccaucaguauuuccucuagcacccaguucaaaaucaacuucaggcggaacagcagcucucgguugcuuagugaaagacuacuuuccagaaccuguuacaguauccuggaauucaggagcacuaacaucuggaguacacacauucccagcugucuuacaaucuucagguuuauauucacuaucaucaguagucacaguaccuucauccucucuagguacccaaacauacaucugcaacguaaaucacaaaccuuccaauacaaaaguugacaaacgaguugaaccuaaaucaugugacaaaacccauacaugcccaccaugcccugccccagaauuacuaggugguccaucaguuuuccuauucccaccaaaaccaaaagacacacuaaugaucucaagaacuccagaaguaacaugcguagucgucgacguaucacaugaagauccagaaguaaaauucaacugguacguagauggaguagaaguacacaacgcaaaaacuaaaccaagagaagaacaguauaacucaaccuaccgaguaguaucaguauuaacaguacuacaccaagacuggcucaacggaaaagaauacaaaugcaaaguauccaacaaagcauuacccgcaccaauagaaaaaacaauaucaaaagcaaaaggacaacccagagaaccucaaguauacacauuaccaccuuccagagaagaaaugacaaaaaaccaagucucacuaacuugccucguaaaaggauucuacccuucagauauagcaguugaaugggaaucaaauggacaaccagaaaauaacuacaaaacaacaccaccuguacuagauagcgauggauccuucuuuuuauauucaaaacuaacagucgacaaaucaagauggcaacaaggcaacguauucucaugcucaguaaugcacgaagcauuacauaaccauuauacacaaaaaucacuaagccuaucacccggaaaa

SEQ ID NO: 46061 - RNA, 660 nt, Artificial Sequence
  derived and/or modified sequence opt6 from Dinutuximab_beta_LightChain1
gaaauaguaaugacacaaucaccagcaaccuuaucaguaaguccaggugaaagagcaacauuauccugcagaucaucacaaagcuuaguacaucgcaauggcaauacauaucuacauugguaucuacaaaaaccaggacaaucaccaaaauuacucauacacaaaguaucaaacagauucucaggaguaccagauagauuuucaggaagcggaagcggaacagacuucacacuaaaaauaucaagaguagaagcagaagaucucggaguauauuucuguagccaaucaacacacguaccaccacuaacauucggagcaggaacaaaacuagaacucaaacgaacaguagcagcaccaucaguauucauauucccaccaucugacgaacaacuaaaaucaggaacagcaucaguaguaugccuacuaaauaacuuuuacccacgagaagcaaaaguacaauggaaaguagauaacgcacuacaaagcggaaacucacaagaaucaguaacagaacaagacagcaaagacucaacauauucauuaucaucaacauuaacauuaucaaaagcagauuacgaaaaacauaaagucuacgcaugcgaaguaacacaccaaggauuaucaucaccaguaacaaaaucauuuaacaggggagaaugu

SEQ ID NO: 46062 - RNA, 1329 nt, Artificial Sequence
  derived and/or modified sequence opt6 from Dinutuximab_HeavyChain1
gaaguacaacuacuacaaucaggaccagaacuagaaaaaccaggcgcuucaguaaugauaucauguaaagcuucaggaucaagcuuuacaggauacaacaugaacuggguaagacaaaauauagguaaaucauuagaauggauaggagcaauagauccauacuacggaggcacaucauacaaucaaaaauucaaaggacgagcaacacuaacaguagauaaaucuaguucaacagcauauaugcacuuaaaaucauuaacaucugaagauagcgcaguuuacuacugcguaucuggaauggaauacuggggccaaggaacaagcguaacuguaucaucagcuucaacaaaaggaccaucaguauucccauuagcaccaucaucaaaaucaacaucaggaggaacagccgcucucggaugccuaguuaaagacuacuuuccagaaccaguuacaguaucauggaauucaggcgcuuuaacuucaggaguacacacauucccagcaguccuacaaucaucuggacuauacagcuuaucaucaguaguaacagucccgucuucaucacuaggaacacaaaccuauauauguaacguaaaccacaaaccuucaaacacaaaaguagacaaacgaguagaaccaaaaagcugcgacaaaacacauacauguccuccaugccccgcaccugaacuauuaggaggaccaucaguuuucuuauuuccaccaaaaccaaaagacaccuuaaugauaucaagaacaccagaaguaacaugcguuguuguagaugucucucacgaagaccccgaaguuaaauuuaacugguacguagacggaguagaaguccauaacgccaaaacaaaacccagagaagaacaguacaacucaacauaucgaguaguaucaguauuaacaguacuacaucaagauuggcuaaacggaaaagaauacaaaugcaaaguaucaaacaaagcuuuaccagcaccaauagaaaaaacaauaucaaaagccaaaggacaaccaagagaaccacaagucuacacacuaccaccaucacgagaagaaaugacgaaaaaccaaguaucacuaacaugccuaguaaaaggauuuuacccaucagacauagcagucgaaugggaaucaaacggacaaccagaaaacaacuacaaaacaacaccaccaguacuagauucagauggaucauucuuccuauacuccaaauuaacuguagacaaaucaagauggcaacaagguaacguauucuccugcuccguaaugcacgaagcccuacacaaccacuauacccaaaaaucuuuaucuuuaucaccaggaaaa

SEQ ID NO: 46063 - RNA, 660 nt, Artificial Sequence
  derived and/or modified sequence opt6 from Dinutuximab_LightChain1
gaaauaguaaugacacaaucaccagcaacauuaaguguaagcccaggagaaagagcaacacuaagcugccgcucaucacaaagccuaguacauagaaauggaaauacauaucuacauugguaucuccaaaaaccaggacaaucaccaaaacuauuaauacacaaaguaucuaacagauucucaggaguaccagauagauuuagcggaucaggaucaggaacugauuucacacuaaaaauaucacgaguagaagcugaagaucuaggaguauauuucuguagccaaucaacacacguaccaccacuaacauucggagcaggaaccaaacuagaacuaaaacgcacaguagcagcaccaucaguauucauauucccaccaucagacgaacaauuaaaaucaggaacagcauccguaguaugcuuacuaaauaacuuuuacccacgagaagcaaaaguacaauggaaagucgauaacgcacuacaaagcggaaacucacaagaaucaguaacagaacaagauucaaaagacucaacauauucacuaucaucaacauuaacacuaagcaaagcagauuacgaaaaacauaaaguauacgcaugcgaaguaacacaccaaggauuaucaucaccaguaacaaaaagcuuuaacagaggagaaugc

SEQ ID NO: 46064 - RNA, 660 nt, Artificial Sequence
  derived and/or modified sequence opt6 from Dinutuximab_LightChain
gaaauaguaaugacacaaucaccagcaacauuaucaguaucaccaggagaaagagcaacauuaagcuguagaucaucacaaucauuaguacauagaaacggaaacacauaucuacacugguaccuccaaaaaccaggacaaucaccaaaauuacuaauacacaaaguaucaaacagauucucaggcguaccagacagauucucaggaucaggcucaggaaccgacuucacacucaaaauaucaagaguagaagcagaagaucuaggaguauacuucuguagccaaucaacacacguaccaccacuaacauucggagcaggaacaaaacucgaacuaaaaagaacagucgcagcaccauccguauucauauucccaccaucagacgaacaacuaaaaucaggaacagcaucaguaguaugucuacuaaauaacuucuacccacgagaagcaaaaguacaauggaaaguagacaacgcauuacaauccggaaacucucaagaaagcguaacugaacaagacucaaaagacucaacauauucauuauccucaaccuuaacauuaaguaaagcagauuacgaaaaacauaaaguauacgcaugcgaaguaacacaccaaggauuaaguucacccguaacaaaaaguuucaacagaggagaaugc

SEQ ID NO: 46065 - RNA, 1350 nt, Artificial Sequence
  derived and/or modified sequence opt6 from Diridavumab_HeavyChain1
gaaguucaacucguagaauccggagccgaagucaaaaaaccagggaguuccgucaaaguuucauguaaagcaucaggaggaccauucagauccuaugcaauaucauggguaagacaagcaccaggacaaggaccagaauggaugggaggaauaauaccuauuuuuggaacaacaaaauacgccccaaaauuccaaggaagagucacaauuacagcagaugauuuugcuggaacaguauacauggaacuaucuucacuaagaucagaagacacagcaauguauuacugugcaaaacacaugggauaccaaguacgcgaaaccauggauguauggggaaaaggaacuacagucacaguuagcagcgcaucaacuaaaggcccauccguuuucccacuagcaccaucaucuaaauccaccucaggaggaacagcagcucuuggaugucuaguaaaagauuauuuuccagaaccuguaacaguaucauggaauucaggagcgcuaacaucagguguccauacauucccagcuguauuacaauccucaggacuauacucauuaucaucaguaguaacaguacccucaucaucacucggcacucaaacguacauaugcaauguaaaccacaaacccucaaauacaaaaguagacaaacguguugaaccaaaaucaugcgauaaaacacauacauguccacccuguccagccccugaauuauuaggaggaccaucaguuuuccuauucccaccaaaaccuaaagauacacuaaugauuagucgaacacccgaaguaacauguguaguaguagauguuucacaugaggauccagaaguuaaauuuaacugguauguugacggaguagaaguacauaaugccaaaacaaaaccaagagaagaacaauauaacucaacauauagagucguaucuguacuaacaguccuucaucaagauugguuaaauggaaaagaauauaaaugcaaaguuucaaacaaagcuuuaccagcacccauagaaaaaacaauuuccaaagcaaaaggccaaccaagagaaccacaaguauauacauuacccccaucaagggaagaaaugacaaaaaaucaagucucuuuaacauguuuaguuaaaggauuuuauccaucagacauagcaguagaaugggaaucuaauggucaaccugaaaacaacuauaaaacuaccccaccaguauuagauucugaugguucuuuuuuccucuauaguaaacuaaccguagauaaaucaagauggcaacaaggaaauguauucucaugcucuguaaugcaugaagcucuacauaaucacuacacacaaaaaucauuaagucuaucaccagga

SEQ ID NO: 46066 - RNA, 651 nt, Artificial Sequence
  derived and/or modified sequence opt6 from Diridavumab_LightChain1
caaucaguacuaacacaaccaccaagcguaucagcagcaccaggacaaaaaguaacaauaucaugcucaggaucaucaucaaacaucggaaacgacuacguaucaugguaccaacaacucccaggaacagcaccaaaauuacuaauauacgacaacaacaaaagaccaucaggaauaccagacagauucucaggaucaaaauccggaaccucagcaacacuaggaauaacaggacuacaaacaggcgacgaagcaaauuacuacugcgcaacaugggacagacgaccaacagcauacguaguauucggaggaggaacaaaacuaacaguacuaggacaaccaaaagcagcaccaucagucacacuauucccaccaucaucagaagaacuacaagcaaacaaagcaacauuaguaugccuaauaucagacuuuuacccaggcgcaguaacaguugcauggaaagccgacucaucaccaguaaaagcaggaguagaaacaacaacaccaucaaaacaaucaaacaacaaauacgcagcaucauccuaccuaucacuaacaccagaacaauggaaaucacacagauccuacucaugccaaguaacacacgaaggaucaacaguagaaaaaacaguagcaccaacagaaugcuca

SEQ ID NO: 46067 - RNA, 1338 nt, Artificial Sequence
  derived and/or modified sequence opt6 from Domagrozumab_HeavyChain1
gaaguucaacuccuagaaucaggcggaggucuaguacaaccaggaggauccuuaagauuaaguugcgcagccuccggauucacauucucuucuuacgcaaugucauggguacgacaagcuccuggaaaaggauuagaauggguaucaacuauuucaucaggaggcuccuacacgucuuaccccgacucuguaaaaggucgauuuacaauaucacgagauaauucaaaaaacacacuauaucuacaaaugaacucccuaagagcagaagacacagcaguauacuacugcgcaaaacaagacuacgcaaugaacuacuggggacaaggaacauuaguaacaguauccucagcaucuacaaaaggaccaucaguauuuccauuagcaccaucaucaaaauccacaagugguggaaccgcugcacuuggaugccuuguaaaagacuauuucccagaaccagucaccguaucauggaacucaggcgcuuuaacuucaggaguacacaccuucccagcuguauuacaaaguuccggacucuacucacuuucaucaguaguaacaguaccuucuucaucacuaggcacucaaacuuacaucuguaacgucaaucacaaaccaucaaacacaaaaguagacaaaaaaguagaaccaaaaucaugcgauaaaacccauacaugccccccuugcccagcuccagaagcagcaggcgcaccaucuguuuucuuauucccccccaaaccaaaagacacauuaaugauaucaagaaccccagaaguaacaugcguaguaguagacguaucccacgaagacccagaagucaaauuuaauugguacgucgauggaguagaaguacauaaugcaaaaacuaaaccacgcgaagaacaauauaacucaaccuacagaguaguaucaguacuaacuguucuacaccaagacugguuaaacggaaaggaauauaaauguaaaguaucaaacaaagcauuacccgcaccuaucgaaaaaacaauaucuaaagcaaaaggacaaccacgagaaccacaagucuauacacucccaccaucuagagaagaaaugacuaaaaaccaagucucuuuaacauguuuaguaaaaggauucuauccaucagauaucgcaguagaaugggaauccaacggacaaccugaaaauaacuauaaaaccacaccaccaguucuagauagugacggaucauucuuuuuauacuccaaauuaacaguugacaaaucaagauggcaacaaggaaacgucuucuccuguucuguaaugcacgaagcacuucacaaccacuauacacaaaaaucacuaucccuuucaccaggaaaa

SEQ ID NO: 46068 - RNA, 1335 nt, Artificial Sequence
  derived and/or modified sequence opt6 from Domagrozumab_HeavyChain
gaaguacaacuacuagaaucuggaggaggucuuguacaacccggaggaucucuucguuuaucuugugcagcaucaggauucacauucagcucauaugccaugucauggguacgucaagcaccagguaaaggacuagaauggguaucuaccaucucaucuggagguucauacacaucauauccagacucuguaaaaggaagauucacaaucucaagagacaauagcaaaaacaccuuauaccuacaaaugaauucacuaagagcagaagacacagccguauacuacugcgccaaacaagauuacgcaaugaacuacuggggacaaggaacuuuaguaacaguaucuucagcaagcacaaaaggaccuucaguauuccccuuagcaccaucaucaaagucaacaucaggcggaacagcugcacuaggaugucuuguaaaagacuacuuucccgaaccaguuacaguauccuggaauaguggagcccuaacaucuggaguacauaccuuccccgcaguacuucaaucaaguggacucuacucacuaucaucaguaguuacaguaccaucaucaucauuaggaacucaaacauauauaugcaauguaaaccauaaacccuccaacacaaaagucgacaaaaaaguagaaccaaaaaguugcgauaaaacacauacaugccccccaugcccugcuccugaagcagcuggagccccaucagucuucuuauuccccccaaaaccaaaagacacacuaaugaucuccagaaccccagaaguaaccugcguaguaguagacgucucacacgaagacccagaaguaaaauucaauugguauguagacggcguagaaguacacaaugcaaaaacuaaaccaagagaagaacaauacaauucaacauauagaguagucucaguccuaacaguauuacaccaagacuggcuaaacggaaaagaauacaaaugcaaaguaucaaauaaagcccuaccagcaccaauagaaaaaacaauaucaaaagcaaaaggccaaccacgagaaccucaaguauacacccuaccgccaucaagagaagaaaugacaaaaaaucaaguaucacuaacaugcuuagucaaaggauuuuacccaucagauauugcaguagaaugggaauccaauggacaaccagaaaacaacuauaaaacuacacccccaguacuugauucagauggaucauucuuucucuacucaaaauuaacaguagauaaaucaagauggcaacaaggaaauguauucuccuguucuguaaugcacgaagcuuuacacaaccacuacacacaaaaaucacuuucccuaucaccugga

SEQ ID NO: 46069 - RNA, 642 nt, Artificial Sequence
  derived and/or modified sequence opt6 from Domagrozumab_LightChain1
gacauacaaaugacacaaucaccauccucacuaucagcauccguaggcgauagaguaacaauaacaugcaaagcaucccaagacguaucaacagcaguagcaugguaccaacaaaaacccggaaaagcaccaaaacuacuaauauacucagcaucauaccgauacacaggaguaccaucaagauuuucaggaucaggaucaggcacagacuucacacuaacaauaucaucacuacaaccagaagacuucgcaacauacuauugucaacaacacuacucaacaccauggacauucggaggaggaacaaaaguagaaauaaaacgaacaguagcagcaccauccguauucauauucccaccaucagacgaacaauuaaaaucuggaacagccucagucguaugccuacuaaacaacuucuacccaagagaagcaaaaguacaauggaaaguagacaacgcacuacaaucaggaaacucacaagaaucaguaacugaacaagacucaaaagacucaacauacagccuaucauccacacuaacacuaucaaaagcagacuacgaaaaacacaaaguauacgcaugcgaaguaacacaccaaggauuaucaucaccaguaacaaaaucauucaacagaggcgaaugc

SEQ ID NO: 46070 - RNA, 1335 nt, Artificial Sequence
  derived and/or modified sequence opt6 from Drozituab_HeavyChain1
gagguacaacuaguacaaucaggaggaggaguagaaagaccaggagguucacuaagauuauccugcgcagcaucaggauuuacauuugacgauuaugcaaguuggguaagacaagcccccggaaaaggacuagaaugggucaguggcaucaauuggcaagggggauccacugguuaugccgauaguguaaaaggacgagugacaauaagcagagacaacgcuaaaaacucacuauaucuucaaaacucacuaagagcagaagacacagcaguauacuacugcgcaaaaauacuuggagcuggaagagguugguauuuugauuacuggggaaaagguacuaccgucacaguaucaucagcuucaacaaaagguccaucaguauuuccauuagcaccaucuucaaaaucuacaucaggaggaaccgcagcacuaggaugccuaguaaaagacuauuucccagaaccaguaacaguaucauggaacucaggagcauuaacaucaggaguccacacuuuuccggcaguuuuacaaagcucaggauuauacucacuaucaucaguaguaacaguaccaagcaguucacuaggaacacaaacauacauaugcaauguaaaucacaaaccaucaaauacuaaaguagauaaaaaaguagaaccaaaaagcugcgauaaaacacauacaugcccaccauguccagcaccagaacuacuuggaggacccuccguauuuuuauuuccaccaaagccaaaagauacauuaaucaguagaacaccagaaguaacaugcguaguaguagacguaucacaugaagaucccgaaguaaaauucaacugguacguagauggaguagaaguacauaaugccaaaaccaaaccaagagaagaacaauauaacucaaccuaucgaguuguuucaguacuaacaguucuacaucaagacuggcuaaauggaaaagaauauaaauguaaaguaucaaacaaagcauuaccagcaccaauagaaaaaacaauaaguaaagcuaaaggacaacccagagaaccucaaguauacacccuaccuccuucaagagaagaaacaaaaaaucaaguaucccuaacaugcuuaguaaaagguuucuauccauccgacauagcaguagaaugggaaaguaacggacaaccggaaaacaauuacaaaacaaccccaccaguacuagauagcgauggaucauuuuuccuauauaguaaacuaacagucgauaaaucacgauggcaacaaggaaauguauuuucauguucaguacacgaagcauuacacaaucacuauacacaaaaaaguuuaaguuuaucaccagga

SEQ ID NO: 46071 - RNA, 639 nt, Artificial Sequence
  derived and/or modified sequence opt6 from Drozituab_LightChain1
ucagaacuaacacaagacccagcagucucaguagcacuaggacaaacaguaagaauaacaugcucaggugacucacuaagaucauacuacgcaucaugguaccaacaaaaaccaggacaagcaccaguccuaguaauauacggagcaaacaacagaccaucaggaauaccagaccgauucucaggaucaucaucaggaaauacagcaucacuaacaauaacaggagcacaagcagaagacgaagcagacuacuacugcaacucagcagacuccucaggcaaccacgucguauucggaggaggaaccaaacuuacaguacuaggacaaccaaaagcagcaccaucaguaacauuauucccaccaucaucagaagaacuacaagcaaacaaagcaacauuaguaugccuaauaucagauuucuacccaggagcaguaacaguagcauggaaagcagacucaucaccaguaaaagccggaguagaaacaacaacaccauccaaacaaucaaacaacaaauaugcagccucaucauaccuaucacuaacaccagaacaauggaaaucacacaaaucauacucaugccaaguaacacacgaaggcucaacaguagaaaaaacaguagcaccaacagaaugcuca

SEQ ID NO: 46072 - RNA, 1353 nt, Artificial Sequence
  derived and/or modified sequence opt6 from Drozitumab_HeavyChain1
gaaguacaacuuguacaaucaggaggaggaguagaaagaccaggaggaagcuuaagauuauccugcgccgcaucaggauucacauucgaugacuacgcaaugucauggguaagacaagcaccaggaaaaggucuagaauggguuuccggaauaaacuggcaaggaggaucaacaggauacgccgacucaguaaaaggaagaguaacaauaucaagagauaaugcaaaaaacucacuauauuuacaaaugaauucacuaagagcagaagauacagcaguauauuauugcgcaaaaauacuaggcgcuggaagaggaugguacuuugauuauuggggaaaaggcacaacuguaacuguaucuucagcaagcacaaaaggaccaucaguauucccauuagcaccaagcucaaaaaguacaucaggaggaacagcagccuuaggcugcuuaguaaaagacuacuuccccgaaccuguuacagugucauggaacaguggagcacuaacaucaggaguacauacauucccagcaguuuuacaaucaucaggacucuauucauuaucaagcgucguaacaguccccaguucaucacuaggaacacaaaccuacauaugcaacguaaaccauaaaccuagcaacacaaaaguagacaaaaaaguagaaccgaaaucaugcgauaaaacacauacguguccuccaugcccagcaccagaacuacuaggaggaccaucaguuuucuuauuuccacccaaaccaaaagacacacuuaugauaucaagaacaccugaaguaacuugcguaguaguagauguaucacaugaagacccugaaguaaaauucaauugguauguagacggagucgaaguacacaaugccaaaaccaaaccuagagaagaacaauauaacucaaccuacagaguuguuaguguuuuaacuguacuacaccaagacuggcuaaacggaaaagaauauaaaugcaaaguaucuaacaaagcccuaccagcaccaauagaaaaaacaauaagcaaagcaaaaggacaaccaagagaaccucaaguuuauaccuuaccaccaucaagagaagaaaugacaaaaaaucaaguaucauuaacaugucuaguaaaaggauucuauccauccgacauagcaguagaaugggaaucaaauggccaaccagaaaacaacuacaaaacaacaccacccguauuagacagugauggaucauuuuuccuauauucaaaacuaaccguagacaaaagucgauggcaacaaggaaacguauuuucauguucaguaaugcacgaagcacuacauaaccacuauacacaaaaaucacuaagccucucucccggaaaa

SEQ ID NO: 46073 - RNA, 639 nt, Artificial Sequence
  derived and/or modified sequence opt6 from Drozitumab_LightChain1
ucagaacuaacacaagacccagcaguaucaguagcacuaggacaaacaguaagaauaacaugcucaggagauagccuaagaucauauuacgcaucaugguaccaacaaaaaccaggacaagcaccaguacuaguaauauacggagcaaacaaccgcccaucaggaauaccagacagauucagcggcucaucaucaggaaacacagcaucacuaacaauaacuggagcacaagcagaagacgaagcagacuacuacugcaacuccgcagacuccucuggaaaccacgucguauucggaggaggaacaaaauuaacaguacuaggacaacccaaagcagccccaucaguaacacuauucccaccaucaucagaagaacuacaagccaacaaagcaacauuaguaugucuaauaucagacuucuacccaggagcaguaacaguagcauggaaagcagacucaucaccuguaaaagcuggaguagaaacaacaacaccaucaaaacaaucaaacaacaaauacgcagcaucaucauacuuaucauuaacaccagaacaauggaaaucacacaaaucauacucaugccaaguaacacacgaaggcucaacaguagaaaaaacaguagcaccaacagaaugcagc

SEQ ID NO: 46074 - RNA, 1353 nt, Artificial Sequence
  derived and/or modified sequence opt6 from Duligotumab_HeavyChain1
gaaguacaauuaguugaaaguggaggaggccuaguacaaccaggaggaucacuaagacuaaguugcgcagcaucagguuuuacacuaucaggagauuggauacacuggguuagacaagcacccggaaaaggacuagaauggguaggcgaaauaucagcagcaggaggauacacugacuaugcagauucaguaaaaggacgcuucacuauaagugcagauacaucuaaaaacacagcauacuuacaaaugaacucauuaagagcagaagacacagccguuuacuauugugcaagagaaagucgaguaucuuuugaagcagcaauggauuauuggggacagggaacacuaguaaccgucucaucagcaucuacaaaaggaccuaguguauuuccacucgccccaucaucaaaaucaacgucaggcggaacagcagcacuaggaugccuaguuaaagauuacuucccagaaccuguaaccguaucguggaacucaggugcccuuacaucaggaguacauacauuuccugcuguacuccaaucaucaggacuuuauucauuaaguuccguaguaacuguuccaucaucaucauuaggaacccaaacauauauaugcaauguaaaccauaaaccaagcaauacuaaagucgauaaaaaaguagaaccaaaaaguugugacaaaacacacacauguccaccauguccagcuccagaacuucuuggagguccaaguguauuuuuauuuccacccaaaccaaaagacacucuaaugauaucaagaacaccagagguuacauguguagucguagacguaucacacgaagacccagaaguaaaauucaauugguauguagacggcguagaaguccacaacgcaaaaacaaaaccaagagaagaacaauauaacucaacauacagagucguaucgguucuaacaguauuacaucaagacugguuaaacggaaaagaauauaaaugcaaaguaucaaacaaagcuuuaccagcgccaauagaaaaaacaauaucaaaagcaaaaggacaacccagagaaccacaaguauacacauuaccaccaucacgagaagaaaugacaaaaaaccaaguaucacucacauguuuaguaaaaggcuucuacccauccgauaucgcaguagaaugggaaucuaacggacaaccagaaaacaauuauaaaacaacaccaccaguauuagauucagacggaaguuuuuuuuuauauaguaaacuaacaguagacaaaucaagauggcaacaaggaaauguauuuucauguucaguuaugcacgaagcacuacauaaucauuacacacaaaaaucuuuaucauuaagucccggaaaa

SEQ ID NO: 46075 - RNA, 642 nt, Artificial Sequence
  derived and/or modified sequence opt6 from Duligotumab_LightChain1
gacauacaaaugacacaaucaccaucaucacuaucagcaucaguaggagacagaguaacaauaacaugcagagcaucacaaaacauagcaacagacguagcaugguaccaacaaaaaccaggaaaagcaccaaaauuauuaauauacuccgcaucauuucuauacucaggaguaccaucaagauucucaggauccggaucaggaacagauuucacacuaaccauaagcucauuacaaccagaagacuucgccacauacuacugccaacaaucagaaccagaaccauauacauuuggacaaggcacaaaaguagaaauaaaaagaacaguagcagcaccaucaguauucauauucccaccaucagacgaacaauuaaaaucaggaacagcaucagucguaugccuacuaaauaacuucuacccaagagaagcaaaaguacaauggaaaguagacaacgcacuacaaucaggaaacucacaagaaucaguaacagaacaagacucaaaagacucaacauauucacuaucaucaaccuuaacccuaucaaaagccgacuacgaaaaacacaaaguauaugcaugcgaaguaacacaccaaggauuauccucacccguaaccaaaucauucaacagaggcgaaugc

SEQ ID NO: 46076 - RNA, 1353 nt, Artificial Sequence
  derived and/or modified sequence opt6 from Duligotuzumab_HeavyChain1
gaaguccaacucgucgaaucaggaggaggacuaguacaaccaggaggaucuuuaagauuaucaugcgcggcaucaggauucacauuaucaggagauuggauacacuggguacgacaagcacccggaaaaggacuagaauggguaggagaaauuucugcagcaggaggauacacagauuacgcagacaguguaaaaggacguuucacaauauccgcagacacuucaaaaaauacagcauacuuacaaaugaauucauuaagagcugaagauacagcaguauauuacugcgcacgagaaucaagaguaucauucgaagcugccauggacuauuggggacaaggaacacuagucacaguaucaucagccuccacaaaaggcccuucuguauuuccacuagcaccaucuucaaagucaacaucaggaggaacagcagccuuaggaugcuuaguaaaagauuacuuccccgaacccguaacaguaaguuggaacuccggagcacuaacaucaggcguucauacauucccagcaguucuucaaucuuccggccuauauucacuaucaucaguaguaacaguaccaucaucaucacuaggaacacaaacauacauaugcaauguaaaccauaaacccucaaacacaaaaguugauaaaaaaguagaaccuaaaucaugcgacaaaacacauaccuguccaccaugcccagcaccagaacuacuaggaggaccuaguguauuccuuuucccaccaaaaccaaaagacacacuaaugauauccagaacaccagaaguaacuugcguaguaguagacguaucucacgaagauccugaagucaaauuuaacugguacguagauggcguagaaguacacaaugcuaaaacaaaaccaagagaagaacaauauaacucaacauaccgugucguaucaguacuaacaguacuacaccaagacuggcuaaauggaaaagaauacaaauguaaaguauccaacaaagcauuacccgcaccaauagaaaaaacaauaucaaaagcaaaaggccaaccacgagaaccacaaguauauacucuacccccgucuagagaagaaaugaccaaaaaccaaguaucauuaaccugccuagucaaaggauuuuacccaucagauauugcaguagaaugggaaucuaacggacaaccagaaaauaacuacaaaacaacaccccccguuuuagauucagacggcucauuuuucuuauauucaaaauuaacaguugacaaauccagauggcaacaaggaaacguauucucauguagugucaugcacgaagcacuucauaaccacuauacacaaaaaucacuaaguuuaucuccuggcaaa

SEQ ID NO: 46077 - RNA, 642 nt, Artificial Sequence
  derived and/or modified sequence opt6 from Duligotuzumab_LightChain1
gacauacaaaugacacaaucaccaucaagcuuaucagcaucaguaggagacagaguaacaauaacaugcagagcaucccaaaauauagcaacagacguagcaugguaucaacaaaaaccaggaaaagcaccaaaacuacuaauauacucagcauccuuccuauacucaggaguaccaucaagauucucagguucaggaucaggaacagacuucacacuaacaauauccucacuacaacccgaagacuucgcaacuuacuacugccaacaaucagaaccagaaccauacacauucggacaaggaacaaaaguagaaauaaaaagaacaguagcagcaccaucagucuucauauuuccaccaucagacgaacaacuaaaauccggaacagcaucaguaguaugucuacuaaacaacuucuacccaagagaagcaaaaguacaauggaaaguagacaaugcacuacaaucaggaaauucacaagaaucaguaacagaacaagacucaaaagacucaacauacucacuauccucaacacuaacauuaucaaaagcagacuacgaaaaacacaaaguuuacgcaugcgaaguaacacaucaaggacuaucaucacccguaacaaaaucauucaacagaggagaaugc

SEQ ID NO: 46078 - RNA, 1353 nt, Artificial Sequence
  derived and/or modified sequence opt6 from Dupilumab_HeavyChain1
gaaguccaacuaguagaaucaggaggaggucuugaacaaccaggaggaucacuaagacuauccugugcaggaucaggauucacauuccgagacuacgcaaugacauggguacgucaagcuccaggaaaaggacuagaauggguaucaucaauaucaggaucuggaggaaacacauacuaugcagacucaguaaagggaagauuuacuauaucacgagacaauucaaaaaacacacuauaccuucaaaugaauucacucagagcagaagacacagcuguauauuacugcgcaaaagaucgauuaucaaucaccauaagaccacgcuauuacggacuagauguauggggacaagguacaacagucacaguaaguuccgcaucaacaaaaggaccaaguguauucccucuagcacccuguucaagauccacaucagaaaguacagccgcguuaggauguuuaguaaaagauuauuucccagaaccaguaacaguuucauggaacucaggagcuuuaacaucaggcguacacacauuuccagcaguacuacaaucuucaggacuauauucauuaucaucaguaguaacaguaccaucaucaucuuuagguacaaaaacuuauacauguaacguagaucauaaaccaucaaacacaaaaguagacaaaagaguagaaucaaaauacggacccccaugcccaccaugcccagcuccugaauucuuaggaggcccaaguguauuccucuuuccaccaaaaccuaaagauacauuaaugauuucaagaacaccagaaguaaccuguguaguaguagauguaucgcaagaagacccagaaguacaauucaacugguacguagauggaguagaaguacauaacgcaaaaacuaaaccaagagaagaacaauucaacucuacauauagaguaguaucaguccuaacaguauuacaucaggacuggcuaaauggaaaagaauacaaauguaaagucuccaauaaaggauuaccaucaaguauagaaaaaaccauuucaaaagcaaaaggacaaccaagagaaccacaaguauacacacuaccacccucccaagaggaaaugacaaaaaaccaaguauccuuaacaugccuagucaaaggauucuaccccuccgacauagccguugaaugggaaucaaacggacaaccagaaaacaacuauaaaacaacaccacccguauuagauucagauggaaguuucuuucuauauucaagacuaacaguagauaaaaguagauggcaagaaggaaauguauuuagcuguucaguaaugcaugaagcauuacauaaccacuauacacaaaaaagcuuaucucuaucacucggu

SEQ ID NO: 46079 - RNA, 657 nt, Artificial Sequence
  derived and/or modified sequence opt6 from Dupilumab_LightChain1
gacauaguaaugacacaauccccacuaucacuaccaguaacaccaggagaaccagccucaaucucaugcagaucaucacaaucacuauuauacucaauaggauacaauuaccuagacugguaccuacaaaaaucaggacaaucaccacaacuacuaauauaccuaggauccaauagagcaucuggaguaccagacagauucucaggaucaggaucaggcaccgacuucacacuaaaaauaucaagaguagaagcagaagacguaggcuucuacuauugcaugcaagcacuacaaacaccauacacauucggacaaggaacaaaacuagaaauuaaaagaacaguagcagcaccaucaguauucauauucccaccaucagacgaacaacuaaaaucaggaacagcaucaguaguaugccuacuaaacaacuuuuacccaagagaagcaaaaguacaauggaaagucgacaacgcacuccaauccggaaacucacaagaaucaguaacagaacaagacaguaaagacucaacauacucacuaucauccacuuuaacccuaucaaaagcagacuacgaaaaacacaaaguauacgcaugcgaaguaacacaccaaggauuaucaucaccaguaacaaaauccuucaacagaggagaaugc

SEQ ID NO: 46080 - RNA, 1353 nt, Artificial Sequence
  derived and/or modified sequence opt6 from Durvalumab_HeavyChain1
gaaguacaacuuguagaaucugguggaggauuaguacagccaggagguucauuaagacuaucaugcgcugcaagcggauuuacauucuccagauauuggaugucauggguaagacaagcaccaggaaaaggcuuagaauggguagcaaacauaaaacaagauggaucagaaaaauacuacguggacaguguaaaaggacgauuuacuauaucaagagacaaugcaaaaaacucucuauacuuacaaaugaauucauuaagagcugaagauacagcuguauacuauugcgcaagagaaggaggaugguucggagaacuagcauucgacuacuggggacaaggaacauuagucacaguaaguucagcaucaacaaaaggacccucaguauucccauuagcuccaagcucaaaaucaacgucaggcggcacugcagcacuaggauguuuagucaaagacuauuucccagaaccaguaacaguuucauggaauagcggagcauuaacaagugggguacacacuuucccugcaguauuacaaagcagcggauuauauucauuaaguagcguagucacuguaccaucaucaucucuaggaacacaaacauacauauguaauguaaaucacaaaccaucaaauacaaaaguagauaaaagaguagaaccaaaaucaugcgacaaaacacauaccuguccaccauguccagcaccagaauuugaagguggaccaucaguauuucuauucccaccaaaaccaaaagauacacucaugauaaguagaaccccagaagucacauguguaguaguagauguaucacacgaagauccagaaguaaaauuuaacugguauguagauggagucgaaguucauaacgcaaaaacaaaaccaagagaagaacaauauaacaguacauauagaguagugucaguauuaacaguacuacaucaagacugguuaaacggcaaagaauacaaauguaaaguaucaaauaaagcacuacccgcaucaauagaaaaaacaauauccaaagccaaaggacaaccaagagaaccucaaguauacacucuaccaccuucaagagaagaaaugacuaaaaaccaaguaucacuaacaugcuuaguaaaggguuuuuacccaucagacauagcuguggaaugggaaaguaacggacaaccagaaaauaacuauaaaacaaccccaccaguacuugauucagacggauccuuuuuucucuacucaaaacuaacagucgacaaauccagauggcaacaagguaacguauuuucuugcucaguaaugcacgaagcacuacacaaucauuacacucaaaaaagcuuaagucuaucaccaggaaaa

SEQ ID NO: 46081 - RNA, 645 nt, Artificial Sequence
  derived and/or modified sequence opt6 from Durvalumab_LightChain1
gaaauaguacuaacacaaucaccaggaacacuaucacuaucacccggagaaagagcaacauuauccuguagagcaucacaaagaguaucaucaucauaccuagcaugguaccaacaaaaaccaggacaagcacccagacuacuaauauacgacgcauccuccagagcaacaggaauaccagacagauucucaggaucaggcucaggaacagacuucacauuaacaauaucaagacuagaaccagaagacuucgcaguauauuacugccaacaauacggaagccuaccauggacauucggacaaggaacaaaaguagaaauaaaaagaacaguagcagcaccauccguauucauauucccaccaucagacgaacaacuaaaaucaggaacagcaucaguaguaugucuacuaaacaacuucuacccaagagaagcaaaaguacaauggaaaguagacaacgcacuacaaucaggaaacucacaagaaucaguaacagaacaagacucaaaagauucaacauacucacuaagcucaacacucacacuaagcaaagccgacuacgaaaaacacaaagucuaugcaugugaaguaacacaccaaggacuauccucaccagucacaaaaucauucaacagaggagaaugc

SEQ ID NO: 46082 - RNA, 1338 nt, Artificial Sequence
  derived and/or modified sequence opt6 from Dusigitumab_HeavyChain1
caaguacaacuaguacaaucaggagcagaaguaaaaaaaccaggagccucaguaaaaguaagcugcaaagcaucaggauauacauucacuaguuacgauauaaauuggguucgacaagcaacuggccaaggcuuagaauggaugggauggaugaacccaaauuccggaaauacuggauacgcucaaaaauuccaaggccgaguaacaaugacaagaaauacaucuauaucaaccgcuuacauggaacuaucaucauuaagaucagaagacacugccguauacuacugcgcacgugauccauacuauuauuacuauggcauggauguauggggucaaggaacaacaguuacaguuucaagugcaucaacuaaaggacccucaguauuuccauuagcuccuugcucaagaucaacaucagaaucaacagcugcauuaggauguuuaguaaaagauuauuuccccgaaccuguaacaguaagcuggaacucaggagcacuaacaucaggaguccauacauuuccagcaguauuacaaucaaguggauuauauucacuaaguucaguagucacaguaccaucuagcaacuuugguacccaaacauauacauguaauguugaccauaaaccauccaacacaaaaguugauaaaacaguagaaagaaaaugcugcguagaaugcccuccauguccagcaccaccaguagcagguccaagcguauuccuauucccacccaaaccaaaagauacacuaaugauaaguagaacuccagaaguaacauguguuguaguagacguuucacaugaagauccagaaguucaauuuaauugguaugucgacggcguugaaguacacaaugcaaaaacaaaacccagagaagaacaauuuaauucaacauuccgaguaguaucaguacucacaguaguacaucaagauuggcuuaacggaaaagaauacaaaugcaaaguauccaacaaaggacuuccagcaccaauagaaaaaacuauaagcaaaacaaaaggacaacccagagaaccacaaguauauacacuaccaccaucaagagaagaaaugacaaaaaaccaaguaucauuaacuugcuuaguaaaaggauuuuacccaagcgauauagcaguagaaugggaaagcaacggccaaccagaaaacaauuacaaaaccacacccccaaugcucgauucugacgggucauuuuuucuauacucaaaacuuacuguugacaaaucaagauggcaacaaggcaauguauucucuuguucagucaugcaugaagcacuacacaaccacuauacacaaaaaucauuaucguuaucaccagguaaa

SEQ ID NO: 46083 - RNA, 651 nt, Artificial Sequence
  derived and/or modified sequence opt6 from Dusigitumab_LightChain1
caaucaguacuaacacaaccaccaucaguaucagcagcaccaggacaaaaaguaacaauauccugcucaggaagcucaucaaacauagaaaacaaccacguaucaugguaucaacaauuaccaggaacagcaccaaaauuauuaauuuacgacaacaacaaaagaccaagcggaauaccagacagauuuucuggaucaaaaucaggaacaucagcaacacuaggaauaacaggacuacaaacaggagacgaagcagacuacuacugcgaaacaugggauacaucacuaagcgcaggaagaguauucggaggaggaacaaaauuaacaguacuaggacaaccaaaagcagcuccaucaguaacauuauucccaccaucaucagaagaacuacaagcaaacaaagcaacacuaguaugcuuaauaucagacuucuauccaggagcaguaacaguagcauggaaagccgacagcucaccaguaaaagcaggaguagaaacaacaacaccaucaaaacaaucaaacaacaaauaugcagcaucaaguuaccucucacuaacaccagaacaauggaaaucacacagaucauacucaugccaaguaacacacgaaggaucaacaguagaaaaaacaguagcaccaacagaauguuca

SEQ ID NO: 46084 - RNA, 1347 nt, Artificial Sequence
  derived and/or modified sequence opt6 from Ecromeximab_HeavyChain1
gaaguaacacuaguugaaucagguggagauuuuguaaaacccggagguucauuaaaaguuagcugcgcagccuccggauuugcauucucucacuacgcaaugucauggguaagacaaacccccgcaaaacgacuagaauggguagcauauauaaguuccggaggaucaggaaccuacuauuccgacucuguuaaaggaagauucacuauaucccgagacaaugccaaaaacacuuuauaccuucaaaugagaucccuacgaucagaagauucagcaauguauuucugcacaagaguaaaguuaggcaccuauuacuucgauucauggggccaaggcacaaccuuaacggucucaucagcaucaacuaaaggaccaucaguauucccauuagcaccuuccucaaaaucaacaucaggaggaacagcagcauuaggaugccuaguaaaagauuacuuccccgaaccaguaacaguauccuggaacucaggagcauuaacaucugguguacacacauucccugcaguacuacaaucaucaggacuauacucuuuaaguucaguaguaacaguaccaucuaguucauuaggaacacaaaccuacauauguaauguaaaucauaaaccaucaaauaccaaaguagacaaaaaaguagaaccaaaauccugcgacaaaacccacacaugcccaccuuguccagcaccagaauuacuaggaggcccaucaguauuucuauucccaccaaaaccaaaagauacccuaaugauaucaagaacccccgaaguaacaugcguaguaguugacgucucacaugaagacccagaaguuaaauucaacugguacguugauggaguagaaguacauaaugcaaaaacuaaaccaagagaagaacaauacaauucaacauaucgaguaguaagugucuuaacaguauuacaucaagauuggcucaacggaaaagaauauaaaugcaaaguaucaaacaaagcacuuccagccccaauagaaaaaacaauaucaaaagcuaaaggucaaccaagagaaccacaaguauacacacuaccccccucacgagacgaacuaacgaaaaaccaaguuucucuaacaugccucguaaaaggauuuuauccauccgauauagcaguagaaugggaaucaaauggacaaccagaaaauaacuauaaaaccacaccaccaguacucgacucagacggauccuuuuucuuauacucaaaauuaacaguagauaaaucuagauggcaacaaggaaacguauuuucaugcucaguaaugcacgaagcacuucacaaccacuacacccaaaaaucccuaucauuaucaccaggaaaa

SEQ ID NO: 46085 - RNA, 642 nt, Artificial Sequence
  derived and/or modified sequence opt6 from Ecromeximab_LightChain1
gacauacaaaugacacaaacagcaucaucauuaccagcaucacuaggcgauagaguaacuauaucaugcucagcaucccaagacauaaguaacuaccuaaacugguaccaacaaaaaccagacgguacagucaaauuacuaauauucuacucaucaaaccuccacucaggaguaccaucacgauucucaggaggaggaucaggaacagacuauucucuaacaauauccaaccuagaaccagaagacauagcaacauacuucugccaccaauacucaaaacuaccauggacauucggaggaggaaccaaacuagaaauaaaaagaacaguugcagcaccaucaguauucauauucccaccaucagacgaacaacuaaaaucaggaacagcaucagucguaugcuuacuaaauaauuucuacccaagagaagcaaaaguacaauggaaagucgacaacgcacuacaaucaggaaacucacaagaaucaguaacagaacaagacucaaaagacucaacauacucacuaucaucaacacuaacauuauccaaagcagacuacgaaaaacacaaaguauacgcaugcgaaguaacacaccaaggacuaucaucaccaguaacaaaaucauucaacagaggagaaugc

SEQ ID NO: 46086 - RNA, 1341 nt, Artificial Sequence
  derived and/or modified sequence opt6 from Eculizumab_HeavyChain1
guacaacuaguccaauccggugcagaaguuaaaaaaccaggagcaucaguuaaaguuuccugcaaagcaucaggcuacauauucucuaacuacuggauucaauggguccgacaagcucccggucaaggccuagaauggaugggagaaauauuaccaggaucaggaucaaccgaauacacagaaaacuucaaagacagagugacuaugacucgagacacaagcacauccacagucuauauggaacucucuucacuaagaucugaagauacagcaguauauuacugcgcaagauacuuuuucggaucaucaccaaacugguacuucgacgucuggggacaaggaacucuuguaacaguaucuuccgcaagcacaaaaggaccaucaguauuuccauuagcuccauguucacgcuccacuagcgaauccaccgcagcucuaggaugccuaguaaaagacuauuucccagaaccuguuacaguuucuuggaacucuggagcacuaaccaguggaguacacacauuccccgcaguccuacaaucuaguggauuauauucauuaucaucagucguaacuguaccauccucaaauuuuggcacacaaacauacacuuguaacguagaccauaaaccaucuaacacaaaaguagacaaaacaguagaaagaaaauguugcguagaauguccaccaugcccagcccccccaguagcaggaccuucaguuuuucuauucccaccaaaaccaaaagauacauuaaugauauccagaacacccgaagucacaugcguaguaguagacguaucacaagaagaucccgaaguucaauucaacugguaugucgacggaguagaaguacacaacgcaaaaacaaaaccaagagaagaacaauucaauucaacuuauagaguuguaagcguccuaacaguacuacaucaagacugguuaaauggcaaagaguacaaaugcaaaguuucuaacaaagguuuaccaucaucaauagaaaaaacaauauccaaagcaaaaggucaacccagagaaccacaaguauauacacuaccaccuucacaagaagaaaugacuaaaaaucaaguaucauuaacauguuuaguaaaaggauucuacccaucagacauagcaguugaaugggaaucaaacggucaaccagaaaauaacuauaaaacaaccccacccguauuagacucagacggcucuuucuuucuauacucacgacuaaccguagauaaaucaagauggcaagaaggaaacguauuuucuugcucaguaaugcaugaagccuuacacaaucacuacacacaaaaaucacuaucacuaucuuuaggaaaa

SEQ ID NO: 46087 - RNA, 642 nt, Artificial Sequence
  derived and/or modified sequence opt6 from Eculizumab_LightChain1
gacauacaaaugacacaaucaccaucaagcuuaucagcaagcguaggagacagaguaacaauaacaugcggagcaagcgaaaacauauacggagcacucaacugguaccaacaaaaacccggaaaagcaccaaaacuacuaaucuacggcgcaacaaaccuagcagacggcguuccauccagauucucaggaucaggaucaggaacagacuucacauuaacaauaucaucacuacaaccagaagacuucgcaacauacuacugccaaaacguacuaaacacaccacuaacauucggacaaggaacaaaaguagaaauaaaaagaaccgucgcagccccaucaguauucauauucccaccaucagacgaacaacuaaaaucaggaacagccucaguaguaugccuacuaaacaacuucuacccaagagaagcaaaaguacaauggaaaguagacaacgcauuacaaucaggaaacucacaagaaucaguaacagaacaagacuccaaagacucaacauacucacuaucaucaacacuaacacuaucaaaagcagacuacgaaaaacacaaaguauacgcaugcgaaguaacacaucaaggcuuaaguucaccaguaacaaaauccuucaacagaggagaaugc

SEQ ID NO: 46088 - RNA, 375 nt, Artificial Sequence
  derived and/or modified sequence opt6 from Efalizumab_HeavyChain
gaaguacaauuaguagaaagcggaggaggacuaguacaaccaggaggaaguuuaagauuaagcugugcagcaagcggauacucauucacaggacauuggaugaacuggguaagacaagcaccaggaaaaggacuagaauggguaggaauaaugauacacccaagcgauagcgaaacaagauacaaucaaaaauucaaagacauaagauuuacaauaagcguagacaaaaguaaaaacacacuauaucuacaaaugaauagcuuaagagcagaagauacagcaguauauuacugugcaagaauaggaauauauuucuauggaacaacauauuucgauuacauauggggacaaggaacauuaguaacaguaucaagc

SEQ ID NO: 46089 - RNA, 324 nt, Artificial Sequence
  derived and/or modified sequence opt6 from Efalizumab_LightChain
gacauacaaaugacacaaucaccaucaucacuaucagcaucaguaggagacagaguaacaauaacaugcagagcaucaaaaacaauaucaaaauaccuagcaugguaccaacaaaaaccaggaaaagcaccaaaacuacuaauauacucaggaucaacacuacaaucaggaguaccaucaagauucucaggaucaggaucaggaacagacuucacacuaacaauaucaucacuacaaccagaagacuucgcaacauacuacugccaacaacacaacgaauacccacuaacauucggacaaggaacaaaaguagaaauaaaacga

SEQ ID NO: 46090 - RNA, 768 nt, Artificial Sequence
  derived and/or modified sequence opt6 from Efungumab_SingleChain_variable_fragment
auggcagaaguacaacuaguagaaaguggagcagaaguaaaaaaaccaggagaaagucuaagaauaaguuguaaaggaagcggaugcauaauaucaagcuauuggauaaguugggucaggcaaaugccaggaaaaggacuugaauggaugggaaaaauagauccaggagauucauauauaaauuauaguccaaguuuucaaggacacguaacaauaagugcagauaaaaguauaaauacagcauauuuacaauggaauaguuuaaaagcaagcgacacagcaauguauuauugugccagaggaggacgagauuucggagauaguuuugauuauuggggacaaggaacucuaguaacaguaaguucaggaggaggaggaagugggggaggaggcucaggaggaggaggaagcgauguaguaaugacacaaucaccaucauuuuuaagugcauuuguaggagauagaauaacaauaacauguagagcaaguaguggaauaaguagauauuuagcaugguaucaacaagcaccuggaaaagcaccaaaauuauugauauaugcagcaaguacauuacaaacaggaguaccaaguagauuuaguggaucaggaucaggaacagaauuuacauuaacaauaaauucauuacaaccagaagacuuugcaacauacuauugucaacauuuaaacagcuauccauuaacauuuggaggaggaacaaaaguugauauaaaaagagcagcugcacuagaacaucaucaucaucaucau

SEQ ID NO: 46091 - RNA, 1362 nt, Artificial Sequence
  derived and/or modified sequence opt6 from Eldelumab_HeavyChain1
caaaugcaauuaguagaaucaggagguggagucgugcaaccaggaagaucauuacgauuaaguuguacugcuaguggauucacuuucucaaauaacggaaugcacuggguaagacaagcuccaggaaaagggcuugaauggguagcaguaaucugguucgauggaaugaacaaauucuacguugacaguguaaaaggaagauuuacaauaagcagagacaauaguaaaaacacacuauaccuagaaaugaauaguuuaagagcagaagacacagcuauauauuauugugcucgagaaggggacggaucaggaauauauuacuacuauggaauggaugucuggggacaaggaacaacaguaacugucucaucugcaucuacaaaaggaccaucagucuuuccacuagcaccaucauccaaaucaacaucaggaggaacagcagcacuuggaugccuagucaaagauuauuuuccagaaccaguaacaguaucauggaauucaggagcauuaacaagcggaguacacacauuuccagcaguauuacaaucuaguggauuauacucacuaucaucaguaguuacaguacccucaucaucauuaggaacacaaacuuauauaugcaauguaaaucauaaaccaucaaauacaaaaguagacaaaagaguugaaccaaaaucaugcgauaaaacacacacaugcccaccaugccccgcaccagaauuacuaggaggcccaagcguauuuuuauuucccccuaaaccaaaagacaccuuaaugauuucaagaacaccagaaguaacauguguaguaguagauguaucacaugaagaccccgaagugaaauuuaauugguauguagacggaguagaaguucauaacgcaaaaacaaaaccaagagaagaacaauacaacaguacauacagaguuguaaguguauuaacaguacuacaccaagauuggcuaaacggaaaagaauauaaauguaaaguaucaaauaaagccuuaccagccccaauagaaaaaacaauaagcaaagcaaaaggucaaccacgagaaccacaaguauauacauuaccaccuucuagagaagaaaugacaaaaaaucaaguaaguuuaacaugcuuaguaaaaggauucuacccauccgacauugcgguagaaugggaauccaauggacaaccagaaaauaacuauaaaacaacaccaccaguacuugauagugauggaucauuuuuccuauacagcaaacuaacagucgauaaaucaagauggcaacaagguaaugucuucagcugcucaguaaugcaugaagcucuacacaaccacuauacacaaaaaucacugucauuaucaccaggaaaa

SEQ ID NO: 46092 - RNA, 648 nt, Artificial Sequence
  derived and/or modified sequence opt6 from Eldelumab_LightChain1
gaaauaguacuuacacaaucacccggaacacuaucacuaucaccaggagaaagagcaacacuaucaugcagagcaucacaaucaguaucaucaucauacuuagcaugguaccaacaaaaaccaggacaagcaccaagauuacuaauauacggagcaucaaguagagcaacagguauacccgacagauuuucaggauccggaucaggaaccgacuucacacuaacaauaucaagauuagaaccagaagacuucgcaguauacuacugccaacaauacggaucauccccaauauucacauucggaccaggaaccaaaguagauauaaaacgaacaguagcagcaccaucaguauucauauucccaccaucagacgaacaacuaaaaucaggaacagccucaguaguaugcuuacuaaauaacuucuauccaagagaagcaaaaguacaauggaaaguagacaacgcacuacaaucaggaaacucacaagaaucaguuacugaacaagacucaaaagacucaacauauucauuaucaucaaccuuaacacuaucaaaagccgacuacgaaaaacacaaaguauacgcaugcgaaguaacacaccaaggacuauccucacccguaacaaaaucauucaaccgaggagaaugc

SEQ ID NO: 46093 - RNA, 1341 nt, Artificial Sequence
  derived and/or modified sequence opt6 from Elgemtumab_HeavyChain1
gaaguacaacuacuagaaucaggaggaggauuaguacaaccaggaggaucacuacgacuauccugugcagcaucuggauucacauucucaaguuacgcaaugucauggguaagacaagccccaggaaaaggauuagaauggguaucagcaauaaacucacaagguaaaucaacuuacuacgccgauucaguaaaaggaagauuuacaauaucacgagauaauucaaaaaauacacucuaucuacaaaugaacagucuaagagcagaagacacugcuguuuacuauugcgcuagauggggagacgaaggcuuugacauauggggacaagggacacucguaacaguauccucagcaucaacuaaagguccaucaguauucccacuagcaccaucaucaaaaucuaccaguggaggaacagcagcacuaggaugucuaguaaaagacuacuuccccgaaccaguaacaguaucauggaacucaggcgcccuuacaucaggaguacacacauuucccgcuguauuacaaaguucaggccuauauuccuuaucaucuguaguaacaguaccaucaucuucccuaggaacacaaacauauauauguaacguaaaucauaaacccucaaauacuaaaguagacaaacgcguagaaccuaaaaguugcgacaaaacacacacauguccaccuuguccagcacccgaguuauuaggaggaccaucagucuuucuauuuccaccaaaaccaaaagauacacucaugauaaguagaacaccagaaguaacaugugucguaguagauguaagucacgaagacccugaaguaaaauucaacugguaugucgacggcguagaaguccacaacgccaaaacaaaaccccgugaagaacaauauaacucaacauauagaguaguaucagucuuaacaguauuacaccaagauugguuaaauggaaaagaauacaaaugcaaaguaucaaauaaagccuuaccagcaccaauugaaaagacaauaucaaaagcgaaaggacaaccaagagaaccacaaguauauacauuaccuccauccagagaagaaaugaccaaaaaccaaguauccuuaacaugucuaguaaaagguuucuaccccuccgauaucgcagucgaaugggaauccaauggucaaccugaaaauaauuacaaaacaacaccccccguacucgauucagacggaucuuuuuuccuauacucaaaacuaacaguagauaaaucuagauggcaacaaggaaacguauucuccuguucuguaaugcaugaagcauuacacaaucacuauacacaaaaaagcuuaucauuaucuccaggaaaa

SEQ ID NO: 46094 - RNA, 642 nt, Artificial Sequence
  derived and/or modified sequence opt6 from Elgemtumab_LightChain1
gacauacaaaugacacaaucacccucaucacuaucagcaucaguaggagaccgaguaacaauaacaugcagagcaucacaaggcauaucaaacuggcuagcaugguaccaacaaaaacccggaaaagcccccaaacuccuaauauacggagcaucaucacuccaaucaggaguaccaucaagauucucagguucaggcucaggaacagacuucacauuaaccauaucaucacuacaaccagaagacuucgcaacauacuacugccaacaauauucaucauucccaaccacauucggacaaggaacaaaaguagaaauaaaaagaacaguagcagcaccauccguauucauauucccaccaucagacgaacaacuaaaaucaggaacagcaucagucguaugccuacuaaacaacuucuacccaagagaagccaaaguucaauggaaaguagacaacgcacuacaaucaggaaacucacaagaaucuguaacagaacaagacucaaaagacucaacauacuccuuaucaucaacauuaacacuuuccaaagcagacuacgaaaaacacaaaguauacgcaugcgaaguaacacaccaaggacuaucaucaccagucacaaaaucauucaacagaggagaaugc

SEQ ID NO: 46095 - RNA, 1347 nt, Artificial Sequence
  derived and/or modified sequence opt6 from Elotuzumab_HeavyChain1
gaaguacaauuaguagaaucuggugguggauuaguucaaccaggagguucacuaagacuaucuugugcagcuucaggauuugauuucucacgauauuggaugucauggguuagacaagcaccaggaaaaggacucgaauggaucggagaaauaaauccagauuccucuacuauaaauuaugcaccuagccuaaaagauaaauuuauaauaucaagagacaaugccaaaaauucauuauaucuacaaaugaauucacuaagagcagaagauacagcuguauauuacugcgcacgcccagacggaaauuacugguacuuugacguauggggccaagguaccuuaguaacagucucuucagcaucgaccaaaggaccauccgucuucccacuagcaccuucuucaaaaucaaccuccgguggaacagcagcauuaggauguuuagucaaagacuacuuucccgaaccaguaacaguaucuuggaauucaggagcacuaacaucuggcguccauacuuucccagccguccuccaaucuucaggacuauacucccuaucaucaguaguaacaguaccauccuccucacuaggcacacaaaccuauauauguaacgucaaucauaaaccaucuaacacuaaaguagacaaaaaagucgaaccaaaaucgugugauaaaacccauacauguccacccugccccgcaccagaauuauuagggggaccaucugucuuccuguucccuccaaaaccaaaagacacauuaaugaucucaagaaccccagaaguuacaugcguaguaguagaugucucucaugaagaccccgaagucaaauuuaauugguauguagacgguguugaaguacacaaugcaaaaacuaaaccaagagaagaacaauauaacucaacauaucgaguuguaucuguauuaacaguauuacaccaagauuggcuuaacgguaaagaauacaaaugcaaaguauccaauaaagcauuaccagccccaauagaaaaaacuauuuccaaagcaaaaggacaaccaagagaaccacaaguauacacacuaccaccauccagagacgaauuaacaaaaaaccaaguaagccuuacaugccuaguaaaaggauuuuacccaucagacauagcaguagaaugggaaucaaacggacaaccagaaaacaacuauaaaaccacaccaccaguccuagauucagauggaucauuuuuccuauauucaaaauuaacaguagacaaaagccguuggcaacaaggaaacgucuuuucaugcucaguaaugcaugaagcauuacauaaccauuauacacaaaaaucacucucacuaucacccggcaaa

SEQ ID NO: 46096 - RNA, 642 nt, Artificial Sequence
  derived and/or modified sequence opt6 from Elotuzumab_LightChain1
gacauacaaaugacacaaucaccaucaucacuaucugcaucaguaggagacagaguaacaauaacaugcaaagcuucacaagauguaggaauagcaguagcaugguaucaacaaaaaccaggaaaaguaccaaaacuccuuauauacugggcaucaacaagacacacaggaguaccagacagauuuucaggaucaggaucaggaacagacuucacauuaacaauaucaucauuacaaccagaagacguagcaacauacuacugccaacaauacucaucauacccauacacauucggacaaggaacuaaaguagaaauaaaaagaacaguugcagcaccaucaguauucauauuccccccaucagacgaacaacuaaaaucaggaacagcaucaguaguaugccuacuaaacaacuucuacccaagagaagcaaaaguacaauggaaaguagacaacgcacuacaaucaggaaauucacaagaaucaguaacagaacaagacucaaaagacucaacauacucacuaagcucaacauuaacacuaucuaaagcagacuacgaaaaacacaaaguauacgcaugugaaguaacacaccaaggcuuaagcucaccaguaacaaaauccuucaacagaggagaaugc

SEQ ID NO: 46097 - RNA, 1338 nt, Artificial Sequence
  derived and/or modified sequence opt6 from Emactuzumab_HeavyChain1
cagguucaauuaguucaaucaggagccgaaguuaaaaaacccggagcaucaguaaaaguaagcuguaaagcuaguggauacacauucacaagcuaugacaucucauggguaagacaagcaccaggacaaggacuagaauggauggguguaauauggaccgauggaggaacuaauuacgcacaaaaauuacaaggaagaguaacaaugacaacagauacauccacaucaacagcauacauggaacuacgaucacuaagaucagacgauacagcaguauauuacugugcacgugaccaaagauuauacuucgacguauggggacagggaacaacaguaacaguaucaucagcaaguacaaaaggaccuucaguuuuuccacuugcaccuucaucaaaaucaacaagcggaggaacagcagcacuaggaugccuaguuaaagauuauuucccugaaccaguaacaguuucauggaacucaggagcucuaaccucaggcguucauaccuucccugcaguacuccaaucauccggauuauacucgcuuucaucaguuguaacaguaccauccucaucacuaggcacacaaacauacauuuguaacguaaaccauaaaccaucaaacacuaaagucgauaaaaaaguugaaccaaaaucaugcgacaaaacucacacauguccaccaugcccagcacccgaacuccuaggaggcccaucaguauuuuuauucccaccaaaaccaaaagacacccucaugauaucccgaaccccagaaguaacauguguaguagucgauguuagccaugaagacccagaaguaaaauuuaacugguacguggacggaguagaaguacacaaugccaaaacaaaaccaagagaagaacaauacaacagcaccuaccgaguaguaucaguauuaaccguucuacaucaagauuggcuuaacggaaaagaauacaaaugcaaagucagcaauaaagcacuacccgcaccaauagaaaaaacaauaucaaaagcaaaaggccaaccuagagaaccacaaguauauacacuaccaccaucaagagaugaauuaacaaaaaaucaaguaagccuaacaugccuaguaaaaggauucuacccaagugacauugcaguugaaugggaaucaaauggacaaccagaaaauaauuauaaaacaacaccucccguacucgacucagacggaucauucuuuuuauacucaaaacuaacagucgacaaaucaagauggcaacaaggaaacguauucucauguuccguaaugcacgaggcacuacacaaccauuacacacaaaaaucauuaucacuaucaccaggaaaa

SEQ ID NO: 46098 - RNA, 639 nt, Artificial Sequence
  derived and/or modified sequence opt6 from Emactuzumab_LightChain1
gacauacaaaugacacaaucaccaucaucauuaucagcaucaguaggagacagaguaacaauuacaugcagagcaucagaagacguaaacacauacguaucaugguaccaacaaaaaccaggaaaagcaccaaaacuacuaauauaugccgcaucaaacagauacacaggcguacccuccagauucucaggauccggaucuggaacagacuucacauuaacaauaucaucccuacaaccagaagacuucgcaacauacuacugccaacaaucuuucucauacccaacauucggacaaggaacaaaacucgaaauaaaacgaacagucgcagcaccaucaguauucauauucccaccaucagacgaacaacuaaaaucaggcacagcaucaguaguaugucuacuaaacaacuucuacccaagagaagcaaaaguacaauggaaaguagacaacgcacuacaaucaggaaacucacaagaaucugucacagaacaagacucaaaagauucaacauacucacuaucaucaacauuaacacuaucaaaagccgacuacgaaaaacacaaaguauacgcaugcgaaguaacacaccaaggacuaucaucacccguaacaaaaucauucaacagaggcgaaugc

SEQ ID NO: 46099 - RNA, 1323 nt, Artificial Sequence
  derived and/or modified sequence opt6 from Emibetuzumab_HeavyChain1
caaguucaauuaguacaaucaggcgcagaaguaaaaaaaccaggagcaucaguaaaagucagcugcaaagcaucuggauacacauuuacagacuacuauaugcacuggguaagacaagcaccaggucaaggacuagaauggaugggcagaguaaauccaaaccgacgaggaacaaccuauaaccaaaaauuugaaggaagagucacaaugacaacagauacaucaacauccacugcauacauggaacuucguucacuacgaucagacgacacagcaguauacuauugcgcacgagcaaauuggcuugacuacuggggacaaggaacaaccguuacaguaaguucagccucaacaaaaggaccaaguguauuuccacuagcuccuugcucuagaucaacaucagaaucuacugcagcauuaggaugucuuguaaaagauuauuuucccgaaccaguaacaguaucuuggaacucaggagcucuaaccucaggaguucauacauucccagcaguauuacaauccucaggcuuguacucccucucaucaguaguaacagucccaucaucaagcuuaggaacaaaaaccuacacaugcaacgucgaccacaaaccaucaaauacaaaaguagacaagagagucgaaucaaaauaugguccgccauguccaccauguccagccccagaagccgcaggagguccaucuguuuuccuauucccaccaaaacccaaagauacauuaaugaucucaagaacaccagaaguaacaugcguaguaguagauguuucccaagaagaccccgaaguacaauuuaacugguacguagacggaguggaaguacacaacgcaaaaacaaaacccagagaagaacaauucaacucaacauacagaguuguaucaguacuuacuguauuacaucaagacuggcuaaauggaaaagaauauaaauguaaaguaaguaacaaaggauuaccauccuccauagaaaaaaccauaucaaaagcuaaaggacaacccagagaaccacaaguauacacucuaccaccaucacaagaagaaaugacuaaaaaucaaguaucacuaacaugucuaguaaaaggauucuauccaucagacauagcaguugaaugggagucuaauggacaaccagaaaauaacuacaaaacaacuccacccguacuagacucagacgguucauucuuucuauauucaagacuaacaguagacaaauccagauggcaagaaggaaauguauucucauguucaguaaugcaugaagcauuacacaaccacuacacacaaaaaucacuaagucuaucauuagga

SEQ ID NO: 46100 - RNA, 645 nt, Artificial Sequence
  derived and/or modified sequence opt6 from Emibetuzumab_LightChain1
gacauacaaaugacccaaucaccaucaucacuaucagcaucaguaggagacagaguaacaauaacaugcucagucucaucauccguaucaucaauauaccuacacugguaccaacaaaaaccaggaaaagcaccaaaacuauuaauauacucaacaucaaaccucgcaucaggaguacccucaagauucucaggaucaggaucaggcacagacuucacacuaacaauauccucacuacaaccagaagacuucgcaacauacuacugccaaguauacucuggauacccacuaacauucggaggaggaacaaaaguagaaauaaaaagaacaguagcagcaccaucaguauucauauucccaccaucagacgaacaacuaaaaucaggaacagccuccguaguaugccuauuaaacaacuucuacccuagagaagcaaaaguacaauggaaaguagacaacgcacuacaaucaggaaacucccaagaaucaguaacagaacaagacucaaaagacucaacauacucacuauccucaacacuaacacuaucaaaagccgauuacgaaaaacacaaaguauacgcaugcgaaguaacacaccaaggccuauccucacccgucacaaaaucauucaacagaggagaaugc

SEQ ID NO: 46101 - RNA, 1344 nt, Artificial Sequence
  derived and/or modified sequence opt6 from Emicizumab_HeavyChain1
caaguucaguuaguugaaucaggaggaggacuaguccaaccaggaggaucauuacgacuauccugcgcagcaucaggauucacauucucauauuaugauauccaauggguaagacaagcaccuggaaaaggcuuagaauggguaucaucaauaucaccaagcggacaaucaacauauuaucgaagagaaguaaaaggaagguuuacaauaaguagagacaauucaaaaaacacauuauauuuacaaaugaacucacuaagagcagaagacacugccguauauuacugugcuagacgaacuggacgagaauacggaggaggaugguacuuugauuauuggggacaaggcacucuaguaacaguaucaagcgcaucaacuaaaggaccaagcguuuuuccccuagcaccauguaguagaucaacauccgagaguacagccgcauuaggaugccucguuaaagauuacuucccagaaccaguaacaguaucuuggaauaguggugcuuuaaccucaggaguucauacuuucccagccguacuacaaucaucagguuuauauucacucucgucaguaguaacaguaccaucuucaagcuuaggaacccaaacauacaccugcaacguagaucauaaaccaucaaauacaaaaguagauaaacgcguagaaucaaaauauggacccccauguccaccgugcccagcaccagaauuuuuaggaggaccaagcgucuuucuauuuccacccaaacccaaagauacucuaaugauaucucgcacaccugaaguaacuugcguuguaguagauguaagucaagaagacccagaaguccaauucaacugguauguagauggaguagaaguucacaacgcaaaaacuaaaccccgagaagaacaauauaauaguacauauagaguaguaucaguccuaacaguacuacaucaagacugguuaaacggaaaagaauauaagugcaaaguaucaaacaaaggauuaccaucaaguauagaaaaaacaauaucaaaagcuaaaggacaaccaagagaaccccaagucuacacacuaccaccaucacaaaaagaaaugaccaaaaaccaaguaucacuaacaugcuuaguaaaaggauuuuacccaagugacauagcaguagaaugggagucaaauggacaaccagaaaauaauuauaaaacuacacccccaguauuggacucagacggcucuuucuucuuauauucuaaauuaacaguugacaaaucuagauggcaagaaggaaauguauucucaugcagcguaaugcacgaagcacuacacaauagauauacacaaaaaucacucucacuaucccca

SEQ ID NO: 46102 - RNA, 1332 nt, Artificial Sequence
  derived and/or modified sequence opt6 from Emicizumab_HeavyChain2
caaguacaacuaguacaaucaggaagcgaacuaaaaaaaccaggagcaucaguaaaaguaucauguaaagcaucaggauacacauuuacugacaauaacauggauuggguaagacaagcaccaggacaaggacuagaauggaugggagauauaaauacacgauccgguggaucaauauauaacgaagaauuucaagauagaguaauaaugacaguagauaaaucaacagacacugcuuauauggaacuauccucauuaagaucugaagauaccgcaacauaucacugcgcacgaagaaaaucauaugguuacuaccuugacgaauggggagaaggaacauuagucacuguaucaagugcaucaacaaaaggaccuucaguauuuccauuagcaccaugcucuagaucuacauccgaaucuacagcagcacuuggaugucuagucaaagacuacuuuccagaacccguuacaguaagcuggaacaguggagcacuuacaucaggaguacauacauuuccagcuguauuacaaucaucagguuuauauucacuaucaucagucguaacaguaccaucuuccucauuaggaacucaaaccuacaccugcaacguagaccauaaacccucaaacacaaaaguagauaaaagaguagaaucaaaauacggaccaccaugcccaccauguccagccccagaauuccuugguggaccauccguauuucuauucccaccaaaacccaaagauaccuuaaugauaucacgaacaccagaagucacaugugucguaguagauguaucucaagaagauccagaaguccaauuuaacugguauguagacgguguagaaguccauaacgcaaaaacaaaaccacgagaagaacaauacaauucaacuuacagaguuguaucuguacuaaccguucuacaccaagacugguuaaacggaaaagaauauaaaugcaaaguaucaaauaaaggucuaccaucaucaauagaaaaaacaauaucaaaagcaaaaggacaaccuagagaaccacaaguauauacauuaccuccaucacaagaagaaaugaccaaaaaucaaguaucauuaacaugcuuaguaaaaggauucuauccauccgacaucgccguugaaugggaaucaaacggucaacccgaaaauaacuauaaaacaacaccaccaguacuagauucagauggaucauucuuucuauauuccaaacuaacgguagauaagucaagauggcaagaaggaaacguauucucaugcucuguaaugcacgaagcuuuacacaaccauuacacucaagaaucacucagcuuaucacca

SEQ ID NO: 46103 - RNA, 642 nt, Artificial Sequence
  derived and/or modified sequence opt6 from Emicizumab_LightChain1
gacauacaaaugacacaaucaccuucaucauuaagcgccucaguaggagauagaguaacaauaacauguaaagcaucaagaaacauagaaagacaauuagcaugguaccaacaaaaaccaggacaagcaccugaacuacuaaucuaucaagcauccagaaaagaaucaggaguaccagacagauucucaggaucaagauacggaacagacuucacacuaacaauauccucauuacaaccagaagacauagcaacauacuacugccaacaauacucagacccaccacuaacauucggaggaggaaccaaaguagaaauaaaaagaacuguagcagcaccaucaguauucauauucccaccaucagacgaacaacuaaaaucaggaacagcaucaguaguaugccuauuaaacaacuucuacccaagagaagcaaaaguacaauggaaaguagacaacgcacuucaaucaggaaacucacaagaaucaguaacagaacaagacucaaaagacucaacauacucauuauccucaacacuaacacuaucaaaagccgacuacgaaaaacacaaaguauacgcaugugaaguaacacaccaaggacuaucauccccaguaacaaaaucauucaacagaggagaaugc

SEQ ID NO: 46104 - RNA, 1347 nt, Artificial Sequence
  derived and/or modified sequence opt6 from Enavatuzumab_HeavyChain1
gaaguacaacuuguagaaucaggcggaggucuuguacaaccaggaggaucucuacgcuuauccugcgcagcaucaggauucacauucagcucauauuggaugucauggguaagacaagccccaggaaaaggucuagaauggguagcagaaauuagacuaaaaucagacaacuacgcaacccacuaugccgaaucaguaaaaggaagauucaccauaucuagagacgacucuaaaaauuccuuauaucuccaaaugaacucguuacgagcugaagacacagcaguauauuauuguacagguuauuaugcugacgccauggacuacuggggacaaggaacucuagucacaguauccucagccuccacuaaaggaccuuccguuuuuccauuagcccccuccuccaaaucuaccucaggaggaaccgcagcacuaggcugucuaguaaaagauuacuuuccagaacccgucacaguuucauggaacuccggagcauuaacuagcggaguacacacauucccagcaguauuacaaucaucaggacuauacucauuaucaucaguaguaacaguaccuuccucuucacucggaacacaaacauauauauguaacguaaaccacaaaccaucaaacacaaaaguagacaaaaaagucgaaccaaaaucaugcgacaaaacacauacaugcccaccaugcccagcaccugaacuauuaggaggaccaucaguauuccuauuuccaccaaaaccaaaagacacacucaugauaucaagaacacccgaaguaaccugcguaguuguagacguuucccacgaagacccagaaguaaaauucaacugguacgucgacggaguagaaguacauaaugcaaaaacaaaaccaagagaagaacaauacaacucaacauacagaguaguauccguucuaacaguauuacaucaagacuggcuaaacggaaaagaauacaaaugcaaaguaucuaacaaagcacuaccugcacccauagaaaaaacaauuucaaaagcuaaaggacaacccagagaaccacaaguauacacacuaccaccaucaagagaagaaaugacaaaaaaccaagucucauuaacaugcuuaguaaaagguuucuaccccucagacauugcaguagaaugggaaucaaacggacaacccgaaaacaacuacaaaaccacaccaccaguacuagacucagacgguucauuuuucuuauacucaaaacuaacugucgacaaauccagauggcaacaaggaaacguauuuuccugcucagucaugcacgaagcacuccauaaccauuacacacaaaaaucacuaucacucuccccugguaaa

SEQ ID NO: 46105 - RNA, 654 nt, Artificial Sequence
  derived and/or modified sequence opt6 from Enavatuzumab_LightChain1
gacauccaaaugacacaaucaccaucaucacuaagugcaucaguaggagacagaguaaccauaaccugcagagccucacaaucaguaucaacaucaucauacucauacaugcacugguaccaacaaaaaccaggcaaagcaccaaaacuacuaauaaaauacgcaucaaaccuagaauccggagucccaucaagauucucaggaucaggcucaggaacagacuucacacuaaccauaucaucacuacaaccagaagacuucgcaacauacuacugucaacacucaugggaaaucccauacacauucggaggaggaacaaaaguagaaaucaaaagaacaguagcagccccaucaguauucauauucccaccaucagacgaacaauuaaaaucaggcacagcaucaguaguaugccuauuaaacaacuucuacccacgcgaagccaaaguacaauggaaaguagacaaugcacuccaauccggaaacucacaagaaucaguaacagaacaagacucaaaagacucaaccuacucacuaucaucaacccuaacacuaucaaaagcagacuacgaaaaacacaaaguauacgcaugcgaaguaacacaccaaggccuaucaucaccaguaacaaaaucauuuaaccgaggagaaugc

SEQ ID NO: 46106 - RNA, 1341 nt, Artificial Sequence
  derived and/or modified sequence opt6 from Enfortumab_HeavyChain
gaaguacaacuaguagaaucaggagguggauuaguacaaccaggugguagucuuagacucaguugcgcagcaucaggauucacauuuagcucauacaauaugaacuggguaagacaagcaccaggaaaaggacuagaaugggucucuuacauaucaucaucaucaucuacaauauauuaugccgacucuguuaaaggaagauuuacaauaucacgagauaacgcaaaaaauucauuauccuuacaaaugaauucuuuaagagacgaagauacagccguauauuacugcgcacgugcauauuauuauggcauggauguauggggacaaggaacaacagucaccguuucaucugcaucaaccaaaggaccaagcguauuuccauuagccccuucaagcaaaucaacauccgguggaaccgcagcauuaggaugucuaguuaaagauuauuuccccgaaccagucacagucucauggaauucaggagcccuaacaucagguguacacaccuucccagcaguauuacaaucaagcggucuauacucauuaucuaguguuguaacaguacccucaucaucauuaggaacacaaacauacauaugcaacguaaaccacaaaccaucaaauacaaaaguagacaaaagagucgaaccaaaaucuugugauaaaacacauacaugccccccaugcccagcucccgaacuauuaggaggacccuccguauucuuauuccccccaaaaccaaaagacacacucaugauaucaagaacaccugaaguaacauguguaguagucgacguaucacacgaagacccagaaguaaaauuuaacugguauguagauggaguagaaguacacaaugccaaaacaaaaccaagagaagaacaauacaauucaacuuacagagucguauccguacuuacaguucuacaccaagacugguuaaauggaaaagaauacaaaugcaaagucucaaauaaagcauuaccagcaccaauagaaaaaacaauuucaaaagcaaaaggucaaccacgagaaccacaagucuacacacuaccaccauccagagaagaaaugacaaaaaaccaaguaucacuaacauguuuaguaaaaggauucuaccccucagauaucgcaguagaaugggaaucaaauggucaaccagaaaauaauuacaaaacaaccccacccguuuuagauucagauggaucauucuucuuauauucuaaacucacuguagauaaaucaagauggcaacaaggcaaugucuucagcuguucagucaugcacgaagcacuacacaaccacuacacucaaaaaucauuaucccuuucuccagguaaa

SEQ ID NO: 46107 - RNA, 642 nt, Artificial Sequence
  derived and/or modified sequence opt6 from Enfortumab_LightChain
gacauacaaaugacacaaucaccaucaaguguaucagcaucaguaggagaccgaguaacaauaacauguagagcaucacaaggaauaucaggauggcuagcaugguaccaacaaaaaccaggaaaagcaccaaaauucuuaauauacgcagcaucaacacuacaaucaggaguaccaucaagauuuucaggaucaggaucaggaacagauuucacauuaacaauaucaucauuacaaccagaagauuucgcaacauacuacugccaacaagcaaacucauucccaccaacauucggaggaggaacaaaaguagaaaucaaacgaacagucgcagcaccaagcguauuuauauucccaccaucagacgaacaacuaaaaucaggaacagcauccguaguaugccuauuaaacaacuuuuacccaagagaagcaaaaguacaauggaaaguagacaacgcacuacaaucaggaaacucacaagaaucaguaacugaacaagacucaaaagacucaacauacucccuauccucaacacuaacuuuaagcaaagcugacuacgaaaaacacaaaguauacgcaugcgaaguaacacaccaaggauuaagcucaccaguaacaaaaucauucaauagaggagaaugc

SEQ ID NO: 46108 - RNA, 1341 nt, Artificial Sequence
  derived and/or modified sequence opt6 from Enfortumab_vedotin_HeavyChain1
gaaguacaacuaguagaaucuggaggcggacucguacaaccaggaggaucacuaagauuaucaugcgcagccucagguuuuacauucuccucauacaacaugaacuggguuagacaagcacccggaaaaggacuagaaugggucuccuacauaucaucaaguagcucaacaauauauuacgccgauuccguaaaaggcagauuuacuauaucaagggacaaugcaaaaaacagccuaucauuacaaaugaacucacuaagagacgaagacacagcuguauacuauugugccagagcauacuauuacggcauggacguauggggccaaggaacaacaguuacaguaucaucagcuuccacuaaaggaccaaguguauucccauuagcaccaaguaguaaaucuacaucaggcggcaccgccgcacuaggaugucuaguaaaagacuacuucccagaacccguuacaguaucauggaacucuggcgcauuaacaucaggaguacacaccuuuccagccguucuacaaucuucaggacuauauucacuaaguucaguaguuacaguaccaucaucaagucucggaacucaaacauauaucugcaauguaaaccacaaaccaucaaacacuaaaguagauaaacgcguagaaccuaaaucaugcgauaaaacacacacaugcccaccauguccagcuccagaauuacuaggaggcccaaguguauuuuuauuucccccaaaaccaaaagacacauuaaugaucucaagaacaccagaagucacaugcgucguaguagacguaucacacgaagacccagaagucaaauucaauugguacguagauggcguagaaguacacaacgcuaaaacaaaaccaagagaagaacaauacaauucaacuuacagagucguaucaguauuaaccguacuucaucaagauuggcucaaugguaaagaauauaaaugcaaaguaucuaacaaagcuuuaccagcaccaauugaaaaaaccauaucuaaagcaaaaggccaaccuagagaaccacaaguauacacauuaccaccuagcagagaagaaaugacaaaaaaucaaguaucccuuacaugucucguaaaaggauuuuacccaucagacaucgcaguagaaugggaaagcaauggacaaccagaaaauaacuacaaaacaacccccccaguucuagacucagacggaucauucuuccuauauucaaaauuaacaguagauaaaucaagauggcaacaagguaacguauucuccuguagcguaaugcacgaagcauuacauaaccacuacacacaaaaaucauuaaguuuaucaccuggaaaa

SEQ ID NO: 46109 - RNA, 642 nt, Artificial Sequence
  derived and/or modified sequence opt6 from Enfortumab_vedotin_LightChain1
gacauacaaaugacacaaucaccaucaucaguaagcgcaucaguaggagacagaguaaccauaacauguagagcaucacaaggaauaucaggaugguuagcaugguaccaacaaaaaccaggaaaagcacccaaauuccuaauauaugcagcaucaacacuacaaagcggaguaccaagcagauucucaggaucaggaucaggaacagacuuuacauuaacaauaucaucauuacaaccagaagacuucgccacauacuacugccaacaagcuaacucauucccaccaacauucggaggagguacaaaaguagaaauaaaaagaacaguugcagcaccaucaguauucauauucccaccaucagacgaacaauuaaaaucaggaacagcaucaguaguaugccuacucaacaacuuuuacccaagagaagcaaaaguccaauggaaaguagacaacgcacuacaaagcggaaacucacaagaaucaguaacagaacaagauagcaaagacucaacauacaguuuaagcucaacacuaaccuuaaguaaagcagauuacgaaaaacauaaaguauacgcaugcgaaguaacacaccaaggccuaucaucaccaguaacaaaaucauucaacagaggcgaaugc

SEQ ID NO: 46110 - RNA, 1356 nt, Artificial Sequence
  derived and/or modified sequence opt6 from Enoblituzumab_HeavyChain
gaaguacaauuaguagaaucaggaggaggcuuaguacaaccaggaggaucauuaagacuaucaugcgcugcaucaggauucacuuucaguaguuucgguaugcacugggugagacaagcaccagguaaaggauuggaauggguagccuauauaucaucagauuccagugcaaucuauuacgcugauacaguaaaaggaagauucacaauaucacgcgauaacgcaaaaaacagucuuuaucuacaaaugaacucauuaagagacgaagacacagcaguauacuauugcggaaggggaagagagaacauuuacuauggaagccgacuagacuacuggggucaagguaccacaguaacaguaucuucagcuucaacuaaaggaccaucaguauuuccauuagcacccuccucuaaauccacaucaggaggaacagcagcauuaggcugucuagucaaagauuauuuuccagaaccaguaacaguuucauggaacucaggagcauuaacuagugguguacauaccuuuccagcaguauuacaaucaaguggucuauauucauuaucaaguguaguaacaguaccauccuccucacuaggaacucaaacguacauaugcaacguaaaccauaaaccuaguaacacaaaaguagauaaacgaguagaaccaaaaucaugugacaaaacacauaccugucccccaugcccagcacccgaacuaguaggcggaccaaguguauuccuacuaccaccuaaacccaaagacacacuaaugauaucaagaacuccagaaguaacauguguaguaguugacguuucacaugaagaucccgaaguaaaauucaauugguauguagauggcgucgaaguucacaacgcaaaaacuaaaccaccagaagaacaauacaacucaacauuaagaguaguaucaguauuaacaguucuacaccaagauugguuaaacggaaaagaauauaaaugcaaaguauccaacaaagcauuaccagcacccauagaaaaaacuauuucaaaagcaaaaggccaaccuagggaaccacaaguauauacauuaccaccauccagagaagaaaugacaaaaaaccaaguaucucuaacauguuugguaaaaggcuucuauccauccgauauagcaguagaaugggaaagcaauggccaaccagaaaacaauuacaaaacaacacccuuaguauuagacucagauggaucauuuuucuuauacucaaaauuaacaguugacaaaucaagauggcaacaagguaacgucuuuagcugcucaguaaugcaugaagcacuacauaaccauuauacacaaaaaucacuaucucuaucaccaggaaaa

SEQ ID NO: 46111 - RNA, 642 nt, Artificial Sequence
  derived and/or modified sequence opt6 from Enoblituzumab_LightChain
gacauacaacucacacaaucacccucauuuuuaucagcaucaguaggcgacagaguaacaauaacaugcaaagcaucacaaaacguagacacaaacguagcaugguaccaacaaaaaccaggaaaagcacccaaagcacuaauauacucagccagcuacagauacucaggaguaccaagcagauucucaggaucaggaucaggaacagacuucacccuaacaauaucaucacuccaacccgaagacuucgcaacauacuacugccaacaauacaacaacuacccauucacauucggacaaggaacaaaacuagaaauaaaacgaacaguagcagcaccauccguauucauauucccaccaucagacgaacaacuaaaaucaggcacagcaucagucguaugccuacuaaacaacuucuauccacgagaagcaaaaguacaauggaaaguagacaacgcacuacaaucaggaaacucacaagaauccguaacagaacaagacucaaaagacucaacauacucauuaagcuccacacuaacacuaucaaaagcagacuaugaaaaacacaaaguauacgcaugcgaaguaacccaccaaggauuaucaucaccaguaacaaaaucauucaacagaggagaaugc

SEQ ID NO: 46112 - RNA, 1356 nt, Artificial Sequence
  derived and/or modified sequence opt6 from Enokizumab_HeavyChain1
caaguacaacuagugcaaucaggagcagaaguaaaaaaaccaggcucauccgucaaagugaguuguaaagcaucaggugguacauucucauauuacuggauagaaugggucagacaagcacccggacaaggacuagaauggaugggagaaauucuacccggaucaggaaccacaaacccaaacgaaaaauuuaaaggacgaguaacaauaacagcagacgaaucaacauccacagcauacauggaauuauccucucuaaggucugaagacacagcaguauauuacugugccagagcagacuauuacggaucugauuauguaaaauuugacuacuggggacaaggaacacuaguaaccguauccucagcaucaaccaaaggaccaucaguauuuccauuagcaccaucauccaaauccacaucuggagguacggcagcauuaggaugcuuaguaaaagacuacuuuccagaaccaguaaccguaucguggaacucaggagcacuaacuuccggaguacacacauuuccagcaguacuacaaucauccggucuauacucccuaaguucaguagucacuguuccaucaucaucucuaggaacacaaacauacauaugcaacguaaaccauaaaccaucuaacacgaaaguagauaaacgcguagaaccaaaaucaugugauaaaacacacacaugcccaccaugcccagcaccagaauuauuaggaggaccaucaguuuuccuauuuccaccaaaaccaaaagacacucuaaugauuucaagaacaccagaaguaacaugugucguaguugauguaucacaugaagacccagaaguaaaauucaacugguacguggaugggguagaaguacacaaugcaaaaacaaaaccaagagaagaacaauauaacagcacuuauagaguaguaagcguacuaacaguauuacaccaagacugguuaaacgguaaagaauacaaauguaaaguaaguaauaaagcacuacccgccccaaucgaaaaaacuauaucuaaagccaaaggacaaccacgugaaccacaagucuacacauuacccccaagcagggaagaaaugacuaaaaaccaaguaagucuaacaugcuuaguaaaaggauucuacccauccgauauagcaguagaaugggaaucaaacggccaaccagaaaauaauuauaaaacaacaccuccaguauuagacagugacggaucauuuuucuuauauucaaaauuaacaguagauaaaucaagauggcaacaaggaaacguauucucauguucaguaaugcacgaagcauuacauaaucacuauacucaaaaaucauuaagcuuaucaccaggaaaa

SEQ ID NO: 46113 - RNA, 642 nt, Artificial Sequence
  derived and/or modified sequence opt6 from Enokizumab_LightChain1
gauauacaaaugacacaaucaccaucaucacuaucagcaucaguaggagauagaguaacaauaacaugcaaagcaucacaacacguaauaacacauguaaccugguaccaacaaaaaccaggaaaagcaccaaaacucuuaauauacggaacaucauacagcuacuccggaguaccauccagauucucaggaucaggaucaggaacagacuucacacuaacaauaucaucccuacaaccagaagacuucgcaacauacuacugccaacaauucuacgaauacccacuaacauucggaggaggaacaaaagucgaaauaaaaagaacaguagcagcaccaucaguauucauauucccacccucagacgaacaauuaaaaucaggaacagccucaguaguaugccuacuaaacaacuucuacccaagagaagcaaaaguacaauggaaagucgauaacgcacuacaaucaggaaacucacaagaaagcguaacagaacaagacucaaaagacuccacuuacagccuaucaucaacacuaacacuaucaaaagcagacuacgaaaaacacaaaguauaugcaugcgaagucacacaccaaggacuauccuccccaguaacaaaaucauucaacagaggcgaaugc

SEQ ID NO: 46114 - RNA, 612 nt, Artificial Sequence
  derived and/or modified sequence opt6 from Enokizumab_LightChain
gacauacaaaugacacaaucaccaucaucccuauccgcaucaguaggagacagaguaacaauaacaugcaaagcaucacaacacguaaucacacacguaaccugguaccaacaaaaaccaggaaaagcaccaaaacuacuaauauacggcacaucauacucauacuccggaguaccaucaagauucucaggaucaggauccggaacagacuucacauuaacaauaagcagccuacaaccagaagacuucgccacauacuacugccaacaauucuacgaauacccacuaacauucggaggaggaacaaaaguagaaauaaaacgaacaguagcagcaccaucaguauucauauucccaccaucagacgaacaacuaaaaucuggaacagcaucaguaguaugccuacuaaauaacuucuacccaagagaagcuaaaguacaauggaaaguagaaucagucacagaacaagacucaaaagacucaacauacucccuaucaucaacauuaacauuaucaaaagcagauuacgaaaaacacaaaguauacgcaugcgaaguaacacaccaaggacuaucaucaccaguaacaaaaucauucaacagaggagaaugc

SEQ ID NO: 46115 - RNA, 1356 nt, Artificial Sequence
  derived and/or modified sequence opt6 from Enoticumab_HeavyChain1
caaguacaacuagucgaaucuggaggaggaguuguucaaccaggaagaucauuaagauuaucaugugcagcuucuggcuucacauuuucauccuacggaaugcacugggucagacaagcaccaggaaaaggcuuagaaugggucucuuuucuaugguacgacggaacuaacaaaaauuacgucgaaucaguaaaaggaagauuuacaauaucaagagauaauucaaaaaauauguuguacuuagaaaugaacucacuucgagcagaagacacagcaguuuacuacugcgcacgagaccaugacuucagaucaggauaugaaggaugguucgacccauggggacaaggaacccuaguuaccgucuccuccgcaucaacaaaaggaccaucuguauuuccauuagcaccaucaucuaaaucuacaagcggcggaacugcagcacucgguugucuaguaaaagauuacuucccagaaccagucacaguauccuggaauucaggagcacuaacauccggaguacauacauucccagcaguacuacaaucaucaggacuauauucauuaucaucuguagucaccguaccaucaucaucucuuggaacacaaaccuauauaugcaacguuaaccauaaaccaaguaacacaaaaguagacaaaaaaguagaaccaaaaagcugcgacaaaacacauacauguccaccaugccccgccccagaauuacuaggagguccaucagucuuuuuauuuccgccaaaaccaaaagacacauuaaugauaucaagaacaccagaaguaacaugcguuguaguagacguaucacacgaagacccugaaguaaaauuuaacugguauguagaugguguagaaguacauaacgcaaaaaccaaaccaagagaagaacaauacaacucaacauaccgaguaguaucaguacuaacaguauuacaucaagauugguuaaaugguaaagaauauaaaugcaaagucucaaacaaagcacuaccagcccccauagaaaaaacaauaucaaaagcaaaaggucaaccaagagaaccucaaguauacacacuaccucccucacgagaugaauuaacuaaaaaucaagucucccuaacaugcuuaguaaaaggauuuuacccaucagauauagcaguagaaugggaaucaaacggccaaccagaaaauaacuacaaaacuacacccccaguacuagacucagacggaucauucuuccuauacagcaaauuaacaguagacaaaagcagauggcaacaaggcaacguauucucuugcucaguaaugcacgaagcauuacacaaccacuacacccaaaaaucacuaucauuaucacccggu

SEQ ID NO: 46116 - RNA, 642 nt, Artificial Sequence
  derived and/or modified sequence opt6 from Enoticumab_LightChain1
gaaauaguauuaacacaaucuccagcaacacuaucacuaucaccaggagaaagagcaacacuauccugcagagcaucacaaucagucucaucuuaccuagcaugguaccaacaaaaaccaggacaagcaccaagacuacuaauauacgaugcaucaaacagagcaacaggaauaccagcaagauucucaggcucaggcucaggaacagacuucaccuuaacaauaagcucuuuagaaccagaagacuuugcaguauacuacugccaacacagaagcaacuggccaccaacauucggaggaggaacaaaaguagaaauaaaacguacagucgcagcaccaucaguauucauauucccaccaucagacgaacaauuaaaaucaggcacagcaucaguaguaugcuuauuaaacaacuuuuacccacgagaagcaaaaguacaauggaaaguagacaacgcacuacaaucaggaaacucacaagaaucaguaacagaacaagacucaaaagacucuacauacuccuuaucaucaacacuaacacuaucaaaagcagacuaugaaaaacacaaaguauacgcaugcgaaguaacacaccaaggacuaucaucaccaguaacaaaaucauucaacagaggagaaugc

SEQ ID NO: 46117 - RNA, 1329 nt, Artificial Sequence
  derived and/or modified sequence opt6 from Ensituximab_HeavyChain1
caaguacaacucaaagaauccggaccagaccucguagcaccaucacaaucauuaucaauaacauguacaguaucaggcuucucauuaucaaaauucggcguaaauuggguaagacaaccaccaggaaaaggauuagaaugguuagguguaauauggggagacggaucaaccucauauaauucuggacuaauaucucgacuaucaauaaguaaagaaaacucaaaaucacaaguauuccuaaaacuuaacucacuacaagcagacgacacagccacauauuauugugucaaaccaggaggagauuauuggggacacggaacuucaguaacaguaucaucagcaucaacaaaaggaccaagugucuucccccuagcaccauccucaaaaucaacuaguggaggaacugcagccuuaggaugccuuguaaaagauuauuuuccagaaccaguaacuguuucuuggaacucaggugcauuaacauccggaguccacacauucccagcaguacuacaaucauccggaccauacucacuaucaucaguaguaacaguacccucaucaucauuaggaacccaaacuuauauaugcaaugugaaucacaaaccaagcaacacaaaaguagacaaaaaagucgaaccaaaaucaugcgauaaaacacacacaugcccacccugcccagcaccagaacuauuaggaggacccucuguauucuuauucccacccaaacccaaagacacacuuaugaucucaagaacacccgaaguaacauguguagucguagacgugucucacgaagacccagaagucaaauucaacugguacguagacggagucgaaguacacaacgcaaaaacuaaaccaagagaagaacaauauaauucaacauaccgcguaguaucaguacuaacaguauuacaucaagacuggcuaaauggaaaagaauauaaauguaaagucucuaacaaagccuuaccagcaccuauagaaaaaacaauauccaaagccaaaggacaaccacgagaaccccaaguauauacacuacccccaucaagagaugaauuaacaaaaaaccaaguaucauuaacaugcuuaguaaaaggcuucuaccccucagacauagcaguugaaugggaaucaaauggacaaccagaaaacaacuauaaaacaaugccaccaguacuagacucagacggcucuuucuuccuauauucaaaacuaacagucgauaaaucccgauggcaacaaggaaauguauucucaugcucaguuaugcaugaagcauuacacaaccauuacacacaaaaaaguuuaucucucucaccagguaaa

SEQ ID NO: 46118 - RNA, 639 nt, Artificial Sequence
  derived and/or modified sequence opt6 from Ensituximab_LightChain1
caaguaguacuaacacaaucaccaguaaucaugucagcaucaccaggagaaaaaguaacaaugacaugcucagcaucaucaucaauaucauacauguauugguaccaacaaaaaccaggaacaucacccaaacgauggauauacgacacaucaaaacuagcauccggaguaccagcaagauucucaggauccggaucaggaacauccuacagccuaacaauaucaaacauggaagcaggagacgcagcaacauacuacugccaccaaagagacucauacccauggacauucggaggaggaacaaacuuagaaaucaaaagaacagucgcagcaccaucaguauucauauuuccaccaucagacgaacaacuaaaauccggaacagcaucaguuguaugccuauuaaacaacuucuacccaagagaagcaaaaguacaauggaaaguagacaacgcacuacaaucaggaaacucacaagaaucaguaacagaacaagacucaaaagacuccacauacagccuaucauccacacuaacauuaucaaaagccgacuacgaaaaacacaaaguuuacgcaugcgaagucacacaucaaggacuaucaucaccaguaacaaaaagcuucaacagaggagaaugc

SEQ ID NO: 46119 - RNA, 768 nt, Artificial Sequence
  derived and/or modified sequence opt6 from Ensituximab_SingleChain_variable_fragment
auggcggaaguacaauuaguagaaagcggagcugaaguaaaaaaaccaggagaaagccuaagaauaaguuguaaaggaucuggauguauaauaucaaguuauuggauaagcuggguuagacaaaugccaggaaaaggacuagaauggaugggaaaaauagauccaggagauucauauauaaauuacagcccaagcuuucaaggacauguaacaauaagugcagacaaaucaauaaauacagcauaucuucaauggaauaguuuaaaagcaagugauacagcaauguauuacugugcaagaggagggagagauuuuggggauaguuuugauuauuggggacaaggaacauuaguaacaguaaguucaggaggaggaggaucaggagguggaggaagcggaggaggcgggagugauguaguaaugacacaaucaccaucauuuuuaagugcauuuguaggagaucguauaacuauaacauguagagcaucaaguggaauaaguagauauuuagcaugguaucaacaagcaccaggaaaagcaccaaaauuauuaauauaugcagcaagcacucuacaaacaggaguaccaagcagauuuaguggaucaggaaguggaacugaauuuacacuaacaauaaauucauuacaaccagaagauuuugcaacauauuauugucaacaucuaaauucauacccauuaacauucgguggaggaacaaaaguagauauaaaaagagcagcagcacuagaacaucaccaucaucaucau

SEQ ID NO: 46120 - RNA, 987 nt, Artificial Sequence
  derived and/or modified sequence opt6 from Entolimod_chain1
augagaggcagccaccaccaccaccaccacggaauggcaaguaugacaggaggacaacaaaugggaagagaccucuacgacgaugacgacaaagacccaauggcacaaguuauaaacacaaacucucuaucacuacuaacacaaaacaacuugaacaaaagccaaucaucauuaaguucagcaauagaaagauuaagcucaggacuacgaauaaacucagcaaaagacgacgcagcaggacaagcaauagcaaacagauucacaucaaauauaaaaggauuaacacaagcaucaagaaacgcaaaugacggaauaaguauagcccaaacaacagaaggagcacuaaaugaaauaaacaauaaccuacaaagaguaagagaacucucaguccaagcaacaaacggaacaaacagugacucagaccuuaaaucaauacaagacgaaauacaacaaagacucgaagaaauagacagaguaucaaaccaaacccaauuuaacggaguuaaaguauuaagccaagacaaucaaaugaaaauacaaguaggagcaaaugauggagaaaccauaacaauagacuuacaaaaaauagacguaaaaagcuuaggccuagacggauucaacguaaacucaccaggaauaucaggaggaggaggaggaauauuagauucgaugggaacacuaauaaacgaagacgccgcagcagcaaaaaaaucaacagcaaauccauuagcaucaauagacuccgcauuaaguaaaguagacgcaguaagauccucauuaggagcaauacaaaacagauucgacucagcaaucacaaauuuaggaaacacaguaacaaacuuaaacucagcaagaucaagaaucgaagacgcagacuacgcaacagaaguaaguaacaugucaaaagcacaaauacuacaacaagcagggacaagcguauuagcacaagcaaaccaaguaccacaaaauguacuauccuuauuaaga

SEQ ID NO: 46121 - RNA, 1338 nt, Artificial Sequence
  derived and/or modified sequence opt6 from Epratuzumab_HeavyChain
caaguacaauuaguacaaucaggagcagaaguaaaaaaaccaggcucaucaguaaaaguauccugcaaagccucuggauacacauuuacauccuacugguuacauuggguccgacaagccccaggacaaggucuugaauggauaggcuauaucaauccacgaaacgacuauacagaauauaaccaaaacuucaaagacaaagcaacaaucacagcagaugaaucaacaaacacagcauacauggaauuaagcucacuaagauccgaagacacagcauucuauuuuugcgcaagaagagacauaacaacauuuuacuggggacaaggcacauugguaacaguaucaucagcaucuaccaaaggaccaucagucuucccacuagcacccucaagcaaauccacaagcggaggaacagcugcacuaggaugucuaguaaaagacuacuucccagaaccagucacagucucauggaacucaggagcauuaaccucaggcguacacaccuucccagcaguacuacaauccucaggacuauacucauuaucaaguguugucacaguucccucaucaucacuagguacacaaacauacauaugcaacguaaaccauaaaccaucaaauacaaaaguagauaaaaaaguagaaccaaaauccugugacaaaacacacacaugcccacccugcccagcaccagaacuauuaggaggaccuucuguauuccuuuuuccaccaaaacccaaagacacccucaugaucagcagaacacccgaaguaacuuguguagucguagacguaucacaugaagauccagaaguaaaauuuaacugguacguugacggaguagaaguacauaacgcaaaaacaaaaccacgagaagaacaauacaacucuacauauagagucguauccguacuaacaguacuccaccaagacuggcuaaacggaaaagaauacaaauguaaaguaucuaacaaagcauuaccugcacccauugaaaaaaccauaucuaaagcaaaaggacaaccaagagaaccacaaguauacacacuaccaccaucucgcgaugaacuaacaaaaaaccaaguaucacuaacuugcuuaguaaaaggauucuacccaagcgauauagcaguggaaugggaaucaaauggacaaccagaaaacaacuacaaaacaacaccuccaguacuagauucagacggauccuucuuucuauacucuaaauuaacaguagauaaaucaagauggcaacaaggaaaugucuucucaugcucaguaaugcacgaagcacuacacaaucauuauacacaaaaaucacucucccuaucaccaggcaaa

SEQ ID NO: 46122 - RNA, 657 nt, Artificial Sequence
  derived and/or modified sequence opt6 from Epratuzumab_LightChain
gacauacaacuaacccaaucaccaucaucccuaucagcaucaguaggagacagaguaacaaugucuugcaaaucaagucaaucaguacuauacucagcaaaccacaaaaacuaucuagcaugguaccaacaaaaacccggcaaagcaccaaaacuauuaauauacugggcaucaacaagagaaucaggaguaccaucacgcuucucaggaucaggaucaggaacagacuucaccuucacaauaucaucauuacaaccagaagacauagcaacauauuacugccaccaauacuuaucaucauggacauuuggacaaggaacaaaaguagaaauaaaaagaacaguagcagcaccaucaguauucauauucccaccaucagacgaacaacuaaaaucaggcacagccuccguaguaugccuacuaaacaauuuuuacccaagagaagcaaaaguacaauggaaaguagacaacgcacuucaaucaggaaacucacaagaauccguaaccgaacaagacucaaaagacucaacauacucauuaucauccacccuaacacuaucaaaagcagacuacgaaaaacacaaaguauacgcaugcgaaguaacacaccaaggccuaucuucaccaguaaccaaaucauucaacagaggagaaugu

SEQ ID NO: 46123 - RNA, 762 nt, Artificial Sequence
  derived and/or modified sequence opt6 from Eptacog_beta_HeavyChain1
auaguaggaggaaaaguauguccaaaaggugaaugcccauggcaaguacuauuacuaguaaauggagcacaauuauguggaggaacauuaauaaacacaauauggguaguaucagcagcacacuguuuugauaaaauaaaaaauuggagaaauuuaauagcaguacuaggagaacaugaucuaagugaacaugauggagaugaacaaagucgacgaguagcacaaguaauaauaccaucaacauauguaccaggaacaacaaaucaugacauagcacuauuaagauuacaccaaccaguaguacuaacagaucauguaguaccauuauguuuaccagaaagaacauuuucagaaagaacauuagcuuuuguaagauucucccuaguaucaggauggggacaacuacuagauagaggagcaacagcauuagaauuaaugguauuaaauguaccaagacuaaugacacaagauuguuuacaacaaucaagaaaaguaggagauucaccaaauauuacagaauauauguucugugccggauauucagauggaagcaaagauaguuguaaaggagacaguggaggaccacaugcaacacauuauagaggaacaugguauuuaacaggaauaguaucauggggacaaggaugugcuacaguaggacauuuuggaguuuauacaagaguaagucaauauauagaauggcuacaaaaauuaaugagaucagaaccaagaccaggaguacuacuaagagcaccauuucca

SEQ ID NO: 46124 - RNA, 456 nt, Artificial Sequence
  derived and/or modified sequence opt6 from Eptacog_beta_LightChain1
gcaaacgcauucuuagaagaacuaagaccaggaagccuagaaagagaauguaaagaagaacaaugcucauucgaagaagcaagagaaauauuuaaagacgcagaaagaacaaaauuauucuggauaucauacucagacggagaccaaugcgcaagcaguccaugucaaaauggaggaagcuguaaagaccaauuacaaaguuacauaugcuuuugccuaccagcauucgaaggaagaaacugugaaacacacaaagacgaccaauuaauaugcguaaaugaaaauggaggaugcgaacaauacugcucagaccauacaggaacaaaaagaucaugcagaugccaugaaggauacucauuacuagcagacggaguaagcuguacaccaacaguagaauauccaugcggaaaaauaccaauauuagaaaaaagaaaugcaucaaaaccacaaggaaga

SEQ ID NO: 46125 - RNA, 708 nt, Artificial Sequence
  derived and/or modified sequence opt6 from Erlizuab_HeavyChain1
gaaguacaauuaguagaaucaggaggaggacuaguacaaccaggaggaucacuaagauuaucaugcgcaacaagcggauacacauucacagaauauacacauuggagacaagcaccaggaaaaggacucgaauggguagcaggaauaaauccaaaaaacggaggaacaucacauaaccaaagauuugacagauucacaauaucaguagacaaaagcacaucaacagcuuaccaaaacucauuaagagcagaagacacagcaguauacuauugugcaagauggagaggauuaaacuacggauucgacguuagauacuuugacguauggggacaaggaacacuaguaacaguaucauccgcaucaacaaaaggaccaucaguauucccauuagcaccaucaucaaaaaguacaucaggaggaacagcugcauuaggaugucuaguuaaagacuacuucccagaaccaguaacaguaucauggaacucuggagcauuaacaagcggaguacacacauuuccugcaguauuacaaagcagcggacuauauucauuaucaaguguaguaacaguaccaagcucaucauuaggaacacaaacauacauaugcaacguaaaccauaaaccaucaaauacaaaaguagauaaaaaaguagaaccuaaaucaugugauaaaacacacacaugucccccaugcccagcaccagaauua

SEQ ID NO: 46126 - RNA, 639 nt, Artificial Sequence
  derived and/or modified sequence opt6 from Erlizuab_LightChain1
gacauacaaacacaaucacccucaucacuauccgcauccguaggagaccgaguaacaauaacaugcagagccucacaagacauaaacaacuaccuaaacugguaccaacaaaaaccaggaaaagcaccaaaauuacuaaucuacuacacaucaacacuacacucaggagucccaucaagauucucaggaucaggcucaggaacagacuacacacuaacaauaucaucacuacaaccagaagacuucgcaaccuacuacugccaacaaggaaacacacuaccaccaacauucggacaaggaacaaaaguagaaauaaaacgaaccguagcagccccauccguauucauauucccaccaucagacgaacaacuaaaaucaggaacagcaucaguaguaugccuacuaaacaacuucuacccacgagaagcaaaaguacaauggaaaguagacaacgcacuccaaucaggaaacucacaagaaucaguaacagaacaagacucaaaagacucaacauacuccuuaucaucaacacuaacccuaucaaaagcagauuacgaaaaacauaaaguauacgcaugcgaaguaacacaccaaggacuaucaucuccaguaacaaaaucauucaacagaggagaaugc

SEQ ID NO: 46127 - RNA, 1341 nt, Artificial Sequence
  derived and/or modified sequence opt6 from Etaracizumab_HeavyChain1
caaguccaauuagucgaaucgggcgguggaguaguccaaccaggaagaucacuaagauuaucgugugcagcauccggauucacuuucuccucauacgauaugucauggguccgccaagcacccggaaaaggauuagaauggguagcuaaaguaucauccgguggaggaucuacauauuauuuagacaccguucaaggaagauucacaauaucaagagacaacucaaaaaauacucuuuaucuccaaaugaacucacuacgcgccgaagacacugcagucuacuacugcgcacgucaccuccauggcucauucgcaucauggggccaaggaacaacuguaacagucucaucagcaucaacuaaaggaccaucuguauuccccuuagcaccaucaagcaaaucaacaucagguggaacugcagcacuaggcugucuaguuaaagauuacuucccugaaccaguuacaguaucauggaauaguggcgcauuaacuucagguguacacacauucccagcaguacuacaaucauccggauuauauucuuuaucaucaguugucacagucccauccuccucauuaggaacacaaaccuauauauguaacguaaaccacaaaccaagcaauacaaaaguagauaaaagaguagaaccaaaaucaugcgauaaaacacacacaugccccccuugcccagcaccugaauuauuaggaggacccucaguauuucuauuuccccccaaaccaaaagacacacuaaugauaucaagaacaccagaaguuacaugcguaguaguagacguaucccaugaagauccagaggucaaauuuaacugguauguugauggcguggaaguacacaaugcuaaaacaaaaccaagagaagaacaauacaacucaacauaccgaguaguaucaguucucacaguuuuacaccaagacugguuaaauggaaaagaauacaaauguaaaguaucaaauaaagcucuaccagcaccaauagaaaaaacaauaagcaaagcaaaaggacaacccagagaaccacaagucuauacauuacccccaucuagagaagaaaugacaaaaaaccaaguaucauuaacauguuuaguaaaaggauucuacccaucagacaucgcaguagaaugggaauccaacggucaaccagaaaauaacuacaaaacaacaccucccguuuuagauucugacggaucauucuuccuuuacucaaaauuaacaguagacaaaucccgauggcaacaaggaaacguauucaguuguucaguaaugcaugaagcacuucacaaucauuacacacaaaaauccuuaucuuuaucuccaggcaaa

SEQ ID NO: 46128 - RNA, 642 nt, Artificial Sequence
  derived and/or modified sequence opt6 from Etaracizumab_LightChain1
gaaauaguauuaacacaaucaccagccacacuaucacuauccccaggagaacgagcaacacuauccugccaagcaucacaaucaauaucaaacuuccuacacugguaccaacaaagaccaggacaagcaccaagacuacuaauaagauacagaucacaaucaauaucaggaauaccagcaagauucucaggaucaggaucaggaacagacuucacccuaacaauaucaucacucgaaccagaagacuucgcagucuacuacugccaacaaucaggcucauggccauuaacauucggaggcggaacaaaaguugaaauaaaaagaacaguagcagccccaucaguauucauauuccccccaucagacgaacaauuaaaaucaggaacagcaucaguaguaugccuacuaaacaacuucuacccaagagaagcaaaaguacaauggaaaguagacaacgcauuacaauccggaaacucacaagaaucaguaaccgaacaagacucaaaagacucaacauacucacuaucaucaacacuaacccuauccaaagccgacuacgaaaaacacaaaguauacgcaugcgaaguaacacaccaaggacuaucaucaccaguaacuaaauccuucaacagaggcgaaugc

SEQ ID NO: 46129 - RNA, 1326 nt, Artificial Sequence
  derived and/or modified sequence opt6 from Etrolizuab_HeavyChain1
gaaguacaauuaguagaaucaggagguggauuaguacaaccagguggaucucuuagacuuucaugcgcagcaucaggcuuuuucauaacaaauaauuacuggggcuggguuagacaagcacccggaaaaggacuagaauggguaggcuacauaucuuacucaggaucaaccucauacaauccaucacuuaaaucacgauucacaauaucaagagacacauccaaaaacacauuuuaucuacaaaacucacuaagagcagaagauacagccguauacuacugugccaggacaggaucaucaggauacuuugacuucuggggacaaggaacacuaguaacaguaucuucagccucaacaaaaggaccaucuguuuuuccauuagcaccaucaucuaaaucuaccucaggaggcacagccgccuuaggaugccuaguuaaagauuacuucccagaaccaguaaccguuucuuggaacucaggagcacuaacuucaggcguacacacuuucccagcaguacuacaauccucaggccuauauucacucucaagcguaguaacaguuccaucaucaucccuaggcacacaaaccuacauaugcaauguaaaccauaaaccaucaaacaccaaaguagacaaaaaaguugaaccgaaaucaugcgacaaaacucacacauguccaccuuguccagcacccgaacuacuagguggaccaucgguauuccuauucccaccaaaaccuaaagauacacuaauaucuagaaccccagaagucacauguguuguaguugacguaucacacgaagauccagaagucaaauucaacugguaugucgauggaguagaaguacacaaugccaaaacaaaaccaagagaagaacaauauaacucaaccuacagaguaguaucaguacuaacaguauuacaucaggacugguuaaacggaaaagaauacaaaugcaaaguaucuaacaaagcccuaccagccccaauugaaaaaacaauaucaaaagcaaaaggacaaccaagagaaccacaaguauauacacuccccccaaguagagaagaaacaaaaaaccaaguaucacuuacaugcuuaguaaaaggauucuauccaucagacauagcaguugaaugggaauccaacggacaaccagaaaauaacuauaaaacuaccccuccaguuuuagauucagauggauccuucuuccucuacuccaaauuaacaguagacaaaucaagauggcaacaaggaaauguauucucauguucaguacacgaagcacuacacaaucacuauacacaaaaaucauuaucccucuccccaggu

SEQ ID NO: 46130 - RNA, 1326 nt, Artificial Sequence
  derived and/or modified sequence opt6 from Etrolizuab_HeavyChain2
gaaguacaauuagucgaaagcggaggaggucuaguacaaccaggaggcucauuacgacuaucaugcgcagcaucaggcuuuuucauaacaaacaauuacugggguugggucagacaagcaccaggcaaaggauuagaaugggucggcuacauaaguuauucuggauccacaucuuauaauccaucaaaacuaucuagauuuacaauaucaagagauacuucaaaaaacaccuucuacuuacaaaacucccuaagagcagaagacacagcaguauacuacugcgcacguacuggauccuccggauauuucgacuucuggggacaaggaacauuaguaacaguaucaucagcaucaacuaaaggacccucaguauucccucuugcacccucauccaaauccacuagcggaggcacagcagcacuaggaugcuuaguaaaagacuacuucccugaacccguuacuguaucuuggaacucaggagcacuaacaucaggaguacauacauucccagcaguacuccaaucaucuggcuuauacucacuaucuucaguugucacuguaccaucuucaucacucggaacacaaacauacauaugcaauguaaaucacaaaccauccaacacuaaaguugacaaaaaaguagaacccaaaucuugcgauaaaacacacacaugcccaccuugcccagcaccagaacuauuaggaggacccucaguauuuuuauuuccaccaaaaccaaaagacacccuaauaucuagaacaccagaagucacaugcgucguaguagacguaucucacgaagacccagaaguaaaauuuaacugguacguagacggaguagaaguacacaacgcaaaaacaaaaccaagagaagaacaauauaacucaacauacagaguaguaucaguauuaacaguacuccaucaagacugguuaaacggcaaagaauacaaaugcaaaguaucaaacaaagcauuaccagcaccaauagaaaaaacaaucucuaaagcaaaaggacaaccaagagaaccacaaguuuacacacuaccaccaucacgugaagaaacaaaaaaccaaguuucauuaacauguuuagucaaaggauucuauccuucagauauagcuguagaaugggaaucaaauggccaaccagaaaacaauuacaaaacuacaccaccaguacuagauucagauggcuccuucuuccucuacucuaaacucacaguagauaaauccagguggcaacaaggaaauguauuuucaugcucaguacacgaagcacuacacaaccacuauacacaaaaaucucuaucauuauccccaggu

SEQ ID NO: 46131 - RNA, 639 nt, Artificial Sequence
  derived and/or modified sequence opt6 from Etrolizuab_LightChain1
gacauacaaacacaaucaccaucaagcuuaucagcaucaguaggagacagaguaaccauaaccugcagagcaagcgaaucaguagacgaucucuuacacugguaccaacaaaaaccaggaaaagcaccaaaauuacuaauaaaauacgcaucacaaucaauaagcggaguaccaucacgauucuccggaucaggcucaggaacagacuucacacuaacaauaucaucacuacaaccagaagacuucgcaacauauuacugccaacaaggaaacucauuaccaaacacauucggacaaggcacaaaaguagaaauaaaaagaacagucgcagcaccaucaguauucauauucccacccucagacgaacaauuaaaaucaggaacagcaucaguaguaugcuuacucaacaacuucuacccaagagaagcaaaaguacaauggaaaguagacaaugcacuacaauccggaaacucacaagaaucaguaacagaacaagacucaaaagacuccaccuacuccuuaucaucaacacuaacauuaagcaaagccgacuacgaaaaacacaaaguauacgcaugcgaagucacacaccaaggacuaucaucaccaguaacaaaaucauucaacagaggagaaugc

SEQ ID NO: 46132 - RNA, 1338 nt, Artificial Sequence
  derived and/or modified sequence opt6 from Etrolizumab_HeavyChain1
gaaguacaauuaguagaaucuggaggaggccugguccaaccaggaggaucacuaagacucuccugugcagcaucaggauuuuuuauuacaaacaacuacuggggcugggucagacaagcacccggaaaaggucuugaauggguaggauacauuucauacucaggcucuaccucuuauaauccuucuuuaaaaucuagauuuacaauaucaagagacacaucaaaaaacacauucuaucuccaaaugaacucacuaagagcagaagacacagcuguuuauuauugugcacgaaccggauccucugguuacuucgauuuuuggggacaaggaacacuaguaacaguauccucagcaaguacaaaaggcccaagcguuuuuccacuagccccauccucaaaauccacuucuggaggaacagcagcacuaggauguuuagucaaagacuacuucccagaaccaguaacaguaucauggaacucuggggcacuaaccucaggaguccacaccuuucccgcaguacuacaaucuuccggacuuuacucauuauccucaguaguaacaguaccauccucaagucuaggaacacaaacauacauaugcaacguaaaccacaaaccaucaaacacuaaaguagauaaaaaaguagaaccaaaaucaugugauaaaacucacacauguccaccaugcccagcaccagaacuacuaggaggaccaucaguauucuuauucccaccaaaaccaaaagauacauuaaugaucucacgcacaccagaagucacauguguaguaguagacguaucccacgaagacccagaagucaaauucaacugguacgucgauggagucgaaguacauaacgcaaaaacaaaacccagagaagaacaauauaacucaacuuacagagucguaaguguacuaacaguacuacaccaagauugguuaaacggaaaagaauacaaaugcaaaguuuccaacaaagcauuaccugcaccaauagaaaaaacaauaucaaaagcaaaaggacaaccacgcgaaccacaaguauacacauuaccaccaucacgagaagaaaugacaaaaaaccaaguaucacuaacaugccuuguaaaaggcuuuuacccaucagauauugcagucgaaugggaaucaaacggucaaccugaaaauaacuacaaaacaacaccacccguauuagacucagacggaagcuuuuucuuauacucaaaacuaacaguagacaaaucaagauggcaacaaggaaauguuuucuccugcucaguaaugcacgaagccuuacacaaccacuacacacaaaaaucauuaucauuaucaccagga

SEQ ID NO: 46133 - RNA, 642 nt, Artificial Sequence
  derived and/or modified sequence opt6 from Etrolizumab_LightChain1
gacauacaaaugacacaaucaccaucaucucuaucagcaucuguaggagauagaguaacaauaaccugcagagcauccgaaagcguagacgaccuacuacacugguaccaacaaaaaccaggaaaagcaccaaaauuacuaauaaaauacgcaucacaauccauaagcggagucccaucaagauucucaggaucaggaucaggaacagacuucacccuaacaauaagcucacuacaacccgaagacuuugcaacuuacuacugccaacaaggaaacucccucccaaacacauucggacaaggaaccaaaguagaaauaaaaagaacaguagcagcaccaucaguauucauauucccacccucagacgaacaacuaaaaucaggaacagccucaguaguaugcuuacuaaacaacuucuacccaagagaagcaaaaguacaauggaaaguagacaacgcacuccaauccggaaacucacaagaaucaguaacagaacaagacucaaaagacucaacauacucacuaucaucaacauuaacacuaagcaaagccgacuacgaaaaacacaaaguauacgcaugcgaaguaacacaucaaggacuaucaucaccaguaaccaaaucauucaacagaggagaaugc

SEQ ID NO: 46134 - RNA, 1359 nt, Artificial Sequence
  derived and/or modified sequence opt6 from Evinacumab_HeavyChain1
gaaguucaacuaguugaaucaggaggcggaguaauccaaccaggagguucacuacgauuaucaugugcugcaaguggauucacauuugacgacuacgcaaugaauuggguaagacagggaccaggcaaaggacuugaauggguaucagcaauuucgggcgauggaggcagcacauauuaugcugauucaguaaaaggaagguucacaaucaguagagauaacaguaaaaauucauuauacuuacaaaugaacucauuaagagcagaagacacagcauucuucuauugcgcaaaagauuuaagaaauacaauauuuggaguaguaauaccagaugccuuugauauuuggggucaaggaacaaugguaaccgucaguucagcaucaacuaaaggaccaaguguauuuccauuagcaccauguuccagaagcacaucagaaaguaccgcagcuuuaggaugcuuaguaaaagacuacuucccagaaccaguaacuguaaguuggaacucaggagcacuaacaucagguguacauacauuuccagcaguccuacaaucaucaggauuguauucacuaucauccgucgucacaguaccauccucaucauuaggaacaaaaacuuacaccuguaauguagaccauaaaccaucaaauacaaaaguagacaaaagaguagaaagcaaauacggaccgccauguccaccaugcccagcaccugaauucuuaggaggaccauccguuuuuuuauucccaccaaaaccaaaagauacacuaaugauaucuagaacaccagaaguaacauguguaguaguagacguaucacaagaagauccagaaguucaguucaacugguacgucgacggaguugaaguucacaaugccaaaacaaaaccaagagaagaacaauuuaauucuaccuauagaguaguaucaguauuaacaguuuuacaucaagauugguuaaauggaaaagaauacaaauguaaaguauccaacaaaggauuaccaagcagcauagaaaaaaccauaucuaaagcuaaaggccaaccaagagaaccucaaguuuauacacucccaccaagccaagaagaaaugaccaaaaaccaagucucauuaacaugucuagucaaaggauuuuauccaagugacauugcaguagaaugggaaucaaacggccaaccagaaaauaauuauaaaacaaccccuccaguacuagauucagacggaucauuuuuucuauauucuagauuaacaguagacaaaaguagauggcaagaaggaaacguauucucauguucugucaugcaugaagcacuacacaaccacuacacacaaaaaucauuaucucuaucccuaggaaaa

SEQ ID NO: 46135 - RNA, 642 nt, Artificial Sequence
  derived and/or modified sequence opt6 from Evinacumab_LightChain1
gacauacaaaugacacaaucaccaucaacccuaucagcaucaguaggagacagaguaacaauaaccugcagagcaagccaaucaauaagaucauggcuagccugguaucaacaaaaacccggaaaagcaccaaaacuauuaauauacaaagcaucaucacuagaaucaggagucccaucaagauucucuggaucaggaucaggaacagaauucaccuuaacuauauccucacuccaacccgacgacuucgccacauacuauugccaacaauacaacucauacucauacacauucggacaaggaaccaaacuagaaauaaaaagaacagucgcagcaccaucaguuuucaucuucccaccaucagacgaacaacuaaaaucaggaacagccucaguaguaugcuuacuuaacaacuuuuacccaagagaagcaaaaguacaauggaaaguagacaacgcacuccaauccggaaacucacaagaaucaguaacagaacaagacucaaaagacucaacauacucacuaucaucaacacuaacauuaucaaaagccgacuacgaaaaacacaaaguauacgcaugcgaaguaacacaccaaggauuaucaucaccaguaacaaaaucauucaacagaggcgaaugc

SEQ ID NO: 46136 - RNA, 1323 nt, Artificial Sequence
  derived and/or modified sequence opt6 from Evolocumab_HeavyChain1
gaaguacaacuaguacaaucaggagcagaaguaaaaaaaccaggagcaaguguaaaaguuagcuguaaagcaucagguuauacauuaacaucauaugguauaucauggguaagacaagcaccaggacaaggacuagaauggaugggauggguaaguuucuauaauggaaauacaaauuacgcacaaaaauuacaaggaagaggaacuaugacaacugauccaucaacaagcacagcauauauggaacuacgaucacuuaggucagacgauacagcaguauauuacugugcaaggggauacggaauggacguauggggucaaggaacaacaguaacagucucaucagcaucaacaaaaggaccaucagucuuuccacucgccccauguucaagaaguaccagugaaucuacagcugcacuaggaugccuaguaaaagacuacuuuccagaaccaguaacaguaucauggaacucaggcgcauuaaccucaggaguacacaccuuuccagcaguguuacaaucuaguggauuauauucauuaucaaguguaguaacaguaccaucuaguaauuucggaacacaaacauacacaugcaacguagaucauaaaccaaguaauacuaaaguagacaaaacaguagaaagaaaaugcuguguagaaugcccaccauguccagcaccacccgucgcaggaccuagcguauucuuauucccaccuaaaccaaaagacacucuaaugauuucaagaacacccgaagucacaugcguaguaguagauguaagccaugaagauccagaaguacaguucaauugguacguagauggaguagaaguacacaacgcaaaaacaaaaccacgugaagaacaguuuaacagcacauuccgaguaguaucaguauuaacaguaguacaucaagacugguuaaauggaaaagaauauaaaugcaaaguaaguaauaaaggccuuccagcaccaauagagaaaacaauaaguaaaacaaaaggacaaccaagagaaccccaagucuacacccuaccaccaucaagagaagaaaugacaaaaaaucaaguaaguuuaaccugucucguaaaaggauuuuauccaagcgacauagcuguagaaugggaaucaaauggacaaccugaaaauaauuacaaaacaacaccuccuaugcuagacucagauggaucauuuuucuuauacucaaaacuaacaguagauaaaucaagauggcaacaaggaaauguauuuucaugcucaguaaugcaugaagcuuuacauaaucacuacacucaaaaaucauuaucacuaucaccaggaaaa

SEQ ID NO: 46137 - RNA, 645 nt, Artificial Sequence
  derived and/or modified sequence opt6 from Evolocumab_LightChain1
gaaucagcacuaacacaaccagcaucaguaucaggaucacccggacaaucaauaacaauaucaugcacaggaacaucaucagacguaggcggauacaauucaguaucaugguaccaacaacacccaggaaaagcaccaaaauuaaugauauacgaaguaucaaacagaccuucaggaguauccaacagauucucaggcucaaaaucaggaaacacagcaucacuaacaauaucaggacuacaagccgaagacgaagcagacuacuacugcaacucauacacaucaaccucaaugguauucggaggaggcacuaaacuaacuguacuaggacaacccaaagcagcacccucaguaacacuauucccaccaucaucagaagaacuacaagccaacaaagcaacacuaguaugccucauaucagacuucuacccaggcgcaguaacaguagcauggaaagcagacucaucaccaguaaaagcaggcguagaaaccacaacaccaucaaaacaaucaaacaauaaauacgcagcaucaucauacuuaucacuaacaccagaacaauggaaaucccacagaucauacucaugccaaguaacacacgaaggaucaacaguagaaaaaacaguagcaccuacagaaugcuca

SEQ ID NO: 46138 - RNA, 1353 nt, Artificial Sequence
  derived and/or modified sequence opt6 from Exbivirumab_HeavyChain1
caaguacaauuaguagaaucaggugguggaguuguccaaccaggaggcucacuaagacuaucaugugcaccaucaggauucgucuucagaucauauggaaugcauuggguuagacaaacucccgguaaaggucucgaauggguaucauuaauauggcacgacggaucaaauagauucuacgcagauucagucaaaggacgauucaccauaucacgagacaauucaaaaaacacacuuuaccuacaaaugaauucacuaagagcagaagacacagccauguacuucugugccagagaaagauuaaucgcagcaccagcagcauucgaccuauggggacaagguacacuuguaaccguaucauccgcauccacaaaaggaccauccguauucccacucgcaccuucaucaaaaucaacaucuggaggaaccgcugcacuaggaugccuuguaaaagacuacuuuccagaaccgguaacuguaucauggaacucaggagccuuaacuucaggaguacauacauucccagcaguauuacaaucuucaggccucuacucacuaucuucaguuguaacaguaccaucaaguucacuaggaacccaaacuuacaucugcaacguaaaccacaaaccauccaacacuaaaguagacaaaagaguagaaccaaaaucaugcgacaaaacacauaccugcccaccaugccccgcaccagaacuauuaggaggaccaucaguauuuuuauucccaccaaaacccaaagacacauuaaugauaucucgaacacccgaaguaacaugcguaguuguugacguaucacaugaagacccagaaguaaaauuuaauugguacguagauggaguagaaguacacaacgccaaaacaaaaccacgagaagaacaauauaacucaacauauagaguuguaagugucuuaacaguauuacaucaagacuggcuaaacggcaaagaauacaaaugcaaaguaucuaauaaagcauuaccagcaccuauagaaaaaacaauauccaaagccaaaggacaaccaagagaaccacaaguauacacauuaccaccaucacgugaagaaaugaccaaaaaucaagucucauuaaccuguuuagucaaaggauucuauccaucagacaucgccguagaaugggaauccaacggacaaccagaaaauaauuacaaaaccacaccaccaguacuagacucagauggauccuucuuuuuauauuccaaacucacaguagacaaaucaagauggcaacaaggcaauguauucucauguucaguaaugcacgaagcucuccauaaucauuacacucaaaaaagccuauccuuaucaccagguaaa

SEQ ID NO: 46139 - RNA, 642 nt, Artificial Sequence
  derived and/or modified sequence opt6 from Exbivirumab_LightChain1
ucauacguacuaacacaaccaccaucaguaucaguagcaccaggaaaaacggcuagaauaucaugcgguggaaacaacauaggaacaaaaaacguacacugguaccaacaaaaaccaggacaagcaccaguacuaguaguauacgcagacucagauagaccaucaggaauaccagaacgauucagcggaucaaacucaggaaacacagcaacacucacaaucucaagaguagaagcaggagacgaagcagacuauuacugccaaguaugggacucaguaucauaccauguaguauucggaggaggaacaacacuaacaguauuaggacaaccaaaagcagcaccaaguguaacacuauuuccaccaucaucagaagaacuccaagcaaacaaagccacacuaguaugccuaauauccgauuuuuacccaggagcaguaacaguagccuggaaagcagacuccucaccaguaaaagcaggaguagaaacaacaacaccaucaaaacaaaguaacaacaaauacgcagcaucaucauaccuaucacuaacaccagaacaauggaaaucacacagaucauacucaugccaaguaacacacgaaggaucaacaguagaaaaaacaguagcaccaacagaaugcuca

SEQ ID NO: 46140 - RNA, 1347 nt, Artificial Sequence
  derived and/or modified sequence opt6 from Farletuzumab_HeavyChain1
gaaguacaguuaguagaauccggagguggaguaguacaacccggaagaucacuaagacucucaugcucagccucaggauuuacauuuucaggauacggauuaucauggguaagacaagcaccaggaaaaggacuagaauggguagcaaugauaucaucaggaggaucuuauacauauuaugccgacucuguaaaaggaagauuugcaauaucacgugacaaugcaaaaaauacauuguucuuacaaauggacucccucagaccagaagacacuggcguauacuucugcgcuaggcauggagacgauccagcaugguucgcuuauuggggacaaggaacuccuguuacuguaagcucugcaagcacaaaaggcccuucaguauuuccuuuagcacccucguccaaaagcaccucaggagguacugcugcauuaggaugucucguaaaagacuauuuuccugaaccaguuacugucucauggaauucaggagcacuaacuucaggaguacacacauucccagcaguacuacaaaguucuggacuauacucauuaucaucaguuguaacaguaccaaguucaagccuaggaacccaaacuuauauauguaacgucaaccauaaaccaucaaacacaaaaguagacaaaaaaguagaaccaaaaaguugcgauaaaacacauacuugcccaccaugcccagcaccagaacuauuaggaggaccaaguguauuuuuauucccaccuaaaccaaaggacacauuaaugauaaguaggacaccagaaguaacaugugucguaguugauguuucacaugaagauccagaaguaaaauuuaauugguauguagauggaguagaaguucauaaugcaaaaacaaaaccucgagaagaacaauacaacucuacuuaucgaguaguauccguuuuaacaguacuucaucaagauugguuaaacggaaaagaauauaaauguaaaguaucaaauaaagcauuacccgccccaauagaaaaaacaauaucaaaagcuaaaggacaaccaagagaaccacaaguauacacacuaccaccuucaagagacgaacuaaccaaaaaucaaguaaguuuaaccugucuaguaaaaggcuuuuauccaagcgauauagcaguagaaugggaaucaaauggacaaccagaaaauaauuauaaaacuacaccaccaguacuagauucugacggcucauuuuuccuauauucuaaauuaacaguugacaaaucaagauggcaacaaggaaauguauuuucaugcucuguuaugcacgaagcauuacauaaccauuauacacaaaaaucauuaucauuaucacccgguaaa

SEQ ID NO: 46141 - RNA, 651 nt, Artificial Sequence
  derived and/or modified sequence opt6 from Farletuzumab_LightChain1
gacauacaacuaacacaaucaccaucaucauuaucagcaucaguaggagacagaguaacaauaacaugcucaguaucauccuccauaucaucaaacaaucuacacugguaccaacaaaaacccggaaaagcaccaaaaccauggauauacggaacaucaaaccuagcaucaggaguaccaucaagauucucaggcucaggcucaggaacagacuacaccuucacaauaucaucacuacaaccagaagacauagcaacauacuacugccaacaauggucaucauacccauacauguacacauucggacaaggaacaaaaguagaaauaaaacgaacaguagcagcaccaucuguauucaucuucccaccaucagacgaacaacucaaauccggaacagcaucaguaguaugccuacuaaacaacuucuacccaagagaagcaaaaguacaauggaaaguagacaacgcacuacaaucaggaaacucacaagaaucaguaacagaacaagacucaaaagacucaacauacucacuauccucaacacuaacacuaucaaaagcagacuacgaaaaacacaaaguauacgcaugcgaaguaacacaccaaggacuaucaucacccguaacaaaaucauucaacagaggagaaugc

SEQ ID NO: 46142 - RNA, 1338 nt, Artificial Sequence
  derived and/or modified sequence opt6 from Fasinumab_HeavyChain1
caaguccaauuaguacaaucaggugcagaaguaaaaaaaccaggagcaucaguuaaaguuaguuguaaaguaucagguuucacauugacagaacuauccauccauuggguacgacaagcaccagguaaaggccucgaauggaugggaggauucgauccagaagauggugaaacaauauacgcacaaaaauuucaaggaagagucacaaugacagaagauacaucaaccgacacugcauacauggaauuaacaucccuuagaucagaagauacugcaguauauuacuguuccacaauauuuggaguaguaaccaauuuugacaauuggggacaaggaacguuagucaccgucagcucagcuucuacaaaaggaccaucaguauuuccacuagcaccaugcucuagauccacaucagaaagcacagcagcauuaggaugucuaguaaaagacuacuuuccagaaccaguuaccguaucauggaacucuggagcacuuacauccgguguacauaccuuuccagcaguacuccaaucaagcggacuauauagucuaagcucaguaguaacaguuccaucaucaucuuuagguacaaaaacauacaccuguaacgucgaucauaaaccaucaaacacaaaaguugacaaaagaguagaauccaaauacggaccaccaugcccaccauguccagcuccagaauucuuaggaggaccaucaguauuuuuauuuccaccaaaacccaaagacacuuuaaugauuucaagaacaccagaagucacauguguaguagucgaugucucacaagaagacccugaaguucaauuuaacugguacguagacggaguugaaguacauaaugcaaaaacaaaaccuagagaagaacaauucaauucaacauauagaguaguaucaguauuaacuguacuacaucaagacuggcucaauggaaaagaauauaaauguaaaguaucaaauaaaggucuaccaucaucaauagaaaagacaauaucaaaagcaaaaggccaacccagagagccacaaguauauaccuuaccaccuucacaagaagaaaugacuaaaaaccaagucucauuaacaugucuaguaaaaggauuuuauccauccgacauagcaguagaaugggaaucuaauggacaaccagaaaacaacuauaaaacaacaccuccaguacuagauucagauggaucauuuuuucuauauucacgacuaacuguagauaaaucaagauggcaagaaggaaaugucuucucuuguucaguaaugcaugaagcacuacacaaucauuacacacaaaaaaguuuaucccuaagccucggcaaa

SEQ ID NO: 46143 - RNA, 642 nt, Artificial Sequence
  derived and/or modified sequence opt6 from Fasinumab_LightChain1
gauauacaaaugacacaaucaccaucaucacuaucagcaucagcaggagacagaguaacaauaaccugcagagcaagccaagcaauaagaaacgacuuaggaugguaccaacaaaaaccaggcaaagcacccaaaagacuaaucuaugcagcauucaaccuacaaucaggaguaccaucaagauuuucaggcucaggaucaggaacagaauucacauuaacaauaucaucacuacaaccagaagaccuagcaucauacuacugccaacaauacaacagauacccauggacauucggacaaggaaccaaaguagaaauaaaaagaacagucgcagcaccaucaguauucauauucccaccauccgacgaacaauuaaaauccggaacagcaucaguaguaugcuuacuaaacaacuucuacccaagagaagcaaaaguacaauggaaaguagacaacgcauuacaaucaggaaacucacaagaauccguaaccgaacaagacucaaaagacucaacauacucauuaucaucaacauuaacauuaucaaaagcagacuacgaaaaacacaaaguauacgcaugcgaaguuacacaccaaggacuaagcucaccaguaacaaaaucauucaacagaggagaaugc

SEQ ID NO: 46144 - RNA, 1350 nt, Artificial Sequence
  derived and/or modified sequence opt6 from Fezakinumab_HeavyChain1
caaguccaacuaguacaaucaggagcagaagucaaaaaaccaggagccuccguaaaaguaucuugcaaagcaagcggauacacuuucacaaacuauuacaugcacuggguaagacaagcacccggacaagguuuagaaugggucggcuggauaaacccauacacuggaucugcauucuaugcacaaaaauuccgaggaagagucacaaugacacgcgauacaucuauaucaacagcauauauggaauuaagucgacuaagaucagacgauacugcugucuauuacugugcaagagaaccagaaaaauucgacuccgacgacagcgauguauggggaagaggaacacuaguaacaguaagcuccgccucuacaaaaggaccaagcguauuuccacuagcaccuucuucaaaaucuaccuccggaggaacagcagcauuaggcugcuuagucaaagacuacuucccggaaccaguaaccguauccuggaauucuggcgcacuaacaucaggaguucacacuuuuccagcuguuuuacaaucaaguggacuauacucauuaucaucaguagucacaguaccaucaucaagccuuggaacacaaacauacauauguaauguaaaccauaaaccauccaacacaaaaguagauaaaaaaguagaacccaaauccugugauaaaacccacacaugcccaccauguccagcccccgaacuacuaggaggcccaucuguauucuuauucccaccaaaaccaaaagacacccuaaugauuucaagaacaccagaaguaacaugcguaguaguagaugucucgcacgaagacccagaaguaaaauuuaauugguauguagacggagucgaaguacacaaugccaaaacaaaaccacgagaagaacaauauaauucaacauacagaguaguaucuguauuaacaguucuccaccaagacuggcuaaacggaaaagaauauaaaugcaaaguaucaaauaaagcacuaccagccccaauagaaaaaaccauaucaaaagcaaaaggccagccaagagaaccacaaguauauacacuaccaccaucacgagaagaaaugacaaaaaaccaaguaucccuaacaugccuaguaaaaggauucuaccccucugacauagcaguagaaugggaaucaaauggacaaccagaaaacaacuauaaaacaacaccaccagucuuagauucagauggaucauucuuuuuauacucaaaauuaacuguagacaaaucaagauggcaacaaggaaauguauuuucuugcucuguaaugcacgaagcauuacacaaucauuauacucaaaaaucacuaucacucucaccagga

SEQ ID NO: 46145 - RNA, 651 nt, Artificial Sequence
  derived and/or modified sequence opt6 from Fezakinumab_LightChain1
caagcaguauuaacccaaccaccaucaguaucaggagccccaggacaacgaguaacaauaucaugcacaggaucaucaucaaacaucggagcaggauacggaguacacugguaccaacaauuaccaggaaccgcaccaaaacuauuaauauacggagauucaaacagaccaucaggaguaccagaccgauucucaggauccaaaucaggaaccucagcaucacuagcaauaacaggacuacaagcagaagacgaagccgacuacuacugccaaucauacgauaacuccuuaucaggauacgucuucggaggaggaacacaacuaacaguauuaggacaaccaaaagcagcaccaucaguaaccuuauucccaccaucaucagaagaacuacaagcaaacaaagcuacacuaguaugccuaauaucagacuucuauccaggagcaguaacaguagcauggaaagcugauucaucaccaguaaaagcaggaguagaaacaaccacaccaucaaaacaaucaaauaacaaauacgcagcaucaucauaccucucacucacaccugaacaauggaaaucacacagaucauacuccugccaaguaacucacgaaggaucaacagucgaaaaaaccguagccccaacagaaugcuca

SEQ ID NO: 46146 - RNA, 1347 nt, Artificial Sequence
  derived and/or modified sequence opt6 from FG-3019_HeavyChain1
gaaggacaauuaguucaaucaggagguggauuaguacauccaggaggaaguuuaagauuaucaugcgcaggaucaggauucacuuucuccaguuacggaaugcacuggguuagacaagcaccaggaaaaggacuugaauggguaucagguaucggaacaggagguggaacauauucaacagauucaguaaaaggacgauuuacaauauccagagauaacgccaaaaacucacuauauuuacaaaugaacaguuuaagagcagaagacauggcaguauauuacugcgcaagaggcgauuauuacggcucaggcuccuuuuucgauuguuggggucaagguacauuaguaacuguaucaucagcaucaacaaaaggaccuucuguauuuccauuagcaccaucaaguaaaaguacuuccgguggaaccgcagcacuuggaugccuaguuaaagauuacuuuccagaaccuguaacuguaucauggaacucaggagcacuaacaucagguguucacacauuuccagcaguauuacaaucaucaggcuuauauagccuaaguucaguaguaacaguaccaucaucaucacuaggaacacaaacauacauauguaacguuaaucauaaaccaucaaauacaaaagucgauaaacgaguagaaccaaaaucaugugacaaaacacauaccuguccaccaugcccagcaccagaacuuuuagggggaccaagcguauuccuauucccaccaaaaccaaaagacacacuaaugauauccagaacaccagaagugacauguguuguaguagacguuagccacgaggauccagaaguaaaauuuaauugguacguagacggcguagaaguacauaaugcaaaaacaaaaccaagagaagaacaauauaacucaacauauagagucguaucagucuuaacaguuuuacaccaagauugguuaaacggaaaagaguacaaaugcaaaguaucaaacaaagcauuaccagcaccaauagaaaaaaccauuagcaaagcaaagggacaaccaagagaaccacaaguauacacauuaccaccaucaagagaagaaaugacaaaaaaucaagugucauuaacaugccuagucaaaggauucuauccaagcgauauagccgucgaaugggaaucaaauggucaaccugaaaauaauuauaaaacaacuccaccaguacuagacucagacggaucauuuuucuuauauucuaaauuaacaguagacaaauccagauggcaacaaggaaacgucuucucauguucaguaaugcacgaagcacuacacaaucacuauacucaaaaaucucuaucacuaucuccugga

SEQ ID NO: 46147 - RNA, 642 nt, Artificial Sequence
  derived and/or modified sequence opt6 from FG-3019_LightChain1
gacauacaaaugacacaaucaccuucaucacuaucagcauccguaggagacagaguaacaauaacaugccgagcaucacaaggaauauccucaugguuagcaugguaccaacaaaaaccagaaaaagcaccaaaaucacuaauauacgcagcaucaucauuacaaucaggaguaccaagcagauucucaggcucaggaucaggaacagacuucacacuaaccauauccucacuacaaccagaagacuucgccacauacuacugccaacaauacaacucauacccacccacauucggacaaggaacaaaacuagaaauaaaacgaacaguagcagcaccaucaguauucauauucccaccuucagacgaacaauuaaaaucaggaacagcaucaguuguaugccuacuaaauaacuucuacccaagagaagcaaaaguacaauggaaaguagacaacgcacuacaauccggaaacucacaagaaucaguaacagaacaagacuccaaagacucaacauauuccuuaucaucuacauuaacauuaucaaaagcagauuacgaaaaacacaaaguauacgccugcgaaguaacccaucaaggacuaucaucacccguaacaaaaucauucaacagaggagaaugc

SEQ ID NO: 46148 - RNA, 1344 nt, Artificial Sequence
  derived and/or modified sequence opt6 from Fibatuzumab_HeavyChain1
caaguacaguuaguccaaucaggagccgaagucaaaaaaccaggagcaagcguaaaaguuucauguaaagcaagcggauacacauucacaggcuauuggaugaacuggguaagacaagcaccaggucaaggacuagaauggaugggagauauauacccaggaagcggaaacacaaacuaugacgaaaaauuucaaggaagaguaacaaugacaagagacacaucaauuucaaccgcauacauggaauuaaguagauuaagaucagaugauacagcaguauacuacugugcaagaggcggauacuaugaagauuucgauagcuggggacaaggaacuacaguaacaguaucaucggcaucaacaaaaggacccaguguauucccacuagcgccaucaucaaaaaguacauccggaggcaccgcagcacuaggcugcuuagucaaagacuauuuuccagaaccaguaacuguuuccuggaauagcggagcacuaacaucaggaguacacacuuucccagccguacuacaaaguucuggcuuguacucacuaucuucaguaguaacagucccuucuucaagcuuagguacacaaacauauauuugcaauguaaaucacaaaccuucaaauaccaaaguugacaaacgaguggaaccaaaaucaugugacaaaacacacacauguccaccgugcccagcuccagaacucuuaggaggcccaucugucuuucuauucccaccuaaaccuaaagauacauuaaugauaucaagaacaccagaaguaacauguguaguaguugaugucucacacgaagauccagaaguaaaauuuaauugguacguagauggaguagaaguacacaacgcuaaaacaaaaccgcgagaagaacaauauaauucaacauacagaguaguaagcguacuaacaguacuacaccaagacuggcuaaacggaaaagaauacaaauguaaaguaagcaauaaagcacucccagcaccuauagaaaaaaccauaucaaaagcaaaaggacaaccaagagaaccacaaguauauacacuaccaccaaguagagaagagaugacaaaaaaucaaguuagccuaaccugucuaguaaaaggauucuauccuucugauauagcaguagaaugggaaucuaauggacaaccagaaaauaacuacaaaacaacaccaccaguacuagacagugauggaucuuucuuccuauacucaaaacuaacaguagauaaaucaagauggcaacaaggaaauguauuuuccuguucagugaugcacgaagcauuacauaaccacuauacacaaaaaagcuuaaguuuaucaccaggaaaa

SEQ ID NO: 46149 - RNA, 642 nt, Artificial Sequence
  derived and/or modified sequence opt6 from Fibatuzumab_LightChain1
gacauacaaaugacacaauccccaucuuuccuaucagcaucaguaggcgaccgaguaacaauaacaugcagagcaucccaaggaauaauuucauaccuagcaugguaccaacaaaaaccagaaaaagcaccaaaaagacuaauauacgcugcauccucauuacaaucaggaguaccaucacgauucucaggaucaggaucaggaacagaauucacacuaacaauaucaucacuacaaccagaagacuucgccacauauuacugcggacaauacgcaaacuacccauacacauucggacaaggaacaaaacucgaaauaaaacgcacaguagcagcaccaucaguauucauauucccaccaucagacgaacaacuaaaaucaggcacagcaucagucguaugucuacuaaauaacuucuacccccgcgaagcaaaaguacaauggaaagucgacaacgcacuacaaucaggaaacucacaagaaucaguaacagaacaagacucaaaagacucaacauacucacuaucaucaacauuaacacuauccaaagcagacuacgaaaaacacaaaguauacgccugcgaaguaacacaccaaggacuauccucaccaguaacaaaaucauucaacagaggagaaugc

SEQ ID NO: 46150 - RNA, 1344 nt, Artificial Sequence
  derived and/or modified sequence opt6 from Ficlatuzumab_HeavyChain1
caaguucaauuaguccaaccaggagcagaaguuaaaaaaccaggaacaucuguaaaacuaaguugcaaagcaucuggauauacauuuacgacauacuggaugcacuggguaagacaagcaccaggacaaggucuagaauggauaggagaaauuaacccaacaaacggacacaccaauuacaaccaaaaauuucaaggaagagcaacauuaacagucgauaaaucaacaucaacagcuuacauggaauuaaguucccuaagaagugaagauacagcaguauacuacugcgcucgaaacuauguaggaucaauauucgacuauuggggacaaggaacacuacuaacagucuccucagcauccacaaaagguccaucuguuuucccucucgcaccaucauccaaaucaacaagcggaggaacagcagcauuagguuguuuaguaaaagauuacuucccagaaccaguaacaguaagcuggaacucaggagcauuaacaucaggaguacacacuuuuccagcaguauuacaaucaucaggauuauacucauuaucaucaguaguuaccgucccaucaucaucauuaggaacacaaacauauauaugcaaugucaaccacaaaccaagcaacacaaaaguagauaaacgaguagaaccaaaaucaugcgauaaaacacauacaugcccuccaugcccagcaccagaauuauuaggaggaccaucuguauuccucuucccuccaaaaccaaaagauacauuaaugauaagccgaaccccagaaguuacauguguaguaguagacguaucacacgaagauccagaagugaaauucaacugguacgucgaugguguagaaguacacaacgcaaaaaccaaacccagagaagaacaauacaacucaacauauagagucguauccguacuaacaguccuacaucaagacuggcuaaaugguaaagaauacaaaugcaaaguaucaaauaaagcacuaccagcaccaauugaaaaaacaauaucaaaagccaaaggacaaccaagagaaccacaggucuacacccuaccaccuuccagagaagaaaugacaaaaaaccaaguaucacuaacaugucucguaaaaggcuucuauccaucagacauugcugucgaaugggaaucaaacggacaacccgaaaauaacuacaaaacaacucccccaguucucgauucugauggaucauucuuccuauacucaaaacucacaguugacaaaucccgcuggcaacaaggaaauguuuucucauguucuguaaugcacgaagcacuccacaaccacuacacacaaaaaucacuaucucuaucccccggaaaa

SEQ ID NO: 46151 - RNA, 1341 nt, Artificial Sequence
  derived and/or modified sequence opt6 from Ficlatuzumab_HeavyChain
guacaacuaguccaacccggagcagaaguaaaaaaaccuggaacaucaguaaaauuauccugcaaagcauccggauacacauucacaacauacuggaugcacuggguaagacaagcaccaggacaagggcuagaauggauaggugaaauaaaccccaccaacggacacacaaacuacaaucaaaaauuucaaggaagagcaacucuaacaguagacaaaucuacaucaacagcauacauggaauuaucuucacuaagauccgaagacacagcagucuacuauugugcaaggaacuacguuggaucaauauucgacuauuggggacaaggaacgcuacuaacuguaucuucagccucaaccaaaggacccaguguauuuccacuagcaccaucaucaaagucuacauccggaggaaccgcagcauuaggcugccuuguuaaagacuauuuccccgaacccguaacaguaagcuggaacucaggcgcccuaacuucaggaguacacacauuuccagcaguacuacaaucaucaggucuauauucacucucaagcguaguaacagucccauccucaucacuaggaacucaaaccuacauaugcaacguuaaucauaaaccaaguaacacuaaaguugauaaacgaguugaaccuaaaucaugugauaaaacucauacaugcccaccaugcccagcaccugaacuacuaggaggcccuucaguauuucuauucccuccaaaaccaaaagacacacuaaugauaucuagaaccccugaagucacaugcguagucgucgauguaucacacgaagacccagaaguuaaauuuaauugguauguagacggaguagaaguacacaaugcaaaaacuaaacccagagaagaacaauauaacucaacauauagagucgucucaguauuaacuguauuacaccaagauugguuaaacggaaaagaguacaaaugcaaaguaucaaauaaagcacuaccagcacccauagaaaaaacaauuucaaaagcaaaaggucaaccaagagaaccacaaguauacacucuaccaccaucaagagaagaaaugacaaaaaaccaaguaucacuaacaugcuuaguaaaaggauucuacccaagcgacauagccguagaaugggaauccaacggacaaccagaaaacaauuacaaaacaaccccaccaguauuagacucagacggaucauucuucuuauauaguaaacuaacaguagauaaaucacgauggcaacaaggaaauguauucaguugcuccguaaugcacgaagcacuacacaaucacuacacacaaaaaucacucucauuaucaccaggcaaa

SEQ ID NO: 46152 - RNA, 642 nt, Artificial Sequence
  derived and/or modified sequence opt6 from Ficlatuzumab_LightChain1
gacauaguaaugacacaaucuccagacagccuagccaugucacuaggagaaagaguaacacuaaacuguaaagcaucagaaaacguaguaucauacguaucaugguaucaacaaaaaccaggacaaucacccaaacuacuaauauacggagcauccaacagagaaucaggaguaccagacagauuuucuggcucaggaucagcaacagauuucacucuaacaauaucaucaguacaagcagaagacguagcagacuaccacugcggacaaucauacaacuacccauacacauucggacaaggaacaaaacuagaaauaaaaagaacaguagcugcaccaucaguauucauauucccaccaucagacgaacaacuaaaaucaggaacagccucaguaguaugcuuauuaaacaacuucuacccaagagaagcaaaaguccaauggaaaguagacaacgcacuacaaucaggaaacucacaagaaucagucacagaacaagacucaaaagacucaacauacucacuaucaucaacacuaacacuaucaaaagcagacuacgaaaaacacaaagucuacgcaugugaaguaacucaccaaggacuaucaucaccaguaacaaaauccuucaacagaggagaaugc

SEQ ID NO: 46153 - RNA, 1350 nt, Artificial Sequence
  derived and/or modified sequence opt6 from Figitumumab_HeavyChain1
gaaguacaauuauuagaaucaggaggaggacuuguucaaccuggaggaagccuacguuuaucauguacugcuucaggauucacauuuucaagcuaugcaaugaacuggguuagacaagcaccaggaaaaggacuagaauggguauccgcuauaucaggaucaggcggaacaacuuucuaugccgauuccguaaaaggaagauuuaccauaaguagagacaacucaagaacaacauuauacuuacaaaugaauucauuaagagcagaagacacagcaguauauuacugcgcaaaagacuuaggcuggucagauucauauuacuauuacuacggaauggaugucuggggacaaggaaccacaguaacagucucuucagcaucaacaaagggcccaucagucuuucccuuagcaccauguucaagaucaaccuccgaaucaacagcagccuuaggaugccuaguaaaagauuacuuuccagaaccaguuacaguaucauggaacucaggagcauuaacaucaggaguccauacauuuccugccguccuacaaucauccggucuauacagcuuaucaucaguaguuacgguaccaucaaguaauuucggcacacaaacauacacaugcaacguagaucacaaaccaagcaacacaaaaguagauaaaaccguagaaagaaaaugcugugucgaauguccacccugcccagcaccaccaguagcuggcccaucaguauuccuauuuccucccaaacccaaagauacauuaaugauaagcagaacaccagaaguaacaugcguuguaguagauguaucacacgaagacccugaaguucaauucaauugguauguagaugguguagaaguccauaacgcaaaaacaaaaccaagagaagaacaauuuaauuccaccuuccgaguaguaucaguauuaacagucguucaucaagacugguuaaacgguaaagaauacaaaugcaaaguaucuaacaaagguuuaccagcacccauagaaaaaacaauaucaaaaacaaaaggacaaccaagagaaccacaaguauauacauuaccaccaucacgcgaagaaaugaccaaaaaccaaguaucauuaacuugucuaguaaaaggauucuacccauccgauauugcaguagaaugggaaucaaauggucaacccgaaaauaauuacaaaacaacacccccaauguuagacuccgacggaucauucuuccucuauucaaaacuaacaguagacaaaucacgauggcaacaaggaaauguauuuucuugcucaguaaugcaugaagcauuacacaaccacuauacccaaaaaucauuaucacuaucacccgga

SEQ ID NO: 46154 - RNA, 642 nt, Artificial Sequence
  derived and/or modified sequence opt6 from Figitumumab_LightChain1
gacauacaaaugacacaauucccaucauccuuaucagcaucaguaggcgacagagucacaaucaccugcagagcaucacaaggaauacgaaacgacuuaggaugguaccaacaaaaacccggaaaagcaccaaaacgauuaauauacgcagcaucuagauuacaucgaggaguaccaucaagauucucaggaucaggcucaggaacagaauucacacuaacaauaucaucacuacaaccugaagacuucgcaacauacuacugccuacaacacaacuccuacccaugcucauucggacaaggaacaaaacucgaaaucaaaagaacagucgcagcaccuucaguauucauauucccaccaucagacgaacaauuaaaaucaggaacagcaucaguaguaugccuacuaaacaacuuuuacccacgagaagcaaaaguacaauggaaaguagauaacgcacuacaauccggaaacucacaagaaucaguaacagaacaagacuccaaagacucaacauacucauuaagcucaacccuaacauuauccaaagcagacuaugaaaaacacaaaguauacgcaugcgaaguaacacaccaaggacuauccucaccagucaccaaaucauucaacagaggagaaugu

SEQ ID NO: 46155 - RNA, 1359 nt, Artificial Sequence
  derived and/or modified sequence opt6 from Firivumab_HeavyChain1
caaguacaacuaguacaaaguggagcagaaguaaaaaugccagguuccucuguaaaaguaucauguaaaaccucaggaguauuuuuuucaucacacgcaauaucauggguacgacaagcacccggacaaggucucgaauggauggguggaauaucaccuauguucgguacaacucauuacgcccaaaaauuccaaggcagaguaacaauuacagcugaccaaucaacaacaacugcauauauggaauuaacaucccuaacaucugaagauacagccguuuacuacugugcaagagacggagcaggcaguuacuacccauuaaacugguucgacccauggggacaaggaacccucguaacaguaucaagugcaucaacaaaaggaccaucuguauuuccacuagccccaucauccaaaucaacaucuggaggaacagcugcacucggaugccucguaaaagauuauuucccagaaccaguaacugucucauggaacucaggagcacuaacaaguggaguacacacauuuccugcaguacuacaaucaucuggacucuacucucuaucauccguuguaacuguacccuccucaucacuaggaacccaaacauauauaugcaacgucaaccacaaacccucaaauacaaaaguagauaaacguguagaacccaaaucuugcgauaaaacccauacaugcccaccaugcccagcaccagaacuauuaggaggcccaucuguauuucuauuuccaccuaaaccaaaagacaccuuaaugauaucacgaacccccgaaguaacauguguaguaguagaugucucacacgaagacccagaaguaaaauucaacugguauguggacgguguagaaguacacaacgcaaaaacuaaaccuagagaagaacaauauaacucuacauacagaguagucucaguacucacugucuuacaucaagacuggcuaaauggaaaagaauauaaauguaaaguaucaaauaaagcucuaccagcaccaauugaaaaaacuauauccaaagcaaaaggacaaccaagagaaccacaaguuuacacuuuaccacccucacgugacgagcuaacaaaaaaccaaguaucucuaacaugccuaguaaaaggcuucuacccaucagacauagcagucgaaugggaauccaauggacaaccagaaaacaacuauaaaaccacaccaccaguacuugauucagacggaucuuucuuccuauauagcaaauuaaccguagacaaaucaagauggcaacaaggaaacgucuuuuccuguucaguaaugcacgaaggccugcauaaccacuauacacaaaaaucauuaucuuuaucaccaggaaaa

SEQ ID NO: 46156 - RNA, 642 nt, Artificial Sequence
  derived and/or modified sequence opt6 from Firivumab_LightChain1
gaaauaguacuaacacaaucaccagcaacacuaucccuaagccccggagaaagagcaacacuaucaugcagagcaucagaaaacauauggaacaaccuagcaugguaccaacaaaaacccggacaagcacccagacuacuaaucucaggagcaucaacaggcgcaacaggaguaccaucacgauucagaggcucaggaucaagaacagaauucacacuaacaauauccagcuuacaauccgaagauuucgcaauauacuucugccaacaauacaacucauggccaagaacauucggaccagguacaaaaguagaaauaaaacgaacaguagcagcaccaucaguauucaucuucccaccaucagacgaacaacuaaaaucagguacagcaucaguaguaugccuauuaaacaacuucuacccaagagaagcaaaaguacaauggaaaguagacaacgcauuacaaucaggaaacucacaagaaucaguaacagaacaagacucaaaagacucaacauacucacuaucaucaacacuaacacuaucaaaagcagauuacgaaaaacauaaaguauacgcaugcgaaguaacacaccaaggacucucaucaccaguaacaaaaucauucaacagaggagaaugc

SEQ ID NO: 46157 - RNA, 1347 nt, Artificial Sequence
  derived and/or modified sequence opt6 from Flanvotumab_HeavyChain1
caaguacaacucguacaauccggauccgaacuaaaaaaaccuggagcauccguuaaaauaucaugcaaagcaucaggauauacauuuacaucauaugcaaugaacugggucagacaagcaccaggacaaggacuagaaucaaugggcuggauaaacacaaacacaggaaacccaacauaugcacaaggauucacuggacgauucguauucuccauggacacaucaguaucaacagcauaucuacaaauauccucacuaaaagcagaagacacugcaauauacuacugcgcaccaagauauagcucauccugguaccucgauuauuggggacaaggaacacuaguaacaguaucuucagcaaguacaaaaggccccucagucuuuccacuagcacccaguuccaaaucuaccucaggcggaacagcagcauuaggauguuuaguaaaagacuauuuuccagaaccagucacagucucauggaacucuggugcauuaacaucaggcguacacacauucccagcaguacuacaaaguucagguuuauauucacucagcucaguaguaacaguacccucuuccuccuuagguacccaaaccuauauaugcaauguuaaccauaaaccauccaacacaaaaguagacaaaagaguugaaccaaaaagcugcgauaaaacccacacaugucccccaugcccagcaccagaauuauuaggaggaccaucaguauuccucuuuccacccaaaccaaaagauacacuaaugauaucaagaacaccagaaguuacauguguaguugucgacguuucacacgaagauccagaaguaaaauucaauugguacguagauggaguagaaguccacaacgcuaaaacaaaaccacgugaagaacaauacaacucuacuuauagaguaguaucaguacuaacaguucuccaccaagauuggcucaauggaaaagaauacaaaugcaaagucucaaauaaagcacucccagcaccuauagaaaaaacaaucucaaaagcaaaaggccaaccacgcgaaccccaaguauauacacuacccccuucaagagaagaaaugaccaaaaaccaaguuucacucacaugccuagucaaaggcuuuuacccaucagacaucgccguagaaugggaaucaaauggacaaccagaaaauaacuauaaaacaacaccccccguccuagacucugauggcagcuucuucuuauacagcaaacuaacaguagacaaaucaagauggcaacaagguaauguauucucaugcucuguaaugcacgaagcauuacauaaucacuacacacaaaaaagucuaucauuaucaccaggcaaa

SEQ ID NO: 46158 - RNA, 645 nt, Artificial Sequence
  derived and/or modified sequence opt6 from Flanvotumab_LightChain1
gaaauaguacuaacacaauccccagcaacacuaucccuaucaccaggagaaagagcaacacuaucaugccgagcaucacaaucuguaucaucauaccuagcaugguaccaacaaaaaccaggacaagcaccaagacuacuaauauaugacgcaucaaacagagcaacaggcauaccagcaagauucucaggaucaggaucaggaacagauuuuacacuaacaauaucaucauuagaaccagaagacuucgcaguauacuacugccaacaaagaucaaacuggcuaauguacacauucggacaaggaacaaaacuagaaauaaaaagaacaguagcagcaccaucaguauuuauauucccaccaucagacgaacaacuaaaaucaggaacagcaucaguaguaugccuauuaaauaacuuuuacccaagagaagcaaaaguacaauggaaaguagacaacgcacuacaaucaggaaacucacaagaaucaguaacagaacaagacucaaaagacuccacauacucccuaucauccacauuaacccuaucaaaagcagacuacgaaaaacacaaaguauacgcaugugaaguaacacaccaaggauuaucaucaccaguaacaaaauccuuuaacagaggagaaugu

SEQ ID NO: 46159 - RNA, 1362 nt, Artificial Sequence
  derived and/or modified sequence opt6 from Fletikumab_HeavyChain1
caaguccaacuaguacaaucaggagcagaaguaaaaagaccaggagccucaguuaaaguaucauguaaagccucuggauacacauucaccaacgacauaauucauugggucagacaagcaccaggacagagacuagaauggauggguuggauaaacgcaggauauggaaauacccaauacagccaaaacuuccaagauagaguaucaaucacaagagacacuucagcaucaacagcauacauggaauuaauaucacucagaucugaagauaccgccguuuauuacugugcuagagaaccccuaugguucggugaaucaucuccacaugacuauuacggaauggacguuuggggccaagguacaacaguaacaguauccucagcaucuacuaaagguccauccguauucccacuugcaccaugcucacgauccacaucugaaucaacugcagcacuaggaugucuaguuaaagauuacuuuccagaaccagucacagucaguuggaauagcggagcauuaacaucaggaguacacacauuuccagcaguauuacaaucaucaggacuauacuccuuaucaucagucguaacuguaccaucaagcucauuaggcacaaaaacauacacaugcaacguagaccauaaacccucuaauacaaaaguagacaaaagaguagaaucaaaauacggaccaccuugcccuccaugucccgcaccagaauuccuaggaggaccaucaguauuucuauuuccgccuaaaccaaaagauacauuaaugauaucaagaacaccugaaguaacauguguaguaguagaugucucacaagaagacccagaaguccaauucaauugguacguugauggaguagaaguacauaaugcaaaaacaaaaccaagagaagaacaauuuaauucaaccuacagaguagugucaguauuaaccguacuucaccaagacugguuaaaugggaaagaauauaaauguaaaguaucuaauaaaggucuaccaucaucuauagaaaaaaccauaucuaaagcaaaaggacaacccagagaaccgcaaguauauacauuaccaccaucucaagaagaaaugacaaaaaaucaaguaucauuaacauguuuaguaaaagguuuuuacccaucagacauagcuguagaaugggaaucaaauggacaaccagaaaauaacuacaaaacaacaccacccguauuagacucugacggaucauuuuuucuauacucacgacuaacaguagacaaaucaagauggcaagaaggaaacguauucucuugcucaguaaugcaugaagcacuacauaaccacuacacacaaaaaucauuaucccuuucacucggaaaa

SEQ ID NO: 46160 - RNA, 642 nt, Artificial Sequence
  derived and/or modified sequence opt6 from Fletikumab_LightChain1
gcaauacaacuaacacaaucaccaucaucccuuuccgcaucaguaggagacagaguaacuauaacaugccgagcaucccaaggaauaucaucagcacuagcaugguaccaacaaaaaccaggaaaagcacccaaacuacuaauauacgacgcaucaucacuagaaucaggagucccaucuagauucuccggaucaggaucaggaacugacuuuacacuaacaauauccucccuacaacccgaagacuucgcaacauacuacugccaacaauucaacucauacccauuaacauucggaggaggaacaaaaguagaaauaaaaagaacagucgcagccccauccguauucauauucccaccaucagacgaacaacuaaaaucaggaacagcaucagucguaugccuacucaacaacuucuacccaagagaagcaaaaguacaauggaaagucgauaacgcacuacaaucagguaacucacaagaaucaguaacagaacaagacucaaaagacucaacauacucacuaucaucaacccuaaccuuaucaaaagcagacuacgaaaaacauaaaguauacgcaugcgaaguaacacaccaaggauuaucaucaccaguaaccaaaucauucaacagaggugaaugc

SEQ ID NO: 46161 - RNA, 1341 nt, Artificial Sequence
  derived and/or modified sequence opt6 from Fontolizumab_HeavyChain1
caaguacaauuaguacaaucuggagcagaacuaaaaaaacccggaucaucuguaaaaguaucaugcaaagccucgggauacauauucacaucauccuggauaaacugggucaaacaagcaccaggccaaggacuagaauggauaggaagaauagauccauccgacggcgaaguacauuacaaccaagacuuuaaagauaaagcuacacuaacaguagauaaaucaacaaacaccgcauauauggaauuaucuucacuaagaucugaagauacagccguauacuacugcgcaagaggauuccuccccugguuugcugauuggggucaaggaacauuaguaacaguuuccucagcuagcaccaaagguccaucaguauucccacuagcuccaaguucuaaaucaacaucaggaggaacagcagcccuaggcugccuuguaaaagacuacuucccagaaccagucaccguuuccuggaacucaggcgcacuaacaucaggaguacacacauuucccgcaguacuacaauccucaggacucuacucauuauccuccguaguaacuguuccaucaucaucuuuaggaacccaaacauacauaugcaacguaaaccacaaaccuucaaacacuaaaguagauaaaaaaguagaaccaaaaucaugcgacaaaacacauacaugcccaccaugcccagcaccagaacuacuaggcggaccaucuguauucuuauuuccaccuaaaccuaaagacacacuaaugauaucuagaacaccugaaguaacauguguaguaguagacguaucacacgaagaucccgaaguaaaauucaauugguacguagacggagucgaaguacauaacgcuaaaacaaaaccaagagaagaacaauacaacucaacauacagggucguaucuguacucacaguccuacaucaagauuggcuaaacggaaaagaauacaaauguaaagucucaaauaaagcucuuccagcucccauagaaaaaacuauauccaaagccaaaggacaaccuagagaaccacaaguauacacauuaccacccucaagagaugaacuaacaaaaaaccaaguaagcuuaacaugcuuaguaaaaggauucuacccuucagacauagcaguagaaugggaauccaacgggcaaccagaaaauaauuauaaaaccacaccaccagucuuagacucagauggaagcuucuuucuauacucaaaacuaacaguugacaaaagccgauggcaacaaggaaacguauucucaugcucuguaaugcacgaagcccuacacaaucacuauacucaaaaaucacucucacuaucaccagguaaa

SEQ ID NO: 46162 - RNA, 642 nt, Artificial Sequence
  derived and/or modified sequence opt6 from Fontolizumab_LightChain1
gauauacaaaugacacaaucaccaucaacacuaucagcaucaguaggagacagaguaacaauaacauguaaagcaucagaaaacgucgacacauacguauccugguaccaacaaaaaccaggaaaagcaccaaaauuacuaauauacggagcaucaaacagauacacaggaguaccaucaagauucucaggaucaggcucaggaacagacuuuacacuaaccauaucaucacuacaaccagacgacuuugccacauauuacugcggacaauccuacaauuacccauucacauucggacaaggaacaaaaguagaaguaaaaagaacaguagcagcaccaucaguauucauauucccacccucagacgaacaacuaaaaucaggaaccgcaucaguaguaugcuuacuaaacaacuucuacccaagagaagcaaaaguccaauggaaaguagacaacgcauuacaaucaggaaacucacaagaaucuguaacagaacaagauucuaaagacucaacauacagcuuaucaucuaccuuaacauuaucaaaagcagacuaugaaaaacacaaaguauacgcaugcgaagucacacaccaaggacuaucaucaccaguaacaaaaucauucaacagaggagaaugc

SEQ ID NO: 46163 - RNA, 1344 nt, Artificial Sequence
  derived and/or modified sequence opt6 from Foralumab_HeavyChain1
cagguacaacuaguagaaagugguggagguguaguacaaccuggaagaucuuuaagacugaguugugcugcaucaggauucaaauucucaggauacggaaugcauuggguaagacaagcaccaggaaaaggcuuagaauggguagcaguaauaugguacgauggaagcaaaaaauacuauguagacucaguuaaaggaagauucacaauaucccgagauaacucaaaaaauacucuauaucuacaaaugaauagcuuaagagcagaggauaccgcaguauauuauugugcacgccaaaugggauacuggcauuucgauuuauggggaagaggaacacuaguaacaguaucaagcgcaaguaccaaaggaccaaguguauucccacuagcaccaucuucaaaaucaacaucaggagguacagccgcauuaggauguuuaguaaaagauuauuuccccgaaccaguaacaguaucuuggaacucaggagcacuaaccucaggaguacauacauucccagcaguccuacaaaguucaggacuauacucacuaaguagcguaguuacugucccuagcucaucuuuaggcacacaaacauauauauguaauguaaaucauaaaccaucuaacacuaaaguagacaaaagaguugaaccaaaaucuugugauaaaacucauaccuguccaccauguccagcaccagaagcagaaggagguccaucaguauuucuauuuccaccaaaaccaaaagauacucuaaugauuagcagaacaccagaaguaacauguguaguaguagauguaagccacgaagacccagaaguaaaauuuaauugguacguugauggaguagaaguacauaacgcaaaaacuaaaccaagagaagaacaauacaacucaacuuauagaguaguaucaguauuaacugucuuacaucaagauuggcuaaauggaaaagaauauaaauguaaaguuucaaauaaagcacuaccugcaccaauugaaaaaacuauaaguaaagcaaaaggacaacccagagaaccacaaguauauacacucccaccaaguagagaagaaaugacaaaaaaccaaguauccuuaacuugucuaguaaaagguuuuuauccaucagacauugcgguagaaugggaaucaaacggacaaccagaaaacaauuacaaaacuacccccccaguccuugacagugacggaaguuuuuuucuauauagcaaacuaacaguagauaaauccagauggcaacaagguaauguauuuucaugcagcguaaugcaugaagcacuacacaaccacuauacacaaaaaagucuaagccuuucaccaggaaaa

SEQ ID NO: 46164 - RNA, 645 nt, Artificial Sequence
  derived and/or modified sequence opt6 from Foralumab_LightChain1
gaaauaguacuaacacaaucacccgcaacacuaucacuaucaccaggagaaagagcaacacuaucaugcagagcaucacaaucaguauccucauaccuagcaugguaucaacaaaaaccaggacaagcaccaagauuacuaauauacgacgcaucaaacagagcaacaggaauaccagcaagauucucaggaucaggaucaggaacagacuucacacuaacaauaucaucacuagaaccagaagacuucgcagucuacuauugccaacaacgaucaaacuggccaccacuaacauucggaggaggaacaaaaguagaaauaaaaagaacaguagcagccccaucaguauucauauuuccaccaucagacgaacaacucaaaucaggaacagcaucaguaguaugccuacuaaacaacuucuacccaagagaagccaaaguccaauggaaaguagacaacgcauuacaaucaggaaacucacaagaaucuguaaccgaacaagacuccaaagacuccacauacucauuaucauccacauuaacauuaucaaaagccgauuacgaaaaacacaaaguauacgcaugcgaaguaacacaccaaggacuauccucaccaguaacaaaaucauuuaacagaggagaaugc

SEQ ID NO: 46165 - RNA, 1344 nt, Artificial Sequence
  derived and/or modified sequence opt6 from Foravirumab_HeavyChain1
caaguacaacuaguagaaucaggaggaggagcaguucaaccaggaagaucauuacgauuauccugcgccgccucaggauucacauucucuuccuauggaaugcacuggguaagacaagcaccaggcaaaggauuagaauggguagccguuauccuauaugacggaucagauaaauucuaugcagacucaguaaaaggacgauuuacaauaagccgugacaacagcaaaaacacccuauaucuacaaaugaauucacuaagagcagaagauacagcaguauauuacugcgcaaaaguagcaguagcaggcacacacuuugauuauuggggacaagguacccuaguaacaguaucaagugcaucuacaaaaggacccucuguauuuccacucgcaccaucaucuaaaucaacaucggguggaaccgccgcccucggaugccuagucaaagacuauuuucccgagcccguaacaguauccuggaauucaggagcacuaacaucaggaguacacacauucccagcaguacuacaaucaucaggauuauacucauuaucaucuguuguaacaguaccaaguucuucauuaggaacacaaacauacauauguaauguaaaccacaaaccaucaaacaccaaagucgacaaaagaguagaaccaaaaucaugcgacaaaacccacaccugcccaccauguccagcaccagaacuauuagguggacccucagucuuucuauucccacccaaaccaaaagacacauuaaugaucucacgaacaccagaagucaccugcguaguaguagacguaucccaugaagaccccgaaguaaaauucaauugguacguagauggaguagaaguacauaacgcuaaaacaaaaccacgagaagaacaauauaacucaacauaucgaguagucuccguacuaacaguauuacaucaagacuggcuaaacggaaaagaauacaaauguaaaguuucaaacaaagcauuaccagcuccuauugaaaaaacaauuucaaaagcuaaaggacaaccaagagaaccccaaguauacacccuaccacccagcagagaagaaaugacaaaaaaccaagucucauuaacaugccuaguaaaaggauucuacccaucagacauagcaguagaaugggaaaguaacggacaaccagaaaacaacuauaaaacaacaccaccaguccuagacucagacggcucauucuucuuauauuccaaauuaaccguagauaaaucaagauggcaacaaggaaacguuuucucauguuccguaaugcacgaagcucuacacaaccacuacacacaaaaaagccuaucauuaucaccagga

SEQ ID NO: 46166 - RNA, 1344 nt, Artificial Sequence
  derived and/or modified sequence opt6 from Foravirumab_HeavyChain
gaaguacaacucguagaaucaggaggaggagccguacaaccuggaagaucuuuaaggcuaucaugugcagccucaggauucacauucucaucauauggaaugcacuggguacgacaagcuccuggaaaaggacuagaauggguagcaguuaucuuauaugacggaucagauaaauuuuacgccgacucuguaaaaggaagauucaccauaucuagagauaacucaaaaaacacauuauacuuacaaaugaacuccuuacgagcagaagacacagcaguauauuacugcgcuaaaguagcagucgcaggcacacauuucgacuacuggggccaagguacauuaguaacaguuaguucagccucuacaaaaggaccuucaguauucccacuagccccaucuucaaaaucaacaucaggaggaacugcagcacuaggaugcuuaguaaaagacuauuuucccgaaccaguaacagucucauggaauagcggcgcauuaacauccggaguacauacauuuccggcaguauuacaaucuucaggauuauauucuuuaucuucaguaguaacaguaccaagcucaagccuaggaacacaaacauacauaugcaauguaaaccacaaaccaucaaacacaaaaguagacaaacgaguugaaccaaaauccugcgauaaaacucacaccugcccacccuguccagcuccagaauuauuaggaggcccaaguguauuccuauuuccaccuaaaccaaaagacacauuaaugauaagcagaacaccagaaguaacuuguguaguuguagacguaucacacgaagacccagaagugaaauuuaacugguacguagacggaguagaaguacauaaugcaaaaacuaaaccuagagaagaacaauacaauagcacauacagaguuguaagcguacuaacaguauuacaccaagacugguuaaacggaaaagaauacaaauguaaaguaucuaauaaagcccucccagcaccaauagaaaaaacaauaucaaaagcaaaaggacaaccaagagaaccacaaguauacacgcuaccuccaaguagagaagaaaugacaaaaaaucaaguaucacuaacuugucuagucaaaggauucuauccaucugacaucgcaguagaaugggaaagcaacggacaacccgaaaauaauuacaaaacuacuccaccaguacuagauucagauggaucauucuuucuauacucaaaauuaacaguagauaaaucacgauggcaacaaggaaauguauuuuccuguucagucaugcaugaagcauuacauaaucauuauacacaaaaaucauuaagcuuaaguccugga

SEQ ID NO: 46167 - RNA, 642 nt, Artificial Sequence
  derived and/or modified sequence opt6 from Foravirumab_LightChain1
gacauccaaaugacacaaucaccaucaucauuaucagcaucaguaggagaucgaguaacaauaacaugcagagcaucacaaggaauaagaaacgaccuaggaugguaccaacaaaaacccggaaaagccccaaaacuauuaauauacgcagcauccucacuucaaucaggaguaccaucaagauuuucaggaucaggaucaggaaccgacuucacauuaacuauaucaucacuacaaccagaagacuucgcaacauauuacugccaacaauuaaacucauacccaccaacauucggaggaggaacaaaagucgaaauaaaaagaacaguagcugccccaucaguauucauauuuccaccaucagacgaacaacuaaaaucagguacagccucagucguaugcuuacuaaacaacuucuacccacgagaagcaaaaguccaauggaaaguagacaacgcauuacaaucaggaaacucacaagaaucaguaacagaacaagacucaaaagacucaacauacucacuaucaucaacauuaacccuaucaaaagcagacuaugaaaaacacaaaguauacgcaugcgaaguaacacaccaaggauuaucaucaccaguaacaaaaucauuuaacagaggagaaugc

SEQ ID NO: 46168 - RNA, 1341 nt, Artificial Sequence
  derived and/or modified sequence opt6 from Fresolimumab_HeavyChain1
caaguucaauuaguacaaaguggcgcagaaguaaaaaaaccaggaucaagugucaaaguauccugcaaagcauccggauauacuuuuucaucaaacguaauaucaugggucagacaagcaccaggacaaggauuagaauggaugggaggaguaauaccaauaguagauaucgcaaacuaugcacaacgauucaaaggccguguaacaauaacagcagaugaaucuacaucaacaaccuacauggaacuaucuagucuacgaucugaagauacagcaguauauuacugcgccucaacacuuggauuaguccuagacgcaauggauuacuggggacaaggaacauuaguaacuguuucaucagcaucaacaaaaggaccaucaguauucccuuuagccccaugcucuagauccaccucugaaagcacagcugcacuaggaugcuuaguaaaagauuacuucccagaaccagucacaguaucuuggaacuccggcgcauuaacauccggcguacacacauuuccagcaguacuccaaaguuccggauuauacucauuaucaucaguaguuacgguaccaucuucaucacuaggaacaaaaacauauacauguaauguagaccauaaaccaucaaauacaaaaguggacaaacgagucgaaucaaaauacggacccccauguccaucaugcccugccccagaauuccuaggaggaccuucaguauuuuuauucccaccaaaaccaaaagacacauuaaugauaaguagaacaccagaaguaacaugcguaguaguugacguaucucaagaagacccagaaguucaauucaauugguacguugauggaguugaaguccacaaugcaaaaacaaaaccacgagaagaacaauucaauucaacauauagaguaguaucaguauuaacaguacuucaccaagacugguuaaauggaaaagaauauaaaugcaaaguaucaaacaaaggacuaccuucaucaauagaaaaaacaauaaguaaagccaaaggacaaccuagagagccacaaguauacacauuaccaccaucccaagaggaaaugacaaaaaaucaaguaucacuuacuugucuaguuaaaggauucuauccaucagacauagcaguugaaugggaaagcaacggacaaccagaaaacaacuauaaaacuacaccuccaguccuagauucagauggauccuucuuucuauacucaagacuaacaguagacaaaucuagauggcaagaaggaaauguauucuccugcucaguuaugcacgaagcauuacacaaucacuauacacaaaaaucuuuaucacuaucauuaggaaaa

SEQ ID NO: 46169 - RNA, 645 nt, Artificial Sequence
  derived and/or modified sequence opt6 from Fresolimumab_LightChain1
gaaacaguacuaacccaaucacccggaacauuaucccucucaccaggagaaagagcaacacuaucaugcagagcaucacaaucauuaggaucaucauaccuagcaugguaucaacaaaaaccaggacaagcaccaagacuacuaauauacggagcaucaucaagagcaccaggaauaccagacagauucucaggaucaggaucaggaacagacuucacacuaacaauaucaagacuagaacccgaagacuucgcaguauacuacugccaacaauacgcagacucacccaucacauucggacaaggaacaagacuagaaauaaaaagaaccguagccgcaccaucaguauucauauucccaccaucagaugaacaacucaaaucaggaacagcaucaguaguaugccuacuaaacaacuucuacccaagagaagcuaaaguacaauggaaaguagacaacgcauuacaauccggaaacucacaagaaucaguaacagaacaagacucaaaagacucaacauacucacuaucaucaacacuaacauuaucaaaagcagacuacgaaaaacacaaaguauacgcuugcgaaguaacacaccaaggacuaucaucaccaguaacaaaaucauucaaccgaggagaaugc

SEQ ID NO: 46170 - RNA, 1347 nt, Artificial Sequence
  derived and/or modified sequence opt6 from Fulranumab_HeavyChain1
gaaguacaauuaguagaauccgguggaggauuaguacaacccggcggaucacuacgauuaucaugcgcugcaucaggauuuacacuaaggucauauucaaugaauugggucagacaagcaccaggaaaaggauuagaauggguaucauauaucagcaggucuucacauacaauauucuaugcagacucuguaaaaggaagauuuacaauaucccgagacaaugcaaaaaacucauuauauuuacaaauggauucauuaagagaugaagauaccgcaauguauuauugugccagaguauacucuucaggauggcacguaucagauuacuuugauuauuggggucaggguauccuaguuacaguaucaagugcaucaacuaaaggucccucaguuuuuccacuagcaccaugcagcagaucuaccucagaaucaacagcugccuuaggauguuuaguaaaagauuacuuuccagaaccaguaacuguuuccuggaauucaggagcacucacuucuggaguacauacauuuccagcaguucuacaauccucaggacuauacucccuaucaucaguaguaaccguacccuccuccaacuucggaacacaaacauauacauguaauguagaccacaaaccaucaaacaccaaaguagacaaaacaguagaaagaaaauguuguguagaaugcccaccauguccagcuccaccaguagccggacccucaguuuuucuauucccgccaaaaccgaaagacacauuaaugauaucaagaacaccagaagugacaugcguugucguugacgucucucaugaagauccagaaguucaauucaacugguaugucgacgguguagaaguacauaaugcaaaaacaaaaccuagagaagaacaauucaacucaacauuccgaguaguaucagucuuaacaguaguacaucaagauugguuaaaugguaaagaauacaaauguaaaguaucaaacaaaggacuaccagcuccaaucgaaaaaacaauaucaaaaacaaaaggacaaccuagagaaccacaaguauacacacuccccccuucccgagaagaaaugacaaaaaaucaaguaucacuaacaugcuuaguaaaaggauuuuauccgucagauauagcaguagaaugggaaucaaauggacaaccagaaaacaacuauaaaacaacaccaccaaugcuagacucugacggaucuuuuuuuuuauacucuaaacuaacaguagauaaaucaagauggcaacagggaaacguauucucuuguuccgucaugcacgaagcauuacauaaucacuacacacaaaaaucacuaucacuuucaccaggaaaa

SEQ ID NO: 46171 - RNA, 642 nt, Artificial Sequence
  derived and/or modified sequence opt6 from Fulranumab_LightChain1
gcaauacaacuaacacaaucacccucaucacuaucagcaucaguaggagacagaguaaccauaaccugcagagcaucacaaggcauaucaucagcacuagcaugguaucaacaaaaaccaggaaaagcaccaaaacuacuaauauacgacgcauccucauuagaaucaggcguaccuucaagauucucaggcucaggaucaggaacagacuucacauuaacaauaucuucauuacaaccagaagacuucgccacauacuacugccaacaauucaacucauacccacuaacauucggaggaggaacaaaaguagaaauaaaaagaacaguagcagccccaucaguauucauauuccccccaucagacgaacaauuaaaaucaggaacagcaucagucgucugucuacuaaacaacuucuacccacgcgaagcaaaaguacaauggaaaguagacaacgcacuacaaucaggaaauucacaagaaucaguaacagaacaagacucaaaagacucaacauacucacuaucaucaacuuuaacauuaucaaaagcagacuacgaaaaacacaaaguauacgcaugcgaaguaacacaccaaggacuaucaucacccguaaccaaaucauucaacagaggagaaugc

SEQ ID NO: 46172 - RNA, 1356 nt, Artificial Sequence
  derived and/or modified sequence opt6 from Futuximab_HeavyChain1
gaaguacaacuccaacaacccggguccgaacuuguaagaccaggagcaucuguuaaacuaucauguaaagccucaggauacacauuuacauccuacuggaugcacuggguaaaacaaagacccggacaaggauuagaauggaucggaaauauauacccaggaucaagaaguacaaauuaugaugaaaaauuuaaaucuaaagccacacuaacagucgacacaucauccuccaccgcauauaugcaacuaucaucacuaacaagcgaagauucagcagucuauuauuguacaagaaacggcgacuacuauguuucaucaggcgaugcaauggacuauuggggacaaggcacaucagucacaguaucaucagcuucaacaaaaggaccaucugucuucccauuggcaccuucauccaaaucaacaucugggggaacagccgcacucggaugccuuguuaaagauuacuuuccagaaccuguaacaguaucuuggaauucaggcgcacuaacaucuggaguccacacauuuccagccguauuacaaucaucaggccuauacagcuuauccuccguaguaacaguaccaucaucuucacucggcacacaaacauauauuuguaacguuaaucacaaaccuuccaacacaaaaguugauaaaagagucgaacccaaaucaugcgauaaaacacacacaugccccccaugcccagcaccagaauuauuaggaggccccucaguauucuuauucccaccaaaacccaaagauaccuuaaugauuucucgaacccccgaaguuacauguguaguaguagaugucucucaugaagacccagaaguaaaauucaacugguacguagauggaguugaaguacacaaugcaaaaacaaaaccaagagaagaacaauacaauuccacauacagagucgucucaguacuaacaguauuacaccaagacuggcuaaacggaaaagaauacaaaugcaaaguaagcaacaaagcauuaccagccccaauagaaaaaacaauaucaaaagcaaaaggacaaccaagagaaccacaaguauacacauuaccaccuucuagagaagaaaugacuaaaaaccaaguaaguuuaacaugccuuguaaaaggauucuaucccagcgacauagcaguagaaugggaaucaaacggacaaccagaaaacaauuacaaaaccacaccacccguacuagacuccgacggaucauuuuuccuauauucaaaacuaacaguagacaaaucuagauggcaacaaggaaacguauucucaugcucaguaaugcacgaagcacuacacaaccacuauacacaaaaaucacuaucccuaucaccagga

SEQ ID NO: 46173 - RNA, 642 nt, Artificial Sequence
  derived and/or modified sequence opt6 from Futuximab_LightChain1
gacauacaaaugacacaaacaaccucaucacuaucagcaagccuaggagacagagucacuauaucaugccgaacaagccaagacauaggcaacuaccuaaacugguaccaacaaaaaccagauggcacaguaaaauuacuaauauacuacacaucaagauuacacucaggaguaccaagcagauucucaggcucaggaucaggaacagacuucucacuaacaauaaacaacguagaacaagaagacguagcaacauacuucugccaacacuacaacacaguaccaccuacauucggaggaggaacaaaacuagaaauaaaacgaacagucgcagcaccaucaguauucauauucccaccaucagacgaacaacuaaaaucaggaacagccucaguaguaugccuacucaacaacuucuacccaagagaagcaaaaguacaauggaaaguagacaacgcacuacaaagcggaaauucacaagaaucaguaacagaacaagacagcaaagacucaacauauucacuaagcucaacacuaacacuaucaaaagcagauuacgaaaaacacaaaguauaugcaugugaaguaacacaccaaggacucucaucaccaguaacaaaaagcuucaauagaggcgaaugc

SEQ ID NO: 46174 - RNA, 1335 nt, Artificial Sequence
  derived and/or modified sequence opt6 from Galcanezumab_HeavyChain1
caaguucaacuaguacaaaguggagcagaaguuaaaaaaccaggaucuucaguaaaaguauccuguaaagccuccggcuacaccuuuggaaacuauuggaugcaauggguaagacaagcaccaggucaaggucuagaauggaugggagcaauauacgaaggaacaggaaaaacaguauauauacaaaaauuugcagauagaguuacaauaacagcagacaaaucaaccucaacagcauacauggaacuaagcucucucagaagugaagauacagcaguauacuauugugcccgauuaagugacuaugucucaggauucggauauuggggccaaggcacaacaguaacaguauccucagcauccacaaaaggaccaucaguuuuuccauuagcaccauguucaagaagcacaucagaaaguaccgcugcacuaggaugccuagucaaagauuacuuuccugaaccuguaacaguaucuuggaacucuggagcacuaaccucaggaguacacacauucccagcaguauuacaaaguuccggacuguauagucuaucaaguguaguuacaguuccaucguccucacuaggaacaaaaacauacacaugcaauguagaccauaaaccaaguaauaccaaagucgauaaaagaguagaaucaaaauacggaccgccaugccccccuugcccagcaccagaagccgcaggaggaccaagcguauucuuauuuccaccuaaaccaaaagauacacuaaugauaucacguaccccagaagucaccuguguaguaguagauguaucacaagaagacccagaaguccaauuuaacugguauguagacggaguagaaguacauaaugcaaaaacaaaaccaagagaagaacaauucaauucaacauaucgaguaguaucuguacuaaccguauuacaccaagauuggcugaauggaaaagaauauaaauguaaaguaucaaauaaaggccuaccaucaaguauagaaaaaacaauuaguaaagcaaaaggacaaccacgagaaccccaaguuuauacauuaccaccaucacaagaagaaaugaccaaaaaccaaguuucccuaacaugccuaguuaaaggauucuauccaagugacauagcaguagaaugggaaagcaacggacaaccagaaaacaauuauaaaacaacacccccaguuuuagauucagacgguucauuuuuuuuauauucaagacuaacaguagacaaaucaagauggcaagaagguaauguauuuagcugcuccgucaugcacgaagcauuacauaaccacuauacucaaaaaucauuaucacuaucauuagga

SEQ ID NO: 46175 - RNA, 642 nt, Artificial Sequence
  derived and/or modified sequence opt6 from Galcanezumab_LightChain1
gacauacaaaugacacaaucaccaucaagucuaucagcaucaguaggagacagagucaccauaacaugcagagcaagcaaagacauaucaaaauacuuaaacugguaccaacaaaaaccaggaaaagcaccaaaauuacuaauauacuacaccucaggauaccacucaggcguaccaucaagauucucaggaucaggaucaggaacagacuucacacuaacaauaucaucacuacaaccagaagacuuugccacauacuacugccaacaaggcgacgcacuaccaccaacauucggaggaggaacaaaagucgaaauaaaaagaacaguagcagcaccaucaguauucauauucccaccaucagacgaacaacuaaaaucaggaacagcaucaguaguaugccuacuaaacaacuucuacccacgagaagccaaaguccaauggaaaguagacaacgcacuacaaucaggaaacucacaagaaucaguaaccgaacaagacucaaaagauucaacauacucacuaucaucaacacuaacacuaucaaaagcagacuacgaaaaacacaaaguauacgccugcgaaguaacacaccaagguuuaucaucaccaguaacaaaaucauucaacagaggagaaugc

SEQ ID NO: 46176 - RNA, 1371 nt, Artificial Sequence
  derived and/or modified sequence opt6 from Galiximab_HeavyChain1
caaguccaacuccaagaauccggaccaggccucguaaaaccauccgaaaccuuaucacucacaugugcaguauccggcggaucaauuucaggaggcuauggcuggggauggauaagacaaccucccggaaaaggauuagaauggaucggauccuuuuauuccucaucagguaacacauauuacaauccaagccuaaaaucccaaguaacaauuucaacagacaccucuaaaaaucaauucuccuuaaaacuaaacuccaugacagcagcagauacugcagucuauuauugcguaagagaucgauuauucucagucgucggaauggucuauaacaacugguuugacguaugggguccaggaguuuuaguuacaguuucauccgcauccacaaaaggaccuucaguauucccauuagcccccagcucaaaaucaacauccggaggaaccgcagccuuagguugccuaguaaaagauuacuuuccugaaccaguaaccguaucauggaauuccggugcccucacuucaggaguucacacauuccccgcaguacuacaaucuuccggacuauauuccuuauccuccguuguaacaguaccaucauccagccuuggcacacaaacauacauaugcaacguaaaccacaaaccaucaaacacaaaaguagacaaaaaagcagaacccaaaucaugcgacaaaacccacacaugcccaccaugcccagcuccagaauuacucggaggaccaucaguauuccuuuuuccacccaaaccaaaagacacacuaaugauaucaagaacaccagaaguuaccugcguaguaguagauguaucacaugaagaucccgaaguaaaauucaauugguacguagacggaguagaaguacacaacgccaaaacaaaaccacgagaagaacaauacaacaguacauacagaguagucucuguacucacaguucuacaccaagacugguuaaacggaaaagaauacaaauguaaaguuucaaacaaagcacuaccagcaccaauagaaaaaaccauaucgaaagccaaaggacaaccccgagaaccacaaguauauacacuuccaccauccagagacgaauuaacaaaaaaucaaguaucccucacaugccuaguaaaagguuuuuacccaucagacauagcuguagaaugggaauccaacggacaaccagaaaacaacuauaaaacuacaccaccaguccuugauucagacggaagcuuuuuccuauacaguaaacuaacaguagauaaaucuagauggcaacaaggaaacguauucucaugcucugucaugcacgaagcauuacacaaccacuauacacaaaaaucuuuaucucuaucaccuggaaaa

SEQ ID NO: 46177 - RNA, 648 nt, Artificial Sequence
  derived and/or modified sequence opt6 from Galiximab_LightChain1
gaaucagcacuaacacaaccaccaucagucucaggagcaccaggacaaaaaguaacaauaucaugcacaggaucaacaucaaauauaggaggauacgacuuacacugguaccaacaauuacccggaacagcaccaaaacuacuaauauacgacauaaacaaaagaccuucaggaauaucagacagauucucaggaagcaaaucaggaacagcagcaucucuagcaauaacaggauuacaaacagaagacgaagcagacuauuacugccaaucauacgacucaucacuaaacgcacaaguauucggaggaggaacaagacuaacaguacuaggacaacccaaagcagcaccaacaguaaccuuauucccaccaagcucagaagaacuacaagcaaacaaagcaacacuaguaugccuaauaucagauuucuacccaggagcaguaaccguagcauggaaagccgauucaucaccaguaaaagcaggaguagaaacaacaacaccaucuaaacaaucaaacaacaaauacgcagcaucaaguuaccuaagucuaacaccagaacaauggaaaucacacagauccuacucaugucaaguaacacacgaaggaucaacagucgaaaaaacaguagcaccaaccgaaugcuca

SEQ ID NO: 46178 - RNA, 1347 nt, Artificial Sequence
  derived and/or modified sequence opt6 from Ganitumab_HeavyChain1
caaguucaacuacaagaaucaggacccgguuuaguuaaacccucugguacacugucuuuaacaugcgcaguaucaggcgguucuauauccucaucaaauugguggucauggguacgccaaccaccaggaaaaggauuagaauggauuggcgaaaucuaccacucuggaucaacuaacuauaacccaucacucaaauccagaguaacaauaucaguagacaaauccaaaaaccaauucucacuaaaauuaagcucaguaaccgcagcagacacggcaguauauuauugcgcacguuggacaggacgcacagacgcuuuugauauuuggggacaaggcacaaugguaacaguaucaucagcauccacaaaaggaccaucagucuuucccuuagcaccuucauccaagucuacaaguggaggcacagcagcacuaggauguuuaguaaaagauuauuuuccagaacccguaacaguauccuggaacucaggagcauuaacaucaggcguacacacauuuccagccguauuacaauccucaggauuauauucccucucaagugucguaacaguaccaucaucaucacuaggaacacaaaccuacauaugcaauguaaaccauaaacccucaaauacaaaaguagauaaaaaaguagagccuaaaucaugcgacaaaacccauacaugcccacccugcccagcaccagaauuacucggcggcccuucaguuuucuuauucccuccaaagccaaaagacacacuaaugauaucaagaacaccagaagucacaugugucguaguagacguaucccacgaagacccagaaguaaaauuuaauugguauguagacggaguagaaguacacaacgcaaaaacaaaaccaagagaagaacaauacaacuccacuuauagaguaguaaguguacuaacaguccuacaccaagacugguuaaacgguaaagaauauaaaugcaaagucucaaacaaagcauuaccagcuccaaucgaaaaaacaaucucaaaagcuaaaggacaaccaagagaaccucaaguuuacacauuaccuccuuccagagacgaauuaaccaaaaaucaaguaucacuaacauguuuaguaaaaggauuuuacccuucagauauagcagucgaaugggaauccaacggacaaccagaaaacaacuauaaaacaacaccacccguccuagauucagacgguucauuuuuccuuuauagcaaacuaaccguagacaaaucaagauggcaacaggguaacguauucucaugcucaguaaugcacgaagcacuacauaaucauuacacccaaaaauccuuaucucucucaccaggcaaa

SEQ ID NO: 46179 - RNA, 657 nt, Artificial Sequence
  derived and/or modified sequence opt6 from Ganitumab_LightChain1
gacguaguaaugacacaaucaccacuaucacuaccaguaacaccaggagaaccagcaucaauaucaugcagaucaucucaaucacuacuacacucaaacggauacaacuaccuagacugguacuuacaaaaaccaggacaaucaccacaauuacuaauauaccuaggaaguaacagagcaagcggaguaccagacagauucucaggaucaggcucaggaacagacuuuacacuaaaaauauccagaguagaagcagaagacguaggaguauauuacugcaugcaaggaacacacuggccacuaacauucggacaaggaacaaaaguagaaauaaaaagaacaguagccgcaccaucaguauucauauucccaccaucagacgaacaacuaaaaucaggaaccgcaucaguaguuugcuuauuaaacaacuucuacccaagagaagcaaaaguacaauggaaaguagacaacgcacuccaaucaggaaacucacaagaaucaguaacagaacaagacagcaaagacucaacauacucacuaucaucaacacuaacacuaucaaaagcagacuaugaaaaacacaaaguauacgcaugcgaaguaacacaccaaggacuaaguucaccaguaacuaaaagcuucaaccgaggagaaugc

SEQ ID NO: 46180 - RNA, 1368 nt, Artificial Sequence
  derived and/or modified sequence opt6 from Gantenerumab_HeavyChain1
caaguagaauuaguagaaaguggaggaggauuaguacaaccaggaggaagccuucgucuaaguugugcagcaucaggauucacauuuuccucauaugcaaugagcugggucagacaagcaccuggaaaaggacucgaauggguaucagcaaucaaugcaucuggaacccgcacauacuaugcugauucaguaaaaggcagauuuacaaucucaagagacaauaguaaaaacacccuauauuuacaaaugaauucauuaagagcagaagacacagcaguauacuacugugcacgaggaaaaggaaauacccauaaaccuuauggauacguaagauacuuugauguauggggacaaggcacccuagucacagucucaucagccaguacaaaagguccaucaguauuuccacuagcuccaucaucaaaaaguacaagcggaggaacagcagcucuagguugccuaguuaaagauuacuucccugaaccgguaacaguauccuggaauagcggagcccuaaccucaggaguacacacauuuccagccguacuacaaucaucaggcuuauacucacuaucaucagucguaacaguaccaagcuccagucucggaacacaaacauauauauguaauguaaaucacaaaccuucaaauaccaaaguggauaaaaaaguagaaccuaaaucaugcgauaaaacacacacaugcccuccauguccagcacccgaauugcuaggcgguccaagcguauuccuauuuccaccaaaaccuaaagacacauuaaugauaucaagaacaccagaaguaacaugcguaguaguagauguaucacaugaagacccagaaguuaaauuuaauugguacguagauggaguagaaguacacaaugcuaaaacgaaaccaagagaagaacaauacaacagcacauacagaguaguaagcgugcucacaguacuacaucaagacuggcuaaacggcaaagaauacaaauguaaaguaaguaauaaagcuuuaccagcaccaaucgaaaaaacaauaucaaaagcuaaaggucaaccaagagaaccacaaguauauacauuaccaccauccagagacgaauuaacaaaaaaucaaguaagccuaaccuguuuaguaaaagguuucuauccaucagauauagcaguagaaugggaaucaaacggacaaccugaaaauaauuauaaaacaacaccaccaguacuagacagcgacggaucauucuuccuauacucaaaacuaacagucgacaaaucacguuggcaacaaggcaaugucuuuuccuguucaguaaugcaugaagcccuacauaaccauuacacacaaaaaucacuaagccuuucaccagguaaa

SEQ ID NO: 46181 - RNA, 645 nt, Artificial Sequence
  derived and/or modified sequence opt6 from Gantenerumab_LightChain1
gacauaguacuaacacaaucaccagcaacacuaucacucucaccaggagaaagagcaacacuaucaugcagagccucacaaucagucucaucaucauacuuagcaugguaccaacaaaaaccaggacaagccccaagacuacuaauauacggagcaucaucacgagcuacaggaguacccgcaagauucucaggaucaggaucaggaacagacuucacacuaacaauaucaucauuagaaccagaagacuucgcaacauacuacugccuacaaauauacaacaugcccauaacuuucggacaaggaacaaaaguagaaaucaaaagaacaguagcagcaccaucaguauucauauucccaccaucagacgaacaacuaaaaucaggaacagcaucaguaguaugccuauuaaauaacuucuacccaagagaagcaaaaguacaauggaaaguagacaacgcauuacaaucaggaaacucccaagaaucaguaacagaacaagacucaaaagacucaacauacucauuaucaucaacacuaacauuaucaaaagcagacuacgaaaaacacaaaguauacgccugcgaaguaacacaccaaggauuaucaucaccaguaacaaaaucauucaaccgcggugaaugc

SEQ ID NO: 46182 - RNA, 348 nt, Artificial Sequence
  derived and/or modified sequence opt6 from Gemtuzumab_HeavyChain1
caaguacaauuacaacaaagcggagcagaacuagcaaaaccaggagcaagcguaaaaaugagcuguaaagcaagcggauacacauucacaagcuauagaaugcacuggguaaaacaaagaccaggacaaggacuagaauggauaggauauauaaauccaucaacaggauacacagaauauaaccaaaaauuuaaagauaaagcaacauuaacagcagacaaaagcucaagcacagcauauaugcaacuaucaagcuuaacauuugaagauagugcaguauauuacugugcaagaggaggaggaguauucgauuacuggggacaaggaacaacauuaacaguaagcuca

SEQ ID NO: 46183 - RNA, 351 nt, Artificial Sequence
  derived and/or modified sequence opt6 from Gemtuzumab_HeavyChain2
caaguacaacuaguacaaaguggagcagaaguaaaaaaaccaggaaguaguguaaaaguaaguuguaaagcaaguggaggaacauuuaguagaagugcaauaauauggguaagacaagcaccaggacaaggauuagaauggaugggaggaauaguaccaauguuuggaccaccaaauuaugcacaaaaauuucaaggaagaguaacaauaacagcagaugaaaguacaaauacagcauauauggaauuaaguaguuuaagaagugaagauacagcauuuuauuuuugugcaggaggauauggaauauauaguccagaagaauauaauggaggauuaguaacaguaaguagu

SEQ ID NO: 46184 - RNA, 321 nt, Artificial Sequence
  derived and/or modified sequence opt6 from Gemtuzumab_LightChain2
gacauacaaaugacacaaucaccaucaacacuaucagcaucaguaggagacagaguaacaauaacaugcagagcaucacaaucaauaaacacauggcuagcaugguaccaacaaaaaccaggaaaagcaccaaaacuacuaauguacaaagcaucaucacuagaaucaggaguaccaucaagauucauaggaucaggaucaggaacagaauucacacuaacaauaucaucacuacaaccagacgacuucgcaacauacuacugccaacaauacaacucagacucaaaaauguucggacaaggaacaaaaguagaaguaaaa

SEQ ID NO: 46185 - RNA, 318 nt, Artificial Sequence
  derived and/or modified sequence opt6 from Gemtuzumab_ozogamicin_LightChain1
caaauaguacuaacacaaucaccagcaauaaugucagcaucaccaggagaaaaaguaacaauaacaugcucagcaucaucaucaauaucauacaugcacugguuccaacaaaaaccaggaacaucaccaaaacuauggauauacacaacaucaaaccuagcaucaggaguaccagcaagauucucaggaucaggaucaggaacaucauacucacuaacaauaucaagaauggaagcagaagacgcagccacauacuacugccaccaaagaucaacauacccacuaacauucggaucaggaacaaaacuagaacuaaaa

SEQ ID NO: 46186 - RNA, 1335 nt, Artificial Sequence
  derived and/or modified sequence opt6 from Gevokizumab_HeavyChain1
caaguucaacuacaggaaucaggaccaggucuaguaaaaccaucccaaacccuaucacuaacauguucauuuucaggauuuagccuaucaacaaguggaaugggcgucggauggauaagacaaccauccgguaaaggacuagaauggcuugcacacauauggugggauggugacgaaagcuauaacccaucccuuaaaucaagacuaacaauaucaaaagacacaucaaagaaccaagucucacucaaaauaacaaguguaacagcugcagacacagcaguauauuucugugcaagaaaccgauacgauccaccaugguuuguagacuggggacaaggaacauuaguaacaguaucaucagcaucaacaaaaggaccauccgucuuuccccuagcaccaugcucaagaucaacaucagaaucaacagcagcauuagguugcuuaguuaaagacuauuuuccugaaccaguaacaguaucauggaauucaggagcacuaacaucuggaguccauacauuucccgcaguuuuacaaucaagcggacucuacagccuauccucaguagucaccguaacaucaucaaacuucggaacacaaaccuacacaugcaacguggaccauaaaccaagcaauaccaaaguugauaaaacuguagaacgaaaaugcuguguagaauguccaccaugucccgcacccccuguagcagguccaucaguauuucuuuuuccaccaaaacccaaagacacacuaaugauaucacgaacaccagaaguaacauguguaguaguagauguuagucacgaagacccagaaguacaauuuaacugguauguagacgguauggaaguucacaacgcaaaaaccaaaccccgagaagaacaauucaauucaacauuuagaguaguuucuguccuaacaguaguacaccaagauuggcuaaauggaaaagaauacaaauguaaaguaucaaacaaaggacuacccgcaccaauagaaaaaaccauaagcaaaacaaaaggccaacccagggaaccucaaguauacacccuaccaccaucacgagaagaaaugacuaaaaaucaaguuucccuaacaugccucguaaaaggauuuuauccaucagauauagcaguagaaugggaaucaaauggacaaccugaaaacaauuauaaaacaacaccacccauguuagauagugauggaagcuuuuuccuauacucaaaauuaacaguagacaaaagcagauggcaacaaggaaacgucuucucaugcagcgucaugcacgaagcauuacacaaccauuauacacaaaaaucacucucauuaucuccagga

SEQ ID NO: 46187 - RNA, 642 nt, Artificial Sequence
  derived and/or modified sequence opt6 from Gevokizumab_LightChain1
gacauacaaaugacacaaucaacaucaagccuaagcgcaagcguaggagacagaguaacaauaacaugcagagcaagccaagacauuucaaauuaccuaagcugguaccaacaaaaacccggaaaagcaguaaaauuacuaauauacuacacaagcaaacuccacagcggaguaccaagcagauucucaggaucaggaucaggaacagacuacacacuaacaauaagcucacuacaacaagaagacuucgcaacauacuucugcuuacaaggaaaaaugcuaccauggacauucggacaaggaacaaaacuagaaauaaaaagaacagucgcagcaccaagcguauucauauucccaccaucagacgaacaacuaaaaucaggaacagcaucaguaguaugcuuacucaacaauuucuacccaagagaagcaaaaguacaauggaaaguagauaacgcacuacaaaguggaaacucacaagaaucaguaacagaacaagacagcaaagacucaacauacagcuuaagcucaacauuaacuuuaucaaaagcagacuacgaaaaacacaaaguauacgcaugcgaaguaacacaccaaggacuaagcucucccguaacaaaauccuucaaccgaggagaaugc

SEQ ID NO: 46188 - RNA, 1347 nt, Artificial Sequence
  derived and/or modified sequence opt6 from Girentuximab_HeavyChain1
gauguaaaacucguagaaucaggaggagguuuagucaaauuaggaggaucacuaaaauuaucaugugcagcauccggauucacauuuuccaacuacuacaugucauggguaagacaaacaccagaaaaacgacuagaacuagucgcagcaauaaacucagacggcggaauaacauacuauuuagacacaguaaaaggaagauuuacuauaucgagagauaacgcaaaaaacacauuauaccuacaaaugucaucauuaaaaucugaagacacagcccuauucuauugugcacgucauagaucaggauacuuuagcauggauuacuggggccaagguaccuccguaacaguaucaagcgcauccacaaaaggcccaucagucuuuccauuagcuccaucaucaaaaucaacuucaggaggaacagcagccuuaggaugccucgucaaagacuacuuucccgaaccaguaacuguaucauggaauucaggagcccuaaccuccggcguacacacauucccagcaguacuucaaucaucaggacuauacucauuaucaucuguaguaacagucccauccucaagucuaggaacacaaacuuauauauguaacgucaaccacaaaccauccaauacaaaaguagacaaaaaaguugaaccaaaaucaugcgacaaaacacacacauguccuccaugccccgcgccagaacuacuaggaggacccucaguauuucuauucccaccaaaaccaaaagacacccuaaugauaucaagaacaccagaaguaacaugcguaguuguagauguaagucacgaagacccagaaguaaaauuuaacugguacguagacggagucgaaguacacaaugcaaaaacaaaaccuagagaagaacaauauaacaguacauaucgagucguaucaguauuaacaguauuacaucaagacuggcuaaauggaaaagaauacaaaugcaaaguaucaaacaaagcacuaccagcccccaucgaaaaaacaauaagcaaagcaaaaggacaaccacgugaaccacaaguauacacauuaccacccucuagagaugaacuaacaaaaaaucaaguaucauuaacaugccuaguaaaaggauuuuauccaucagacauagccguagaaugggaaucaaacggccaaccagaaaacaacuacaaaacaacaccaccaguacuagacucagauggaucauuuuucuuauacagcaaacuaaccguugacaaaucaagauggcaacagggaaauguauuuucauguucaguaaugcacgaagcccuacacaaccacuauacccaaaaaucucuaucauuaucuccaggaaaa

SEQ ID NO: 46189 - RNA, 642 nt, Artificial Sequence
  derived and/or modified sequence opt6 from Girentuximab_LightChain1
gauauaguaaugacacaaucacaaagauucaugucaacaaccguaggagauagaguaagcauaacaugcaaagcaucacaaaacguaguaucagcaguagcaugguaccaacaaaaaccaggacaaucaccaaaauuauuaauauauagcgcaagcaauagauacacaggaguaccagacagauucacaggaucuggaucaggaacagacuuuacacuaacaauaagcaacaugcaaucagaagacuuagcagauuucuuuugccaacaauauagcaauuacccauggacauucggaggaggaacaaaacuagaaauaaaacgaacgguagcagcaccaagcguauucauauuuccaccaucagacgaacaauuaaaaucuggaacagcaucaguaguaugcuuacuaaauaacuuuuacccaagagaagcaaaaguccaauggaaaguagauaaugcacuacaaagcggaaacucacaagaaagcguuacagaacaagauagcaaagacucaacauauagcuuaagcucaacacuuacacuaucaaaagcagauuacgaaaaacacaaagucuacgcaugcgaaguaacacaccaaggauuauccucaccaguaacaaaaagcuuuaacagaggagaaugc

SEQ ID NO: 46190 - RNA, 1335 nt, Artificial Sequence
  derived and/or modified sequence opt6 from Glembatumumab_HeavyChain1
caaguccaacuacaagaaucuggacccggccucguaaaaccaucacaaacauuaucuuuaacauguacagucucagguggaucaauaucaucauuuaacuauuacuggucauggauaagacaccauccaggaaaaggacucgaauggauaggcuacaucuacuacucaggaucuacauacaguaacccaucauuaaaaucucgaguaacaauaaguguagacaccucaaaaaaccaauuuucacuaacacuaucaucaguaaccgcagcagauacagcaguauacuacugcgcaagaggauacaacuggaacuacuucgacuacuggggacaaggcaccuuaguaacuguauccucagcauccacaaaaggaccaucugucuucccacuagcccccuguuccagauccacaucagaaucaacagcagcacuaggcugccucguaaaagacuacuuccccgaaccagucacaguaucauggaacucaggagcacucacaucaggaguccauacauuccccgcugucuuacaaucauccggcuuauauucacuaucaucaguaguuaccgucccaucaaguaacuucggaacacaaacauauacaugcaaugucgaucauaaaccuucaaacaccaaaguagauaaaacuguugaaagaaaaugcugcgucgaauguccaccaugcccagcaccuccaguugcaggaccaucagucuuccuauuuccaccaaaacccaaagauacauuaaugauaucgagaacacccgaaguaacaugcguuguaguagacguuucccaugaagacccagaaguacaauuuaacugguacguagacggcguagaaguacacaaugcuaaaacaaaaccccgugaagaacaauuuaacucaacauucagaguaguaucaguucuaacagucguacaccaagacugguuaaauggaaaagaguacaaauguaaaguaucaaacaaaggacuacccgcccccauagaaaaaacaauaucaaaaacaaaaggacaaccaagagaaccacaaguuuauacauuaccaccaucaagagaagaaaugaccaaaaaccaagucucacuaaccuguuuaguaaaaggauucuacccaucagacauagcaguagaaugggaaucaaacggacaacccgaaaacaauuacaaaacaaccccaccaaugcuagacucagauggaucauuuuuuuuauacucaaaacuaacaguagauaaaucaagauggcaacaaggaaacguauucucaugcucaguaaugcacgaagcacuacacaaccacuacacucaaaaaucccuaucucuuucucccggaaaa

SEQ ID NO: 46191 - RNA, 645 nt, Artificial Sequence
  derived and/or modified sequence opt6 from Glembatumumab_LightChain1
gaaauaguaaugacccaaucacccgcaacacuaucaguaucaccaggagaaagagcaacacuaucaugcagagccucacaauccguagacaacaaccuaguaugguaccaacaaaaacccggacaagcaccaagacuacuaauauacggagcaucuacaagagcaacaggaauaccagcaagauuuucaggaucaggaagcggaacagaauucacacuaacaauaucaucacuacaaucagaagacuucgcaguauacuacugccaacaauacaacaacuggccacccuggacauucggacaaggaacaaaaguagaaauaaaaagaacaguagcagcaccaucaguauucauauucccaccaucagacgaacaauuaaaauccggaaccgcaucagucguaugccuacuaaacaacuucuacccacgagaagcaaaaguccaauggaaaguugacaacgcacuacaaucagguaacucacaagaaucaguaacagaacaagacucaaaagacucaacauacucacuaucaucaacacuaacauuauccaaagcagacuaugaaaaacacaaaguauacgcaugcgaaguaacacaccaaggacuaucauccccaguaacuaaaucauuuaacagaggagaaugc

SEQ ID NO: 46192 - RNA, 1332 nt, Artificial Sequence
  derived and/or modified sequence opt6 from Goilixiab_HeavyChain1
gaaguccaauuaguugaauccggaggaggauuagcaaaaccaggaggaucacuacgacucucaugcgcagccucuggauucagauucacauucaauaacuacuaugauuggguacgacaagcucccggacaaggauuagaauggguaucaagaauuagcucauccggagauccaacuugguacgcagauucugucaaaggccgauuuaccauaucuagagaaaacgcaaaaaauacccuauuccuccaaaauucacuacgagcugaagacaccgcaguauauuacugcgcuucacugacaacugguucugauucauggggacaaggaguacuuguaacaguaucuucagcuucaacaaaaggacccucuguauuuccccuagcaccuuccucaaaaucaacuuccggcggcacagcagcacuaggauguuuaguuaaagacuacuuuccagaaccaguaacagucucauggaauucaggagcuuuaacaucuggaguccacacauucccugccguacuacaaucuucaggauuauauucauuaucaaguguuguaacuguacccucaucaucuuuaggaacacaaacauacaucuguaauguaaaccauaaaccuucaaacacaaaaguagacaaaaaaguugaaccaaaaucaugugacaaaacacacacaugcccucccuguccagccccagaauuacuagguggcccaucaguauuccuauucccucccaaaccaaaagacacucuaauaucaagaacaccagaaguaacauguguaguaguagacguaucacacgaagauccagaaguuaaauucaacugguaugucgacggaguagaaguacauaacgcaaaaaccaaaccaagagaagaacaauauaacucaacauacagaguaguuucaguacuaacaguuuuacaccaagauugguuaaacggaaaagaauauaaaugcaaaguuucuaauaaagcauuaccagcaccuauagaaaaaacaauaucaaaagcaaaaggacaaccaagagaaccccaaguauacacccuuccacccucaagagacgaauuaaccaaaaaucaaguaagucuaaccugccuagucaaagguuucuacccaucagacauugcaguagaaugggaaucaaacggucaacccgaaaauaacuauaaaacaacaccaccaguacuagacucagauggauccuucuucuuauauucaaaauuaacaguagauaaaucaagauggcaacaaggaaaugucuucuccuguucaguacacgaagcacuacacaaucacuacacacaaaaaucucuuagcuuaucaccaggcaaa

SEQ ID NO: 46193 - RNA, 639 nt, Artificial Sequence
  derived and/or modified sequence opt6 from Goilixiab_LightChain1
gacauacaaacacaaucaccaucaucauuauccgcaucaguaggagauagagucaccauaaccugccgagcaucacaagacauaagauacuaccuaaacugguaccaacaaaaacccggaaaagcaccaaaacuacuaauauaugucgcaucaucacuccaaucaggagucccaucaagauucucaggauccggaucaggaacagaauucacauuaacaguaagcucauuacaacccgaagacuucgcaacauacuacugccuacaagucuacucaacaccaagaacauucggacaaggaaccaaaguagaaauaaaaagaacagucgcagcaccaucaguauucauauucccaccaucagacgaacaacuaaaaucaggaacagcaucaguaguaugcuuacuaaacaacuucuacccaagagaagccaaaguacaauggaaaguagacaacgcacuacaauccggaaacucacaagaaucaguaacagaacaagacucaaaagacucaaccuacucacuaagcucaaccuuaacacuaucaaaagcagacuacgaaaaacacaaaguauacgcaugcgaagucacacaccaagguuuaucaucaccaguaacaaaaagcuucaacagaggagaaugc

SEQ ID NO: 46194 - RNA, 1338 nt, Artificial Sequence
  derived and/or modified sequence opt6 from Guselkumab_HeavyChain1
gaaguacaacuaguucaaucaggugcugaaguaaaaaaacccggugaaucacuuaaaauuucauguaaaggaucuggauacagcuucucaaacuauuggauaggcuggguaagacaaaugccuggaaaaggcuuagaauggauggguaucaucgacccaucaaauucauacacacgauacucaccuucauuccaaggacaaguaacaauaucagcagacaaaucaauaucaacagcauaucuucaauggucaucacuuaaagcaucagacaccgcaauguacuauugcgcacgaugguacuacaaacccuucgaugucuggggacaaggaacacuaguuaccguauccucagcaucaacaaaagguccaucaguauucccccuagcaccaucaucaaaaucaacaucaggcggaacagcugcucuaggcugccucguaaaagacuauuucccagaaccaguuacagucucauggaauucaggugcauuaacauccggaguucauacauucccagcaguacuacaaucaucaggacuuuacucacuaucuucaguaguaacaguaccauccucaucauuaggaacccaaaccuacauaugcaauguaaaccacaaacccucaaacacaaaaguagacaaaaaaguagaaccaaaaucaugcgauaaaacacacacaugcccaccuuguccugcaccagaacuacuaggcggaccauccguauuccuguuuccuccaaaaccaaaagacacacuaaugauaucuagaaccccagaaguaacauguguaguaguagauguaucccaugaagacccggaagucaaauuuaacugguauguagauggcguagaaguacauaacgcaaaaacuaaaccaagagaagaacaauacaauuccacauauagaguagucagcguccucacuguauuacaccaagacuggcuaaacggaaaagaauacaaaugcaaagucucaaacaaagccuuaccagccccaaucgaaaaaacaauaucaaaagcuaaaggacaaccaagagaaccacaagucuauacuuuaccaccaucucgagacgaacugacaaaaaaucaaguaucccuuacaugucucgucaaaggauucuacccaucugauaucgcaguagaaugggaaucaaacggccaaccagaaaacaacuauaaaacaacuccaccaguccuagacucagauggaucauucuuccuauacucaaaauuaacaguagauaaaagucgauggcaacaaggaaauguauucucaugcucaguuaugcaugaagcacuacacaaccacuacacucaaaaaucacuaucacuaucaccuggu

SEQ ID NO: 46195 - RNA, 651 nt, Artificial Sequence
  derived and/or modified sequence opt6 from Guselkumab_LightChain1
caaucaguacuaacacaaccccccucaguaucaggagcacccggacaacgagucacaauaucaugcacaggaucaucaucuaacauaggaucaggauacgacguacacugguaccaacaacuaccaggaacagcaccaaaacuauuaauauacggaaacagcaaacgaccaucaggaguaccagacagauucucaggaucaaaaucaggaacaagugcaagucuagcaauaacaggacuacaaucagaagacgaagcagacuauuacugugcaucauggaccgacggauuaagccuaguaguauucggaggaggaacaaaacuaacaguccuaggacaaccaaaagcagcacccucaguaacauuauucccaccaucaucagaagaauuacaagcaaacaaagcaacacuaguaugccuaauaucagacuucuacccaggagcaguaaccguagcauggaaagcagacucaucaccaguaaaagcaggaguagaaacaacaacaccaucaaaacaaucaaacaacaaauacgcagcaucaucauaccuaucacuaacaccagaacaauggaaaucacaucgaucauacucaugccaaguaacacacgaaggaucuacaguagaaaaaacaguagcaccaacagaaugcuca

SEQ ID NO: 46196 - RNA, 360 nt, Artificial Sequence
  derived and/or modified sequence opt6 from HuMab-001_HeavyChain_VDJ-Region
caaguacaacuacaacaauggggagcaggacuacuaaaaccaucagaaacacuaucacuaacaugcgcaguauacggcggaucauucucaggauauuacuggaacuggauaagacaaccaccaggaaaaggacuagaauggauaggagaaauaaaccacucaggaucaacaaacuacaacccaucacuaaaaucaagaguaacaauaucaguagacacaucaaaaaaccaauucucacuaaaauuaucaucaguaacagcagccgacacagcaguauacuacugcgcaagaggaaacuacggaucaggauacuacuacuucgaccuauggggaagaggaacacaaguaacaguaucauca

SEQ ID NO: 46197 - RNA, 321 nt, Artificial Sequence
  derived and/or modified sequence opt6 from HuMab-001_LightChain_VJ-Region
gacauacaaaugacacaaucaccaucaucacuaucagcaucaguaggagacagaguaacaauaacaugcagagcaucacaaggaauaucaucauggcuagcaugguaccaacaaaaaccagaaaaagcaccaaaaucacuaauauucgcagcaucaucacuacaaucaggaguaccaucaagauucucaggaucaggaucaggaacagacuucacacuaacaauaucaucauuacaaccagaagacuucgcaacauacuacugccaacaauacauaucauucccaauaacauucggacaaggaacaagacuagaaauaaaa

SEQ ID NO: 46198 - RNA, 366 nt, Artificial Sequence
  derived and/or modified sequence opt6 from HuMab-005_HeavyChain_gamma-Chain_VDJ-Region
gaaguacaauuaguacaaaguggagcagaaguaaaaaaaccaggagaaaguuuaaaaauaaguuguaaagcaaguggauauaguuuucauuuuuauuggauaggauggguaagacaaaugccaggaaaaggauuagaauggaugggaaguauauauccaggagauagugauacaagauauagaccaagcuuucaaggacaaguaacaauaagugcagauaaaaguauaaguacagcauauuuacaauggacaaguuuaaaagcaagugauacagcaauauauuacugugcaagacaaagaggagauuauuauuauuuuuauggaauggauguauggggacaaggaacaacaguaacaguaaguagu

SEQ ID NO: 46199 - RNA, 321 nt, Artificial Sequence
  derived and/or modified sequence opt6 from HuMab-005_LightChain_VJ-Region
gaaauaguacuaacacaaucaccaggaacauuaagcuuaagcccaggagaaagagcaacauuaagcuguagagcaagccaaagcguaagcucaagcuaucuagcaugguaucaacaaaaaccaggacaaguaccaagauuacuaauauacggagcaucaagcagagcaacaggaauaccagauagauuuagcggaagcggaagcggaacagauuucacacuaacaauaucaagauuagaaccagaagauuucgcaguauauuacugucaacaauacggaagcucacuaacauucggaggaggaacaaaaguagaaauaaaa

SEQ ID NO: 46200 - RNA, 357 nt, Artificial Sequence
  derived and/or modified sequence opt6 from HuMab-006_HeavyChain_VDJ-Region
gaaguacaauuauuagaaucaggaggaggauuaguacaaccaggaggaaguuuaagauuaaguugugcagcaucaggauuuacauuuaguaauuaugcacuaauauggguaagacaagcaccaggaaaaggauuagaauggguaaguauaauaagaggaggggcaggaagcacauauuaugcagauagcguaaaaggaagauuuacaauaaguagagauaauaguaaaaauacacuauauuuacaaaugaauaguuuaagagcagaagauacagcaguauauuauugugcaaaagcaagaauauggggaccauuauuugauuauuggggacaaggaacauuaguaacaguaaguagu

SEQ ID NO: 46201 - RNA, 324 nt, Artificial Sequence
  derived and/or modified sequence opt6 from HuMab-006_LightChain_VJ-Region
gaaauaguacuaacacaaucaccagcaacauuaucauuaaguccaggagaaagagcaacauuaagcuguagagcaagccaaagcguaagcucauacuuagcaugguaccaacaaaaaccaggacaagcaccaagacuacuaauauaugacgcaagcaauagagcaacaggaauaccagcaagauucucaggaucaggaucaggaacagacuuuacauuaacaauaagcucacuagaaccagaagacuuugcaguauacuauugccaacaaagaagcaauuggccaccauuaacauuuggcggaggaacaaaaguagaaauaaaa

SEQ ID NO: 46202 - RNA, 360 nt, Artificial Sequence
  derived and/or modified sequence opt6 from HuMab-019_HeavyChain_VDJ-Region
caaguacaacuacaacaauggggagcaggacuacuaaaaccaucagaaacacuaucacuaacaugcgcaguauacggaggauccuucucagacuacuacuggaacuggauaagacaaccaccaggaaaaggauuagaauggauaggagaaauacaccacguaggaucaacaaacuacaacccaucacuaaaaucaagaguaacaauaucaguagacacaucaaaaucacaauucucacuaaaacuaucaucaguaacagcagcagacacagcaguauacuacugcgcaagaggauacuacgacucaggaguauacuacuucgacuacugggcacaaggaacacuaguaacaguaucauca

SEQ ID NO: 46203 - RNA, 360 nt, Artificial Sequence
  derived and/or modified sequence opt6 from HuMab-021_HeavyChain_VDJ-Region
caaguacaacuacaacaauggggagcaggacuacuaaaaccaucagaaacacuaucacuaacaugcgcaguauacggaggaucauucucagacuacuacuggaacuggauaagacaaccaccaggaaaaggacuagaauggauaggagaaauacaccacucaggaucaacaaacuacaacccaucacuaaaaucaagaguaacaauaucaguagacacaucaaaaaaccaauucucacuaaaacuaucaucaguaacagcagcagacacagcaguauacuacugcgcaagaggauacuacgcaucaggaguauacuacuucgacuacuggggacaaggaacacuaguaacaguaucauca

SEQ ID NO: 46204 - RNA, 321 nt, Artificial Sequence
  derived and/or modified sequence opt6 from HuMab-021_LightChain_VJ-Region
gacauacaaaugacacaaucaccaucaucacuaucagcaucaguaggagacagaguaacaauaaccugcagagcaucacaaggcauaucaucauggcuagcaugguaccaacaaaaaccagaaaaagcaccaaaaucacuaauauacgcagcaucaucacuacaaucaggaguaccauccagauucucaggaucaggaucaggaacagacuucacacuaacaauaucaucauuacaaccagaagacuucgcaacauacuacugccaacaauacaacucauacccaauaacauucggacaaggaacaagacuagaaauaaaa

SEQ ID NO: 46205 - RNA, 360 nt, Artificial Sequence
  derived and/or modified sequence opt6 from HuMab-025_HeavyChain_VDJ-Region
caaguacaacuacaacaauggggagcaggacuacuaaaaccaucagaaacacuaucauuaacaugcgcaguauacggaggaucauucucagacuacuacuggaacuggauaagacaaccaccaggaaaaggacucgaauggauaggagaaauacaccacucaggaucaacaaacuacaacccaucacuaaaaucaagaguaacaauaucaguagacacaucaaaaaaccaauucucacuaaaacuaucaucaguaacagcagcagacacagcaguauacuacugcgcaagaggauacuacgacucaggaguauacuacuucgacuacugggcacaaggaacacuaguaacaguaucauca

SEQ ID NO: 46206 - RNA, 321 nt, Artificial Sequence
  derived and/or modified sequence opt6 from HuMab-025_LightChain_VJ-Region
gacauacaaaugacacaaucaccaucaucacuaucagcaucaguaggagacagaguaacaauaacaugcagagcaucacaaggaauaucaagauggcuagcaugguaccaacaaaaaccagaaaaagcaccaaaaucacuaauauacgcagcaucaucacuaagaucaggaguaccaucaagauucucaggaucaggaucaggaacagacuucacacuaacaauaucaucacuacaaccagaagacuucgcaacauacuacugccaacaauacaacucauacccaauaacauucggacaaggaacaagacuagaaauaaaa

SEQ ID NO: 46207 - RNA, 360 nt, Artificial Sequence
  derived and/or modified sequence opt6 from HuMab-027_HeavyChain_VDJ-Region
caaguacaacuacaacaauggggagcaggacuacuaaaaccaucagaaacacuaucacuaacaugcgcaguauacggaggaucauucucagacuacuucuggaacuggauaagacaaccaccaggaaaaggacuagaauggauaggagaaauacaccacucaggaucaacaaacuacaacccaucacuaaaaucaagaguaacaauaucaguagacacaucaaaaaaccaauucucacuaaacuuaucaucaguaacagcagcagacacagcaguauacuacugcgcaagaggacuaauaggaucaggauacuacuacuucgacuacugggaccaaggaacauuaguaacaguaucauca

SEQ ID NO: 46208 - RNA, 360 nt, Artificial Sequence
  derived and/or modified sequence opt6 from HuMab-032_HeavyChain_VDJ-Region
caaguacaauuacaacaauggggagcaggacuacuaaaaccaucagaaacacuaucacuaacaugcgcaguauacggaggaucauucucaggauacuacuggucauggauaagacaaccaccaggaaaaggacuagaauggauaggagaaauaaaccacucaggagacacaaacuacaacccaucacuaacaucaagaguaacaauaucaguagacacaucaaaaaaccaauucucacuaaaacuaucaucaguaacagcagcagacacagcaguauacuacugcgcaagauuauucuacggaucaggaauauacuacuucgacuacuggggacaaggaacacuaguaacaguaagcuca

SEQ ID NO: 46209 - RNA, 321 nt, Artificial Sequence
  derived and/or modified sequence opt6 from HuMab-032_LightChain_VJ-Region
gacauacaaaugacacaaucaccaucaucacuaucagcaucaguaggagacagaguaacaauaacaugcagagcaucacaaggaauaucaucauggcuagcaugguaccaacaaaaaccagaaaaagcaccaaaaucacuaauauacgcaacauucagacuacaaucaggaguaccaucaagauucucaggaucaggaucaggaacagacuucacacuaacaauaucaucacuacaaccagaagacuucgcaacauacuacugccaacaauacaacucauucccaccaacauucggacaaggaacaaaaguagaaauaaaa

SEQ ID NO: 46210 - RNA, 363 nt, Artificial Sequence
  derived and/or modified sequence opt6 from HuMab-033_HeavyChain_VDJ-Region
caaguacaauuaguagaaaguggaggaggaguaguacaaacaggaagaaguuuaagauuaaguugugcagcaaguggauuuacauuuaguagucaugcaaugcauuggguaagacaagcaccaggaaaaggauuagaauggguagcagcaauaaguuaugauggaaguaauaaauauuaugcagauaguguaaaaggaagauuuacaauaaguagagauaauaguaaaaauacauuauauuuacaaaugaauaguuuaagagcagaagauacagcaguauauuauugugcgagaggagauuauauaaguaguaguggaguauuugauuauuggggacaaggaacauuaguaacaguaaguagu

SEQ ID NO: 46211 - RNA, 360 nt, Artificial Sequence
  derived and/or modified sequence opt6 from HuMab-035_HeavyChain_VDJ-Region
caaguacaacuacaacaauggggagcaggacuacuaaaaccaucagaaacacuaucacuaacaugcgcaauauacggaggaucauucucaggauauuacuggucauggauaagacaaccaccaggaaaaggacuagaauggauaggagaaauaaaccacucaggagacacaaacuacaacccaucacuaacaucaagaguaacaauaucaguagacacaucaaaaaaccaauucucacuaaaacuaucaucaguaacagcagcagacacagcaguauacuacugcgcaagacuauucuacggaucaggaauauacuacuucgacuacuggggacaaggaacacuaguaacaguaucauca

SEQ ID NO: 46212 - RNA, 360 nt, Artificial Sequence
  derived and/or modified sequence opt6 from HuMab-036_HeavyChain_VDJ-Region
caaguacaacuacaacaauggggagcaggacuacuaaaaccaagcgaaacacuaucacuaacaugcgcaguauacggaggaucauucucagacuacuacuggucauggauaagacaaccaccaggaaaaggacuagaauggauaggagaaauaaaccacucaggaucaacaaacuacaacccaucacuaaaaucaagaguaacaauaucaguagacacaucaaaaaaccaauucucacuaaaacuaagcucaguaacagcagcagacacagcaguauacuacugcgcaagacuauacuacggaucaggaacauacuacuucgacuacuggggacaaggaacacuaguaacaguaucauca

SEQ ID NO: 46213 - RNA, 321 nt, Artificial Sequence
  derived and/or modified sequence opt6 from HuMab-036_LightChain_VJ-Region
gacauacaaaugacacaaucaccaucaucacuaucagcaucaguaggagacagaguaacaauaacaugcagagcaucacaaggaauaucaucauggcuaacaugguaccaacaaaaaccagaaaaagccccaaaaucacuaauauacgcagcaucaagacuacaaucaggaguaccaucaagauucucaggaucaggaucaggaacagacuucacacuaacaauaucaucacuacaaccagaagacuucgcaacauacuacugccaacaauacaacucauucccaccaacauucggacaaggaacaaaaguagaaauaaaa

SEQ ID NO: 46214 - RNA, 366 nt, Artificial Sequence
  derived and/or modified sequence opt6 from HuMab-041_HeavyChain_VDJ-Region
gaaguacaauuaguacaaagcggagcagaaguaaaaaaaccaggagaaagcuuaaaaauaagcuguaaaggaagcggauacucauucacaagcuauuggauaggauggguaagacaaaugccaggaaaaggacuagaauggaugggaucaauauauccaggagacucacacacaagauauagaccaagcuuucaaggacaaguaacaauaagcgcagacaaaagcauaagcacagcauaucuacaauggucaagcuuaaaagcaagcgauacagcaauguauuacugugcaagacaaaaaggagauuucuauuacuuuuucggacuagauguauggggacaaggaacagcaauaacaguaagcuca

SEQ ID NO: 46215 - RNA, 366 nt, Artificial Sequence
  derived and/or modified sequence opt6 from HuMab-044_HeavyChain_VDJ-Region
gaaguacaauuaguacaaaguggagcagaaguaaaaaaaccaggagaaagcuuaaaaauaaguuguaaaggaaguggauauagauuuaguagcuauuggauaggauggguaagacaaaugccaggaaaaggauuagaauggaugggaaguauauuuccaggagauagugauacaagauauaguccaaguuuucaaggacaaguaacaauaagugcagauaaaaguauaacaacagcauauuuacaauggaguaguuuaaaagcaagugauacagcaauguauuauugugcaagacaagcaggagauuauuauuauuauaauggaauggauguauggggacaaggaacaacaguaacaguaaguagu

SEQ ID NO: 46216 - RNA, 357 nt, Artificial Sequence
  derived and/or modified sequence opt6 from HuMab-049_HeavyChain_VDJ-Region
gaaguacaauuauuagaaaguggaggagauuuaguacaaccaggaggaaguuuaagauuaaguugugcagcaaguggauuuacauuuaguaguuaugcaaugaguuggguaagacaagcaccaggaaaaggauuagaauggguaagugcaauaaguggaagaggaggaacaacauauuaugcagauaguguaaaaggaagauuuacaauaaguagagauaauaguaaaaguacauuauguuuacaaaugaauaguuuaagagcagaagauacagcaguauauuauugugcaaaagcaagagcaaauugggauuauuucgauuauuggggucaaggaacauuaguaacaguaagcagu

SEQ ID NO: 46217 - RNA, 321 nt, Artificial Sequence
  derived and/or modified sequence opt6 from HuMab-049_LightChain_VJ-Region
gacauacaaaugacacaaucaccaucaucaguauccgcaucaguaggagacagaguaacaauaacaugcagagcaucacaaggaauaucauccuggcuagcaugguaccaacacaaaccaggaaaagcaccaaaacuacuaauauacgcagcaucaauacuacaaucaggaguaccaucacgauucucaggaucaggaucaggaacagacuucacacuaacaauaucaucacuaagaccagaagacuucgcaacauacuacugccaacaagcaaacucauucccaauaacauucggacaaggaacaagacuagaaauaaaa

SEQ ID NO: 46218 - RNA, 357 nt, Artificial Sequence
  derived and/or modified sequence opt6 from HuMab-050_HeavyChain_VDJ-Region
gaaguacaauuauuagaaaguggaggaggauuaguacaaccaggaggaaguuuaagauuaaguugugcagcaaguggauuuacauuuaguaguuaugcaaugaauuggguaagacaagcaccaggaaaaggauuagaauggguaagugcaauaaguggaagaggaggaacaacauauuaugcagauaguguaaaaggaagauuuacaauaaguagagauaauagcaaaaauacacuauauuuacaaaugaguaguuuaagagcagaagauacagcaguauauuauugugcaaaagcaagagcaaauugggauuauuuugauuauuggggacaaggaacauuaguaacaguaaguagu

SEQ ID NO: 46219 - RNA, 321 nt, Artificial Sequence
  derived and/or modified sequence opt6 from HuMab-050_LightChain_VJ-Region
gacauacaaaugacacaaucaccaucaucaguaucagcaucaguaggagacagaguaacaauaacaugcagagcaucacaaggaauaucaucauggcuagcaugguaccaacacaaaccaggaaaagcaccaaaacuacuaauauacgcagcaucaauauuacaaucaggaguaccaucaagauucucaggaucaggaucaggaacagacuucacauuaacaauaucaucacuacaaccagaagacuucgcaacauacuacugccaacaagcaaacucauucccaauaacauucggacaaggaacaagacuagaaauaaaa

SEQ ID NO: 46220 - RNA, 360 nt, Artificial Sequence
  derived and/or modified sequence opt6 from HuMab-054_HeavyChain_VDJ-Region
caaguacaacuacaacaauggggagcaggacuacuaaaaccaucagaaacacuaucauuaacaugcgcaguauacggaggaucauucucaggauacuacuggucauggauaagacaaccaccaggaaaaggacuagaauggauaggagaaauacaccacucaggaucaacaaacuacaacccaucacuaaaaucaagaguaacaauauccguagacacaucaaaaaaccaauucucacuaaaacuaucaucaguaacagcagcagacacagcaguauacuacugcgcaagacuaugguacggaucaggaucauacuacuucgacuacuggggacaaggaacacuaguaacaguaucauca

SEQ ID NO: 46221 - RNA, 321 nt, Artificial Sequence
  derived and/or modified sequence opt6 from HuMab-054_LightChain_VJ-Region
gacauacaaaugacacaaucaccaucaucacuaucagcaucaguaggagacagaguaacaauaacaugcagagcaucacaaggaauaucaucauggcuagcaugguaccaacaaaaaccagaaaaagcaccaaaaucacuaauauacgcagcaucaucacuacaaucaggaguaccaucaagauucucaggaucaggaucaggaacagacuucacacuaacaauaucaucacuacaaccagaagacuucgcaacauacuacugccaacaauacaacucauucccaccaacauucggaggaggaacaaaaguagaaauaaaa

SEQ ID NO: 46222 - RNA, 357 nt, Artificial Sequence
  derived and/or modified sequence opt6 from HuMab-055_HeavyChain_VDJ-Region
gaaguacaauuauuagaaucaggaggaggauuaguacaaccaggaggaucauuaagauuaucaugugcagcaucaggauuuacauuuaguucauaugcaaugaauuggguaagacaagcaccaggaaaaggauuagaauggguaucagcaauaagcggaagaggaggaacaacauauuaugcagauucaguaaaaggaagauuuacaauaucaagagauaauaguaaaucaacauuauguuuacaaaugaauucauuaagagcagaagauacagcaguauauuauugugcaaaagcaagagcaaauugggauuauuuugauuauuggggacaaggaacauuaguaacaguaaguuca

SEQ ID NO: 46223 - RNA, 366 nt, Artificial Sequence
  derived and/or modified sequence opt6 from HuMab-059_HeavyChain_VDJ-Region
caaguacaauuaguacaaagcggagcagaaguaaaaaaaccaggagcaagcguaagaguaccauguaaagcaagcggauacacauucacaagauauggaauaagcuggguaagacaagcaccaggacaaggacuagaauggaugggauggauaucagcauauaacggaaaaacauacuaugcacaaaaauuacaaggaagaguaacaaugacaacagacacaagcacaagcacagcauauauggaacuaagaagcuuaagaucagacgauacagcaguauauuacugugcaagaagcccacuauuaugguuugaagaacuauauuucgauuacuggggacaaggaacacuaguaacaguaagcuca

SEQ ID NO: 46224 - RNA, 324 nt, Artificial Sequence
  derived and/or modified sequence opt6 from HuMab-059_LightChain_VJ-Region
gaaauaguacuaacacaaucaccaggaacacuaucauuaucaccaggagaaagagcaacacuaucaugccgagcaucacaaucaguaucaucaacauaccuagcaugguaccaacaaaaaccaggacaagcaccaagacuauuaauauacggagcaucaucaagagcaacaggaauaccagacagauucucaggaucaggaucaggaacagacuucacacuaacaauaucaagacuagaaccagaagacuucgcaguauacuacugccaacaauacggaacaucacuauucacauucggaccaggaacaaaaguagacauaaaa

SEQ ID NO: 46225 - RNA, 366 nt, Artificial Sequence
  derived and/or modified sequence opt6 from HuMab-060_HeavyChain_VDJ-Region
gaaguacaauuaguacaaaguggagcagaaguaaaaaaaccaggagaaaguuuaaaaauaaguuguaaaggaaguggauauagauuuacaaguuauuggauaggauggguaagacaaaugccaggaaaaggauuagaauggaugggaucaauauauccaggagauaguuauacaagaaauaguccaaguuuucaaggacaaguaacaauaagugcagauaaaaguauagcaacagcauauuuacaauggaauaguuuaaaagcaagugauacagcaauguauuauugugcaagacaugcaggagauuuuuauuauuuugauggauuagauguauggggacaaggaacaacaguaacaguaaguagu

SEQ ID NO: 46226 - RNA, 327 nt, Artificial Sequence
  derived and/or modified sequence opt6 from HuMab-060_LightChain_VJ-Region
gaaauaguacuaacacaaucaccaggaacacuaucacuaucaccaggagaaagagcaacacuaucaugcagagcaucacaaucaguaucaucaucauaccuagccugguaccaacaaaaaccaggacaagcaccaagacuacuaauauacggagcaucaucaagagcaacaggaauaccagacagauucucaggaucaggaucaggaacagacuucacacuaacaauaucaagacuagaaccagaagacuucgcaguauacuacugccaacaauacggaucaucaccaccaauaacauucggacaaggaacaagacuagaaauaaaa

SEQ ID NO: 46227 - RNA, 366 nt, Artificial Sequence
  derived and/or modified sequence opt6 from HuMab-067_HeavyChain_VDJ-Region
gaaguacaauuaguacaaagcggagcagaaguaaaaaaaccaggagaaagcuuaaaaauaaguuguaaaggaagcggauauucauucacaagcuauuggauaggauggguaagacaaaugccaggaaaaggauuagaauggaugggaauaauauauccaggagacucagacacaagauauagcccaaguuuucaaggacaaguaacaauaagcguagacaaaagcauaagcacagcauauuuacaauggucaaguuuaaaagcaagcgauacagcaauguauuacugugcaagacaaaaaggagauuacuauuaccauuacggacuagauguauggggacaaggaacaacaguaacaguaaguuca

SEQ ID NO: 46228 - RNA, 366 nt, Artificial Sequence
  derived and/or modified sequence opt6 from HuMab-072_HeavyChain_VDJ-Region
gaaguacaauuaguacaaagcggagcagaaguaaaaaaaccaggagaaagcuuaaaaauaagcuguaaaggaagcggauacucauucacaaguuauuggauaggauggguaagacaaaugccaggaaaaggacuagaauggaugggaauaauauauccaggagacagugacacaagauauagcccgagcuuucaaggacaaguaacaauaagcgcagacaaaagcauaaguacagcauauuuacaauggucaagcuuaaaagcaagugauacagcaauguauuacugugcaagacaaaaaggagauuacuauuacuuuaacggacuagauguauggggacaaggaacaacaguaacaguaagcuca

SEQ ID NO: 46229 - RNA, 327 nt, Artificial Sequence
  derived and/or modified sequence opt6 from HuMab-072_LightChain_VJ-Region
gaaauaguauuaacacaaucaccaggaacauuaagccuaagcccaggagaaagagcaacauuaagcuguagagcaagccaaucaguaagcucaagcuaucuagcaugguaucaacaaaaaccaggacaagcaccaagauuacuaauauacggagcaucaagcagagcaacaggaauaccagauagauuuagcggaagcggaagcggaacagauuucacacuaacaauaucaagauuagaaccagaagauuucgcaguauauuacugucaacaauacggaaguucaccaagacuaacauucggaggaggaacaaaaguagaaauaaaa

SEQ ID NO: 46230 - RNA, 363 nt, Artificial Sequence
  derived and/or modified sequence opt6 from HuMab-084_HeavyChain_VDJ-Region
caaguacaacuaguacaaucaggagcagaaguaaaaaaaccaggaagcucaguaaaaguaucaugcaaagcaucaggaggaacauuuagaacauacgcaauaaauuggguaagacaagcaccaggacaaggacuagaauggaugggaagaauaaacacaguauuaggaauaguaaaucacgcacaaaaauuccaaggaagaguaacaauaacagcagauaaaucaacaaauacagcauacauggaauuaaacucacuaagaagcgaagacacagcaguauacuauugcgcaagagaaaaaggaguagauuacuauuacggaauagagguauggggacaaggaacaacaguaacaguaagcuca

SEQ ID NO: 46231 - RNA, 321 nt, Artificial Sequence
  derived and/or modified sequence opt6 from HuMab-084_LightChain_VJ-Region
gacauacaaaugacacaaucaccaucaucaguaucagcaucaguaggagacagaguaacaauaacaugcagagcaucacaaggaauaucaucauggcuagcaugguaccaacacaaaccaggaaaagcaccaaaauuacuaauauacguagcaucaacacuacaaucaggaguaccaucaagauucucaggaucaggaucaggaacagacuucacacuaacaauaucaucacuacaaccagaagacuucgcaacauacuacugccaacaagcaaacucauucccacuaacauucggaggaggaacaaaaguagaaauaaaa

SEQ ID NO: 46232 - RNA, 360 nt, Artificial Sequence
  derived and/or modified sequence opt6 from HuMab-091_HeavyChain_VDJ-Region
caaguacaacuacaacaauggggagcaggauuacuaaaaccaucagaaacacuaucacuaacaugcgcaguaucaggaggaucauucucaggauacuacuggacauggauaagacaaccaccaggaaaaggacuagaauggauaggagaaauauaccacucaggagacacaaacuacaacccaucacuaaaaucaagaguaacaauaucaguagacacaucaaaaaaccaauucucacuaaaacuauacucaguaacagcagcagacacagcaguauacuacugcgcaagacuauacuucggaucaggaauauacuaccuagacuacuggggacaaggcacacuaguaacaguaucauca

SEQ ID NO: 46233 - RNA, 321 nt, Artificial Sequence
  derived and/or modified sequence opt6 from HuMab-091_LightChain_VJ-Region
gacauacaaaugacacaaucaccaucaucacuaucagcaucaguaggagacagaguaacaauaacaugcagagcaucacaaggaauaucaucauggcuaguaugguaccaacaaaaaccagaaaaagcaccaaaaucacuaauauacgcagcaucaucacuacaaucaggaguaccaucaagauucucaggaucaggaucaggaacagacuucacauuaacaauaucaucacuacaaccagaagacuucgcaacauacuacugccaacaauacaacucauucccaccaacauucggacaaggaacaaaaguagaaauaaaa

SEQ ID NO: 46234 - RNA, 366 nt, Artificial Sequence
  derived and/or modified sequence opt6 from HuMab-093_HeavyChain_VDJ-Region
gaaguacaauuaguacaaagcggagcagaaguaaaaaaaccaggagaaagcuuaaaaauaaguuguaaaggaagcggauacucauucacaaguuauuggauaggcuggguaagacaaaugccaggaaaaggacuagaauggaugggaagaauauauccaggagacucagauacaagauauagcccaagcuuucaaggacaaguaacaauaagcgcagacaaaagcauaacaacagcauaucuacaauggucaagcuuaagagcaagcgauacagcaauguauuacugugcaagacaaagaggagauuacuauuacuuuuucggacuagauauauggggacaaggaacaacaguaacaguaaguuua

SEQ ID NO: 46235 - RNA, 372 nt, Artificial Sequence
  derived and/or modified sequence opt6 from HuMab-098_HeavyChain_VDJ-Region
gaaguacaauuacuagaaagcggaggaggacuaguacaaccaggaggaaguuuaagauuaagcugugcagcaagcggauucacauucucaaacuauggaaugagcuggguaagacaagcaccaggaaaaggacuagaauggguaagcgcaauaucaggaucagcauauagcacauacuaugcagauagcgugaaaggaagauuuacaauaaguagagacaauagcaaaaacacacuauggcuacaaaugaauagcuuaagagcagaagauacagcaguauauuacugugcaaaagcacauuaccauggaucaggaucauacuauacauuauucgauuacuggggacaaggaacacuaguaacaguaagcuca

SEQ ID NO: 46236 - RNA, 321 nt, Artificial Sequence
  derived and/or modified sequence opt6 from HuMab-098_LightChain_VJ-Region
gacauacaaaugacacaaucaccaucaucacuaucagcaucaguaggagacagaguaacaauaacaugcagagcaucacaaggaauaucaucauggcuagcaugguaccaacaaaaaccagaaaaagcaccaaaaucacuaauauacgcagcaucaucacuacaaucaggaguaccaucaagauucucaggaucaggaucaggaacagacuucacacuaacaauaucaucacuacaaccagaagacuucgcaacauacuacugccaacaauacaacucauacccauacacauucggacaaggaacaaaacuagaaauaaaa

SEQ ID NO: 46237 - RNA, 372 nt, Artificial Sequence
  derived and/or modified sequence opt6 from HuMab-100_HeavyChain_VDJ-Region
gaaguacaauuacuagaaaguggaggaggacuaguacaaccaggaggaaguuuaagauuaagcugugcagcaagcggauucacauucaauaacuauggaaugaacuggguaagacaagcaccaggaaaaggacuagaauggguaagugcaauaucaggaacaggauauagcacauacuaugcagauaguguaaaaggaagauuuacaauaagcagagacaauagcaaaaacacacuauaucuacaaaugaauagcuuaagagcagaagauacagcaguauauuacugugcaaaagcacauuacuuuggaucaggaucauacuauacauuauucgauuacuggggacaaggaacacuaguaacaguaagcuca

SEQ ID NO: 46238 - RNA, 372 nt, Artificial Sequence
  derived and/or modified sequence opt6 from HuMab-106_HeavyChain_VDJ-Region
gaaguacaauugguacaaaguggagcagaaguaaaaaaaccaggagaaaguuuaaaaauaagcuguaaaggaagcggauacaguuucacaagauauuggauaggauggguaagacaaaugccaggaaaaggacuagaauggaugggaauaauauauccaggagacucagacacaagauauaguccaagcuuucaaggacaaguaacaauaagugcagacaaaagcauaagcacagcauaucuacaauggucaaguuuaaaagcaagugauacagcaauguauuacugugcaagacuaacaggagauagaggauucgauuacuauaguggaauggauguauggggacaaggaacaacaguaacaguaaguuca

SEQ ID NO: 46239 - RNA, 321 nt, Artificial Sequence
  derived and/or modified sequence opt6 from HuMab-106_LightChain_VJ-Region
gaaauaguacuaacacaaucaccaggaacauuaaguuuaagcccaggagaaagagcaacauuaucauguagagcaagucaaagcguaagcucaagcuaucuagcaugguaucaacaaaaaccaggacaagcaccaagauuacuaauauacggagcaucaagcagagcaacaggaauaccagauagauuuagcggaagcggaagcggaacagauuucacacuaacaauaucaagauuagaaccagaagauuucgcaguauauuacugucaacaauacggaagcucauucacauucggaccaggaacaaaaguagauauaaaa

SEQ ID NO: 46240 - RNA, 351 nt, Artificial Sequence
  derived and/or modified sequence opt6 from HuMab_10F8_HeavyChain_V-Region
caaguacaauuaguagaaaguggaggaggaguaguacaaccaggaagaagcuuaagauuaaguuguacagcaaguggauuuacauuuagucauuauggaauguauuggguaagacaagcaccaggaaaaggauuagaauggguagcaguaauaugguaugauggaaguuaugaauauaaugaagauaguguaaaaggaagauuuacaauaaguagagauaauaguaaaaauacauuauauuuacaaaugaauaguuuaagagcagaagauacagcaguauauuauugugcaagagauagaguaggauuauuugauuauuggggacaaggaacauuaguaacaguaaguagu

SEQ ID NO: 46241 - RNA, 408 nt, Artificial Sequence
  derived and/or modified sequence opt6 from HuMab_10F8_HeavyChain_V-Region_Precursor
auggaauuuggauuaaguuggguauuuuuaguagcauuauuaagaggaguacaaugucaaguacaauuaguagaaagcggaggaggaguaguacaaccaggaagaaguuuaagacuaaguuguacagcaaguggauuuacauuuagucauuauggaauguauuggguaagacaagcaccaggaaaaggauuagaauggguagcaguaauaugguaugauggaaguuaugaauauaaugcagauaguguaaaaggaagauuuacaauaaguagagauaauaguaaaaauacauuauaucuacaaaugaauaguuuaagagcagaagauacagcaguauauuauugugcaagggauagaguaggauuauuugauuauuggggacaaggaacauuaguaacaguaaguagc

SEQ ID NO: 46242 - RNA, 321 nt, Artificial Sequence
  derived and/or modified sequence opt6 from HuMab_10F8_LightChain_V-Region
gaaauaguacuaacacaaucaccaggaacacuaucacuaucaccaggagaaagagcaacacuaucaugcagagcaucacaaucaauaucaucaucauaccuagcaugguaucaacaaaaaccaggacaagcaccaagacuacuaauauacggaccaucaucaagagcaacaggaauaccagacagauucagcggaucaggaucaggaacagacuucacacuaacaauaucaagacuagaaccagaagacuucgcaguauacuacugucaacaauacgcaggaucacuaacauucggacccggaacaaaaguagacauaaaa

SEQ ID NO: 46243 - RNA, 381 nt, Artificial Sequence
  derived and/or modified sequence opt6 from HuMab_10F8_LightChain_V-Region_Precursor
auggaaacacccgcacaauuacuauuucuacuacuacuauggcuaccagacacaacaggagaaauaguacuaacacaaucaccaggaacacuaucacuaucaccaggagaaagagcaacauuaucaugcagagcaucacaaucaauaucaucaucauaccuagcaugguaucaacaaaaaccaggacaagcaccaagacuacuaauauacggaccaucaucaagagcaacaggaauaccagacagauucagcggaucaggaucaggaacagacuucacacuaacaauaucaagacuagaaccagaagacuucgcaguauauuacugccaacaauacgcaggaucacuaacauucggaccaggaacaaaaguagacauaaaa

SEQ ID NO: 46244 - RNA, 357 nt, Artificial Sequence
  derived and/or modified sequence opt6 from HuMab-111_HeavyChain_VDJ-Region
caaguacaauuaguacaaaguggagcagaaguaaaaaaaccaggaagcaguguaaaaguaaguuguaaagcaaguggaggaacauuuaguaguuauggaauaaguuggguaagacaagcaccaggaccaggauuagaauggaugggaagaauaauaccaauauuaggaauagcaaauuaugcacaaaaauuucaaggaagaguaacaauaacagcagauaaaaguacaaauacagcauauauggaacuaaguaguuuaagaagugaagauacagcaguauauuauugugcaagagaucaagaauauaguaguaauugguauuauuggggacaaggaacauuaguaacaguaaguagu

SEQ ID NO: 46245 - RNA, 321 nt, Artificial Sequence
  derived and/or modified sequence opt6 from HuMab-111_LightChain_VJ-Region
gaaauaguacuaacacaaucaccaggaacauuaagcuuaaguccaggagaaagagcaacauuaagcuguagagcaagccaaagcguaagaucaagcuaucuagcaugguaucaacaaaaaccaggacaagcaccaagacuacuaauauacggagcaucaagcagagcaacaggaauaccagauagauuuagcggaagcggaagcggaacagauuucacacuaacaauaucaagauuagaaccagaagauuucgcaguauauuacugucaauuauacggaagcucaccaacauucggaccaggaacaaaaguagauauaaaa

SEQ ID NO: 46246 - RNA, 363 nt, Artificial Sequence
  derived and/or modified sequence opt6 from HuMab-123_HeavyChain_VDJ-Region
caaguacaauuaguacaaucaggagcagaaguaaaaaaaccaggagcaucaguaaaaguaucaugcaaagcagcaggauauacauuuacaaauuacggaauaucauggguaagacaagcaccaggacaagcauuagaauggaugggauggauaacaacauacucaagcaauacaauauacgcacaaaaacuacaaggaagaguaacaaugacaacagauacaucaacaucaacagcauacauggaauuaagaucacuaagaagcgaugacacagcaguauacuauugcgcaagagauagaguaguaguaagaccagacuauuucgauuacuggggacaaggaacacuaguaacaguaagcuca

SEQ ID NO: 46247 - RNA, 321 nt, Artificial Sequence
  derived and/or modified sequence opt6 from HuMab-123_LightChain_VJ-Region
gaaauaguacuaacacaaucaccagcaacacuaucacuaagcccaggagaaagagcaacacuaucaugcagagcaucacaaucaguaucaucauaccuagcaugguaccaacaaaaaccaggacaagcaccaagacuacuaauauacgacacaucaaaccgagcaacaggaauaccagcaagauucucaggaucaggaucaggaacagacuucacacuaacaauaucaucacuagaaccagaagacuucgcaguauacuacugccaacaaagaucacacuggccaagaacauucggacaaggaacaaaaguagaaauaaaa

SEQ ID NO: 46248 - RNA, 363 nt, Artificial Sequence
  derived and/or modified sequence opt6 from HuMab-124_HeavyChain_VDJ-Region
caaguacaacuaguacaaucaggagcagaaguaaaaaaaccaggagcaucaguaaaaguaucaugcaaagcagcaggauauacauuuacaaauuacggaauaucauggguaagacaagcaccaggacaaggacuagaauggaugggauggauaauaacauacaauggaaauacaauauacgcacaaagauuccaagacagaguaacaaugacaacagauacaucaacaucaacagcauacauggaauuaagaucacuaagaagcgaugacacagcaguauacuauugcgcaagagacagaauaauaguaagaccagacuauuucgauuacuggggacaaggaacacuaguaacaguaagcuca

SEQ ID NO: 46249 - RNA, 372 nt, Artificial Sequence
  derived and/or modified sequence opt6 from HuMab-125_HeavyChain_VDJ-Region
gaaguacaauuacuagaaagcggaggaggacuaguacaaccaggaggaagcuuaagacuaagcugugcagcaagcggauucacauucacagacuaugcaaugaacuggguaagacaagcaccaggaaaaggacuagaauggguaagcacaauaucaggaucaggauaugcaacauacuaugcagauagcguaaaaggaagauuuacaauaagcagagacaauucaaaaacaacauuauaucuacaaaugaauagcuuaagagcagaagauacagcaguauauuacugugcaaaaggacauacauuaggaucaggaucauacuauacauuauucgauuacuggggacaaggaacacuagugacaguaagcuca

SEQ ID NO: 46250 - RNA, 321 nt, Artificial Sequence
  derived and/or modified sequence opt6 from HuMab-125_LightChain_VJ-Region
gacauacaaaugacacaaucaccaucaucacuaucagcaucaguaggagacagaguaacaauaacaugcagagcaucacaaggaauaaacucauggcuagcaugguaccaacaaaaaccagaaaaagcaccaaaaucacuaauauacgcagcaucaucacuacaaucaggaguaccaucaagauucucaggaucaggaucaggaacagacuucacacuaacaauaucaucacuacaaccagaagacuucgcaacauacuacugccaacaauacaacucauacccauacacauucggacaaggaacaaaacuagaaauaaaa

SEQ ID NO: 46251 - RNA, 369 nt, Artificial Sequence
  derived and/or modified sequence opt6 from HuMab-127_HeavyChain_VDJ-Region
gaaguacaauuaguacaaaguggagcagaaguaaaaaaaccaggagaaagcuuaacaauaaguuguaaaggaaguggauauaguuuuaguauauauuggauaggauggguaagacaaaugccaggaaaaggauuagaauggaugggaauaauauuuccaggagauagugauauaagauauaguccaaguuuucaaggacaaguaacaauaagugcagauaaaagcauaaguacagcauauuuacaauggaguaguuuaaaagcaagugauacagcaauguauuauugugcaagacaaccaggagauuggaguccaagacauugguauuuugauuuauggggaagaggaacauuaguaacaguaaguagu

SEQ ID NO: 46252 - RNA, 321 nt, Artificial Sequence
  derived and/or modified sequence opt6 from HuMab-127_LightChain_VJ-Region
guaauauggaugacacaaucaccaucacuacuaucagcaucaacaggagacagaguaacaauaucaugcagaaugucacaaggaauaucaucauaccuagcaugguaccaacaaaaaccaggaaaagcaccagaacuacuaauauacgcagcaucaacacuacaaucaggaguaccaucaagauucucaggaucaggaucaggaacagacuucacacuaacaauaucauaccuacaaucagaagacuucgcaacauacuacugccaacaauacuacucauucccacuaacauucggaggaggaacaaaaguagaaauaaaa

SEQ ID NO: 46253 - RNA, 357 nt, Artificial Sequence
  derived and/or modified sequence opt6 from HuMab-129_HeavyChain_VDJ-Region
caaguacaauuaguagaaaguggaggaggaguaguacaaccaggaagaaguuuaagacuaaguugugcagcaaguggauuuacauuuaguacauuugcaauacauuggguaagacaagcaccaggaaaaggauuagaauggguagcaguaauaaguuaugauggaggacauaaauuuuaugcagauaguguaaaaggaagauuuacaauaagcagagauaauaguaaaaauacauuauauuuacaaaugaauaguuuaagagcagaagauacagcaauguauuauugugcaagaggauuaggaguauggggggcauuugauuauuggggacaaggaacauuaguaacaguaaguagu

SEQ ID NO: 46254 - RNA, 318 nt, Artificial Sequence
  derived and/or modified sequence opt6 from HuMab-129_LightChain_VJ-Region
gaaauaguauuaacacaaucaccagcaacauuaagcuuaagcccaggagaaagagcaacauuaagcuguagagcaagccaaaguguaagcucauacuuagcaugguaccaacaaaaaccaggacaagcaccaagauuauuaauauaugacgcaagcaauagagcaacaggaauaccagcaagauucucaggaucaggaucaggaacagacuuuacauuaacaauaagcucacuagaaccagaagacuuugcaguauacuauugccaacaaagaagcaauugguggacauuuggccaaggaacaaaaguagaaauaaaa

SEQ ID NO: 46255 - RNA, 375 nt, Artificial Sequence
  derived and/or modified sequence opt6 from HuMab-132_HeavyChain_VDJ-Region
caaguacaauuaguacaaucaggagcagaaguaaaaaaaccaggagcaucaguaaaaguaucaugcaaagcaucaggauauacauuuacaucauacggaauaucauggguaagacaagcaccaggacaaggacuagaauggaugggauggauaagcgcauacaauggaaauagcaauuacguacaaaaauuccaaggaagaguaacaaugacaacagauacaacaacaucaacagcauacauggaauuaagaucacuaacaagcgaugacacagcaguauacuauugcgcaagagaauacucauacgauagcggaacauauuucuauuacggaauggauguauggggacaaggaacaacaguaacaguaagcuca

SEQ ID NO: 46256 - RNA, 324 nt, Artificial Sequence
  derived and/or modified sequence opt6 from HuMab-132_LightChain_VJ-Region
gaaauaguacuaacacaaucaccagcaacacuaucacuaucaccaggagaaagagcaacacuaucaugcagagcaucacaaucaguaucaucauaccuagcaugguaccaacaaaaaccaggacaagcaccaagacuacuaauauacgacgcaucaaacagagcaacaggaauaccagcaagauucucaggaucaggaucaggaacagacuucacccuaacaauauccucacuagaaccagaagacuucgcaguauacuacugccaacaaagaucaaacuggccaauguacacauucggacaaggaacaaaacuagaaauaaaa

SEQ ID NO: 46257 - RNA, 360 nt, Artificial Sequence
  derived and/or modified sequence opt6 from HuMab-143_HeavyChain_VDJ-Region
caaguacaauuacaacaauggggagcaggauuauuaaaaccaagcgaaacauuaagcuuaacaugugcaguauacggaggaucauucucaggauauuacuggaacuggauaagacaaccaccaggaaaaggacuagaauggauaggagaaauacaucacucaggaucagcaaauuacaauccaucacuaaugagcagaguaacaauaucaguagauacaucaaaaaaucaauuuagcuuacaauuaagcucaguaacagcagcagacacagcaguauacuauugcgcaagaggauacuauggaucaggauauuacuauuucgauuacuggggacaaggaacacuaguaacaguaaguuca

SEQ ID NO: 46258 - RNA, 321 nt, Artificial Sequence
  derived and/or modified sequence opt6 from HuMab-143_LightChain_VJ-Region
gacauacaaaugacacaaucaccaucaucacuaucagcaucaguaggagacagaguaacaauaacaugcagagcaucacaaggaauaucaucauggcuagcaugguaccaacaaaaaccagaaaaagcaccaaaaucccuaauauacgcagcaucaagauuacaaucaggaguaccaucaagauucucaggaucaggaucaggaacagacuucacacuaacaauaucaucacuacaaccagaagacuucgcaacauacuacugccaacaauacaacucauacccaauaacauucggacaaggaacaagacuagaaauaaaa

SEQ ID NO: 46259 - RNA, 366 nt, Artificial Sequence
  derived and/or modified sequence opt6 from HuMab-150_HeavyChain_VDJ-Region
gaaguacaauuaguacaaaguggagcagaaguaaaaaaaccaggagaaagcuuaaaaauaagcuguaaaggaagcggauacucauucacaagcuauuggauaggauggguaaggcaaaugccaggaaaaggacuagaauggaugggaucaauauauccaggagacucacacacaagauauagaccaagcuuucaaggacaaguaacaauaagcgcagacaaaagcauaagcacagcauaucuacaauggucaagcuuaaaagcaagcgauacagcaauguauuacugugcaagacaagcaggagauuacuauuacuauaacggaauggauguauggggacaaggaacaacaguaacaguaagcuca

SEQ ID NO: 46260 - RNA, 321 nt, Artificial Sequence
  derived and/or modified sequence opt6 from HuMab-150_LightChain_VJ-Region
gaaauaguacuaacacaaucaccaggaacacuaagcuuaagcccaggagaaagagcaacauuaagcuguagagcaagccaaagcguaucaucaucauaucuaacaugguaucaacaaaaaccaggacaagcaccaagauuacuaauauacggagcaucaagcagagcaacaggaauaccagauagauuuaguggaagcggaagcggaacagauuucacacuaacaauaucaagauuagaaccagaagauuucgcaguauauuacugucaacaauacggaucaucacuaacauucggaggaggaacaaaaguagaaauaaaa

SEQ ID NO: 46261 - RNA, 363 nt, Artificial Sequence
  derived and/or modified sequence opt6 from HuMab-152_HeavyChain_VDJ-Region
caaguacaaguaguagaaaguggaggaggaguaguacaaccaggaagaaguuuaagauuaaguugugcagcaaguggauuuacauuuaguaguuaugcaaugcauuggguaagacaagcaccaggaaaaggauuagaauggguagcaguaauaaguuaugauggaaguuauaaauauuaugcagauaguguaaaaggaagauuuacaauaaguagagauaauaguaaaaauacauuauauuuacaaaugaauaguuuaagagcagaagauacagcaguauauuauugugcaagaggaaguauaacaggaaguacaggaguauuugauuauuggggacaaggaacauuaguaacaguaaguagu

SEQ ID NO: 46262 - RNA, 321 nt, Artificial Sequence
  derived and/or modified sequence opt6 from HuMab-152_LightChain_VJ-Region
gacauacaaaugacacaaucaccaucaucacuaucagcaucaguaggagacagaguaacaauaacaugcagagcaucacaaggaauaaacucauggcuagcaugguaccaacaaaaaccagaaaaagcaccaaaaucacuaauauacgacgcaucaucacuacaaucaggaguaccaucaagauucucaggaucaggaucaggaacagacuucacacuaacaauaucaucacuacaaccagaaaacuucgcaacauacuacugccaacaauacaacucauacccaauaacauucggacaaggaacaagacuagaaauaaaa

SEQ ID NO: 46263 - RNA, 363 nt, Artificial Sequence
  derived and/or modified sequence opt6 from HuMab-153_HeavyChain_VDJ-Region
caaguacaauuaguagaaaguggaggaggaguaguacaaccaggaagaaguuuaagauuaaguugugcagcaaguggauuuacauuuagugauuauguaauacacuggguaagacaagcaccaggaaaaggauuagaauggguaacaguaauaaguuaugauggaaguaauaaauauuaugcagauaguguaaaaggaagauuuacaauaaguagagauaauaguaaaaauacauuauauuuacaaaugaauaguuuaagugcagaagauacagcaauguauuauugugcaagaggaggaauaacagggacaacaggaguauuugauuauuggggacaaggaacauuaguaacaguaaguagu

SEQ ID NO: 46264 - RNA, 321 nt, Artificial Sequence
  derived and/or modified sequence opt6 from HuMab-153_LightChain_VJ-Region
gacauacaaaugacacaaucaccaucaucauuaucagcaucaguaggagacagaguaacaauaacaugccgagcaucacaaggaauaucaucauggcuagcaugguaccaacaaaaaccagaaaaagcaccaaaaucacuaauauacgacgcaucaucacuacaaucaggaguaccaucaagauucucaggaucaggauacggaacagacuucucacuaacaauaucaucacuacaaccagaagacuucgcaauauacuacugccaacaauacaaaucauacccaauaacauucggacaaggaacaagacuagaaauaaaa

SEQ ID NO: 46265 - RNA, 378 nt, Artificial Sequence
  derived and/or modified sequence opt6 from HuMab-159_HeavyChain_VDJ-Region
gaaguacaauuaguacaaucaggagcagaaguaaaaaaaccaggagaaucauuaaaaauaucauguaaaggaucaggauauaauuucacaucauacuggauaggauggguaagacaaaugccaggaaaaggauuagaauggaugggaauaauauauccaggagacagugacacaagauacucaccaucauuucaaggacaaguaacaauaucagcagauaaaucaauaucaacagcauacuuacaauggagcucacuaaaagcaucagacacagcaauguauuacugcgcaagauggggaacauauuaugacauacuaacaggauauuuuaauugguuugacccauggggacaaggaacauuaguaacaguaucaagu

SEQ ID NO: 46266 - RNA, 321 nt, Artificial Sequence
  derived and/or modified sequence opt6 from HuMab-159_LightChain_VJ-Region
gacauacaaaugacacaaucaccaucaucacuaucagcaucaguaggagacagaguaacaauaacaugccgagcaucacaaggaauaucaucauggcuagcaugguaccaacaaaaaccagaaaaagcaccaaaaucacuaauauacgcagcaucaucacuacaaucaggaguaccaucaagauucucaggaucaggaucaggaacagacuucacacuaacaauaucaucacuacaaccagaagacuucgcaacauacuacugccaacaauacuacauauacccauggacauucggacaaggaacaaaaguagaaauaaaa

SEQ ID NO: 46267 - RNA, 363 nt, Artificial Sequence
  derived and/or modified sequence opt6 from HuMab-160_HeavyChain_VDJ-Region
caaguacaauuaguagaaaguggaggaggaguaguacaaccaggaagaaguuuaagauuaaguugugcagcaaguggauuuacauuuaguagucaugcaaugcauuggguaagacaagcaccaggaaaaggauuagaauggguagcagcaauaaguuaugauggaaguaauaaauauuaugcagauaguguaaaaggaagauucacaauaaguagagauaauaguaaaaauacaauguauuuacaaaugaauaguuuaagagcagaagauacagcaauguguuauugugcaagaggaaguauaacaggaaguacaggaguauuugauuauuggggacaaggaacauuaguaacaguaaguagu

SEQ ID NO: 46268 - RNA, 321 nt, Artificial Sequence
  derived and/or modified sequence opt6 from HuMab-160_LightChain_VJ-Region
gacauacaaaugacacaaucaccaucaucacuaucagcaucaguaggagacagaguaacaauaacaugccgagcaucacaagacauaucaucauggcuagcaugguaccaacaaaaaccagaaaaagcaccaaaaucacuaauauacgcagcaucaucacuacaaucaggaguaccaucaagauucucaggaucaggaucaggaacagacuucacacuaacaauaucaucacuacaaccagaagacuucgcaacauacuacugccaacaauacaacucauacccaauaacauucggacaaggaacaagacuagaaauaaaa

SEQ ID NO: 46269 - RNA, 372 nt, Artificial Sequence
  derived and/or modified sequence opt6 from HuMab-162_HeavyChain_VDJ-Region
gaaguacaauuaugggaaagcggaggaggaagcguacaaccaggaggaaguuuaagauuaagcugugcagcaagcggauucacauucucaagcuauggaaugagcuggguaagacaagcaccaggaaaaggacuagaauggguaagcggaauaucaggaucaggauauagcacauacuaugcagauagcguaaaaggaagauuuacaauaagcagagacaauagcaaaaacacacuauaucuacaaaugaauagcuuaagagcagaagauacagcaguauauuacugugcaaaaggauauuaccauggaucaggaucauacuauacaucauuugauuacuggggacaaggaacacuaguaacaguaaguuca

SEQ ID NO: 46270 - RNA, 321 nt, Artificial Sequence
  derived and/or modified sequence opt6 from HuMab-162_LightChain_VJ-Region
gacauacaaaugacacaaucaccaucaucacuaucagcaucaguaggagacagaguaacaauaacaugcagagcaucacaaggaauaucaucauggcuagcaugguaccaacaaaaaccagaaaaagcaccaaaaucacuaauauacgcagcaucaucauuacaaucaggaguaccaucaagauucucaggaucaggaucaggaacagacuucacacuaacaauaucaucacuacaaccagaagacuucgcaacauacuacugccaacaauacaacucauacccacuaacauucggaggaggaacaaaaguagaaauaaaa

SEQ ID NO: 46271 - RNA, 366 nt, Artificial Sequence
  derived and/or modified sequence opt6 from HuMab-163_HeavyChain_VDJ-Region
gaaguacaauuaguacaaaguggagcagaaguaaaaaaaccaggagaaaguuuaaaaauaaguugucaaggaaguggauauagauuuauaaguuauuggauaggauggguaagacaaaugccaggaaaaggauuagaauggaugggaagaauauauccaggagauagugauacaagauauaguccaaguuuucaaggacaagugacaauaaguguagauaaaaguauaagcacagcauauuuacaauggaguaguuuaaaagcaagugauacagcaauguauuauugugcaagacaaagaggagauuauuauuauuuuaauggauuagauguauggggacaaggaacaacaguaacaguaaguagu

SEQ ID NO: 46272 - RNA, 321 nt, Artificial Sequence
  derived and/or modified sequence opt6 from HuMab-163_LightChain_VJ-Region
gaaauaguauuaacacaaucaccaggaacauuaagcuuaagcccaggagaaagagcaacauuaagcuguagagcaagucaaagcguaagcucaagcuaucuagcaugguaucaacaaaaaccaggacaagcaccaagauuacuaauauacggagcaucaaguagagcaacaggaauaccagauagauuuagcggaagcggaagcggaacagauuucacacuaacaauaucaagauuagaaccagaagauuucgcaguauauuacugucaacaauacggaagcucacuaacauucggaggaggaacaaaaguagaaauaaaa

SEQ ID NO: 46273 - RNA, 363 nt, Artificial Sequence
  derived and/or modified sequence opt6 from HuMab-166_HeavyChain_VDJ-Region
caaguacaauuaguagaaaguggaggaggaguaguacaaccaggaagaaguuuaagauuaaguugugcagcaaguggauuuacauuuaguaguuaugcaaugcauuggguaagacaagcaccaggaaaaggauuagaauggguagcaguaauaaguuaugauggaaguaaugaauauuaugcagauaguguaaaaggaagauuuacaauaaguagagauaauaguaaaaauacauuauauuuacaaaugaauaguuuaagagcagaagauacagcaguauauuauugugcaagaggaaguauaauaggaaguacaggaguauuugauuauuggggacaaggaacauuaguaacaguaaguagu

SEQ ID NO: 46274 - RNA, 321 nt, Artificial Sequence
  derived and/or modified sequence opt6 from HuMab-166_LightChain_VJ-Region
gacauacaaaugacacaaucaccaucaucacuaucagcaucaguaggagacagaguaaccauaacaugcagagcaucacaaggaauaucaaacuggcuagcaugguaccaacaaaaaccagaaaaagcaccaaaaucacuaauauacgacgcaucaucacuacaaucaggaguaccaucaagauucucaggaucaggaucaggaacagacuucacacuaacaauaucaucacuacaaccagaagacuucgccacauacuacugccaacaauacaacucauacccaauaacauucggacaaggaacaagacuagaaauaaaa

SEQ ID NO: 46275 - RNA, 363 nt, Artificial Sequence
  derived and/or modified sequence opt6 from HuMab-167_HeavyChain_VDJ-Region
caaguacaacuaguagaaucaggaggaggaguaguacaaccaggaagaucacuaagacuaucaugcgcagcaaguggauuuacauuuagcucauaugcaauacauuggguaagacaagcaccaggaaaaggauuagaauggguagcaguaauaagcuaugacggaaguaauaaauauuaugcagacucaguaaaaggaagauuuacaauaucaagagauaauucaaaaaauacauuauauuuacaaaugaacucauuaagagcagaagacacagcaguauacuauugugcaagaggaagcauaacaggaaguacaggaguauucgauuacuggggacaaggaacacuaguaacaguaaguuca

SEQ ID NO: 46276 - RNA, 363 nt, Artificial Sequence
  derived and/or modified sequence opt6 from HuMab-169_HeavyChain_VDJ-Region
caaguacaauuaguacaaaguggagcagaaguaaaaaaaccaggagcaaguguaaaaguaaguuguaaagcaaguggauauacauuuacaaauuauggaauaaguuggguaagacaagcaccgggacaaggauuagaauggaugggaugguuaagugcauauaguggaaauacaauauaugcacaaaaauuacaaggaagaguaacaaugacaacagauacaagcacaacaacagcauauauggaauuaagaaguuuaagaagugaugauacagcaguauauuauugugcaagagauagaauaguaguaagaccagauuauuuugauuauuggggacaaggaacauuaguaacaguaaguagu

SEQ ID NO: 46277 - RNA, 321 nt, Artificial Sequence
  derived and/or modified sequence opt6 from HuMab-169_LightChain_VJ-Region
gaaauaguacuaacacaaucaccagcaacacuaucauuaucaccaggagaaagagcaacacuaucaugcagagcaucacaaucaguaucaucauaccuagcaugguaccaacaaaaaccaggacaagcaccaagacuacuaauauacgacgcaucaaacagagcaacaggaauaccagcaagauucucaggaucaggaucaggaacagacuucacacuaacaauaucaucacuagaaccagaagacuucgcaguauacuacugccaacaaagaucaaacuggccaagaacauucggacaaggaacaaaaguagaaauaaaa

SEQ ID NO: 46278 - RNA, 366 nt, Artificial Sequence
  derived and/or modified sequence opt6 from HuMab-7D8_HeavyChain_VH-Region
gaaguacaauuaguagaaaguggaggaggauuaguacaaccagauagaaguuuaagauuaaguugugcagcaaguggauuuacauuucaugauuaugcaaugcauuggguaagacaagcaccaggaaaaggauuagaauggguaaguacaauaaguuggaauaguggaacaauaggauaugcagauaguguaaaaggaagauuuacaauaagcagagauaaugcaaaaaauaguuuauauuuacaaaugaauaguuuaagagcagaagauacagcauuauauuauugugcaaaagauauacaauauggaaauuauuauuauggaauggauguauggggacaaggaacaacaguaacaguaagcagu

SEQ ID NO: 46279 - RNA, 366 nt, Artificial Sequence
  derived and/or modified sequence opt6 from HuMab-7D8_HeavyChain_V-Region
gaaguacaauuaguagaaaguggaggaggauuaguacaaccagauagaaguuuaagauuaaguugugcagcaaguggauuuacauuucaugauuaugcaaugcauuggguaagacaagcaccaggaaaaggauuagaauggguaaguacaauaaguuggaauaguggaacaauaggauaugcagauaguguaaaaggaagauuuacaauaaguagagauaaugcaaaaaauaguuuauauuuacaaaugaauaguuuaagagcagaagauacagcauuauauuauugugcaaaagauauacaauauggaaauuauuauuauggaauggauguauggggacaaggaacaacaguaacaguaaguagu

SEQ ID NO: 46280 - RNA, 321 nt, Artificial Sequence
  derived and/or modified sequence opt6 from HuMab-7D8_LightChain_VL-Region
gaaauaguacuaacacaaucaccagcaacacuaucacuaucaccaggagaaagagcaacacuaucaugcagagcaucacaaucaguaucaucauaccuagcaugguaccaacaaaaaccaggacaagcaccaagacuauuaauauacgacgcaucaaacagagcaacaggaauaccagcaagauucucaggaucaggaucaggaacagacuucacacuaacaauaagcucacuagaaccagaagacuucgcaguauacuacugccaacaaagaucaaacuggccaauaacauucggacaaggaacaagacuagaaauaaaa

SEQ ID NO: 46281 - RNA, 321 nt, Artificial Sequence
  derived and/or modified sequence opt6 from HuMab-7D8_LightChain_V-Region
gaaauaguacuaacacaaucaccagcaacauuaaguuuaagcccaggagaaagagcaacauuaagcuguagagcaagccaaagcguaagcucguacuuagcaugguaccaacaaaaaccaggacaagcaccaagacuauuaauauaugacgcaagcaauagagcaacaggaauaccagcaagauucucaggaucaggaucaggaacagacuuuacauuaacaauaaguucacuagaaccagaagacuuugcaguauacuauugccaacaaagaagcaauuggccaauaacauucggacaaggaacaagacuagaaauaaaa

SEQ ID NO: 46282 - RNA, 324 nt, Artificial Sequence
  derived and/or modified sequence opt6 from huMAb-anti-MSP10.1_LightChain_VJ-Region
gaaauaguacuaacacaaucaccagauauauuaagcuuaagcccaggagaaagagcaacauuaagcuguagagcaagccaagcauuaacagcaaaauaucuagcaugguaucaacaaaaaccaggacaaguaccaagauuacuaauauacggaagcucaacaagagcaacaggaauaccagauagauuuagaggaagcggaagcggaacagauuucacacuaacaauaucaagauuagaaccagcagauagcgcaguauauuacugucaacaauacgaagacucaccauggacauuuggacaaggaacaaaauuagaaauaaaa

SEQ ID NO: 46283 - RNA, 324 nt, Artificial Sequence
  derived and/or modified sequence opt6 from huMAb-anti-MSP10.2_LightChain_VJ-Region
gaaauaguacuaacacaaucaccagacacacuaucacuaucaccaggcgaaacagcaacacuaucaugcagagcaucacaaacaguaagaagaaacucacuagcaugguaccaacaaaaaccaggacaagcaccaagacuacuaauauacggagcaucagacagagcaacaggaauaccagacagauucucaggaucaggauucggaacagacuucacacuaacaguaucaggacuagaaccagaagacuucgcaguauacuacugccaacaauacggaaccucaccaagaacauucggacaaggaacaaaacuagaaauaaaa

SEQ ID NO: 46284 - RNA, 324 nt, Artificial Sequence
  derived and/or modified sequence opt6 from HUMAB-Clone_18_VJ-Region
gaaauaguauuaacacaaucaccagcaacacuaucacuaucaccaggagaaagagcaacacuaucaugcagagcaucacaaucaguaucaucauaccuagcaugguaccaacaaaaaccaggacaagcaccaagacuacuaauauacgacgcaucaaaaagagcaacaggaauaccagcaagauucucaggaucaggaucaggaacagacuucacacuaacaauaucaucacuagaaccagaagacuucgcaguauacuacugccaacaaagaucaaaauggccaccauggacauucggacaaggaacaaaaguagaaucaaaa

SEQ ID NO: 46285 - RNA, 324 nt, Artificial Sequence
  derived and/or modified sequence opt6 from HUMAB-Clone_22_VJ-Region
gaaauaguacuaacacaaucaccagcaacauuaagcuuaagcccaggagaaagagcaacauuaagcuguagagcaagccaaagcguaagcucauacuuagcaugguaccaacaaaaaccaggacaagcaccaagacuauuaauauaugacgcaagcaauagagcaacaggaauaccagcaagauucucaggaucaggaucaggaacagacuuuacauuaacaauaagcucacuagaaccagaagacuuugcaguauacuauugccaacaaagaagcaaauggccaccauggacauuuggacaaggaacaaaaguagaaauaaaa

SEQ ID NO: 46286 - RNA, 432 nt, Artificial Sequence
  derived and/or modified sequence opt6 from HuMab-L612_Chain_VDJ-Region_Precursor
auggaauuuggauuaacaugguuauuuuuaguagcaaauuuaaaaggaguacaaugugaagugcaauuauuagauaguggaggaggauuaguacaaccaggaggauguuuaagauuaaguugugcagcgaguggauuuacauuuucaaguugugcaaugaguuggguaaggcaagcaccaggaaaaggauuagaauggguaagugcaauaaguggaaguggaggaagcacauauuaugcagauagcguaaaaggaagauuuacaauaaguagagauaaaaguaaaaauacauuauauuuacaaaugaauaguuuaagagcagaagauacagcaguauauuauugugcaaaaggaggaaaugauauauuaacaggauauuaugcauggggacaaggaacacuaguaacaguaaguaguggaagugcaagugca

SEQ ID NO: 46287 - RNA, 321 nt, Artificial Sequence
  derived and/or modified sequence opt6 from HuMab_LC5002-002_LightChain_V-Region
gacauacaaaugacacaaucaccaucaucacuaucagcaucaguaggagaccgaguaacaauaacaugcagagcaucacaaggaauaucaagauggguagcaugguaccaacaaaaaccagaaaaagcaccaaaaucacuaauauacgcagcaucaucacuacaaucaggaguaccaucaagauucucaggaucaggaucaggaacagacuucacacuaacaauaagcucacuacaaccagaagacuucgcaacauacuacugccaacaauacaacucauacccauggacauucggacaaggaacaaaaguagaaauaaaa

SEQ ID NO: 46288 - RNA, 357 nt, Artificial Sequence
  derived and/or modified sequence opt6 from HuMab_LC5002-002_gamma1-Chain_V-Region
gaaguacaauuauuagaaaguggaggaggauuaguacaaccaggaggaaguuuaagauuaaguugugcagcaaguggauuuacauuuaauauauaugcaaugaauuggguaagacaagcaccaggaaaaggauuagaauggguaaguguaauaaguggaagaggaauaacaacauauuaugcagauaguguaaaaggaagauuuacaauaaguagagauaauaguaaaaauacauuauauuuacaaaugaauaguuuaagagcagaugauacagcaguauauuauugugcaaaaggaaguagcaguuggacagauuuugauuauuggggacaaggaacauuaguaacaguaaguagu

SEQ ID NO: 46289 - RNA, 321 nt, Artificial Sequence
  derived and/or modified sequence opt6 from HuMab_LC5002-003_LightChain_V-Region
gacauacaaaugacacaaucaccaucaucacuaucagcaucaguaggagacagaguaacaauaacaugcagagcaucacaaggaauaucaucauggcuagcaugguaccaacaaaaaccagaaaaagcaccaaaaucacuaauauacgcagcaucaucacuacaaucaggaguaccaucaagauucucaggaucaggaucaggaacagacuucacacuaacaauaucaucacuacaaccagaagacuucgcaacauacuacugccaacaauacaacucauacccauggacauucggacaaggaacaaaaguagaaauaaaa

SEQ ID NO: 46290 - RNA, 357 nt, Artificial Sequence
  derived and/or modified sequence opt6 from HuMab_LC5002-003_gamma1-Chain_V-Region
gaaguacaauuauuagaaaguggaggagauuuaauacaaccaggaggaaguuuaagauuaaguugugcagcaaguggauuuacauuuaauauauaugcaaugaacuggguaagacaagcaccaggaaaaggauuagaauggguaaguguaauaucaggaagaggaauaacaacauauuaugcagauaguguaaaaggaagauuuacaauaagcagagauaauaguaaaaauacauuauauuuacaaauggauaguuuaagagcagaagauacagcaguauauuacugugcaaaaggaaguaguuauuggacagauuuugauuauuggggacaaggaacauuaguaacaguaaguagu

SEQ ID NO: 46291 - RNA, 321 nt, Artificial Sequence
  derived and/or modified sequence opt6 from HuMab_LC5002-005_LightChain_V-Region
gacauacaaaugacacaaucaccaucaucacuaucagcaucaguaggagacagaguaacaauaacaugcagagcaucacaaggaauaucaucauggcuagcaugguaccaacaaaaaccagaaaaagcaccaaaaucacuaauauacgcagcaucaucacuacaaucaggaguaccaucaagauucucaggaucaggaucaggaacagacuucacacuaacaauaucaucacuacaaccagaagacuucgcaacauacuacugccaacaauacaacucacacccaccaacauucggacaaggaacaaaauuagaaauaaaa

SEQ ID NO: 46292 - RNA, 354 nt, Artificial Sequence
  derived and/or modified sequence opt6 from HuMab_LC5002-005_gamma1-Chain_V-Region
gaaguacaaguacuagauagcggaggaggacuaguacaaccaggaggaaguuuaagauuaagcuguacagcaagcggauucacauucagacuauauacaaugagcuggguaagacaaacaccaggaagaggacuagaauggguaagcggaauaucaggaucaggauuaagcacauacuuugcagauagcguaaaaggaagauuuacaauaagcagagacaauaguaaaaacacaguauaucuacaaaugaauaguuuaagagcagaagauacagcaguauauuacugugcaaaagaaggagacuggauauauuucgauagcuggggacaaggaacacuaguaauaguaagcuca

SEQ ID NO: 46293 - RNA, 321 nt, Artificial Sequence
  derived and/or modified sequence opt6 from HuMab_LC5002-007_LightChain_V-Region
gaaauaguacuaacacaaucaccaggaacauuaagcuuaaguccaggagaaagagcaacauuaagcuguagagcaagccaaagcguaagcucaagcuaucuagcaugguaucaacaaaaaccaggacaagcaccaagauuacuaauauacggagcaucaagcagagcaauaggaauaccagauagauuuaguggaagcggaagcggaacagauuucacacuaacaauaucaagauuagaaccagaagauuucgcaguauauuacugucaacauuacggaaguucacucacauucggaggaggaacaaaaguagaaauaaaa

SEQ ID NO: 46294 - RNA, 369 nt, Artificial Sequence
  derived and/or modified sequence opt6 from HuMab_LC5002-007__gamma1-Chain_V-Region
caaguacaauuaguacaaagcggagcagaaguaaaaaaaccaggaaguaguguaaaaguaaguuguaaaguaaguggaggaacauuuaguaguuaugcauuuagcuggguaagacaagcaccaggacaaggauuagaauggaugggaagaauaauaccaauauuaggaagaacaaauuaugcacaaaaauuucaaggaagaguaacaauaacagcagauaaaaguacaaguacagcauauauggaaguaaguagccuaagaagugaagauacagcaguauauuauugugcaagagaaggagaaacauuagauuauuuuuauuauggaauggauguauggggacaaggaacaacaguaacaguaaguagu

SEQ ID NO: 46295 - RNA, 357 nt, Artificial Sequence
  derived and/or modified sequence opt6 from HuMab_LC5002-018_gamma1-Chain_V-Region
gaaguacaauuauuagaaaguggaggaggauuaguacaaccaggaggaaguuuaagauuaaguugugcagcaaguggauuuacauuuaauauauaugcaaugaauuggguaagacaagcaccaggaaaaggauuagaauggguaaguguaauaaguggaaguggaguaacaacauauuaugcagauaguguaaaaggaagauuuacaauaaguagagauaauaguaaaaauacauuauauuuacaaaugaauaguuuaagagcagaagauacagcaguauauuauugugcaaaaggaaguaguugguauguagauuuugauuauuggggacaaggaacauuaguaacaguaaguagu

SEQ ID NO: 46296 - RNA, 1347 nt, Artificial Sequence
  derived and/or modified sequence opt6 from Ibalizumab_HeavyChain1
caaguacaauuacaacaaaguggaccagaaguaguaaaaccaggagcuucaguaaaaaugucauguaaagccagcgguuauacauuuaccagcuacguaauacacugggucagacaaaaacccggacaaggauuagauuggauaggauauauaaaccccuacaacgacggaacugauuaugacgaaaaauucaaaggcaaagcuaccuugaccucagauacaucaacaucaacagccuacauggaacuaucaaguuuaagaucagaagacacagcaguauacuacugcgcacgcgaaaaagauaauuacgcuacaggagccugguucgcauauuggggccaaggaacucuaguaacagugucaucagcaucaaccaaaggaccuucaguauucccauuagcaccuugcaguagaaguacaagugaaagcacagcagcacuaggauguuuaguaaaagacuacuucccagaaccaguaacagucucauggaacucuggcgcacuaacuucaggcguacacacauucccagcaguauuacaaaguuccggauuauauucauuaucaucugugguaacaguaccaucaucaagccuaggaacaaaaaccuauacauguaacguagaucauaaaccaucaaauacaaaaguagauaagagaguagaaucaaaauacggacccccaugcccaucauguccagcaccagaauuccuaggagggccaucaguauuccuauucccuccaaaaccaaaagacacauuaaugauaucacgaacaccagaaguaacaugcguaguaguagauguaucacaagaagaccccgaaguacaauucaacugguauguagacggaguagaaguacauaacgccaaaacaaaaccaagggaagaacaauucaacucaacauaucgaguaguauccguacuaaccguauuacaucaagacugguuaaacggaaaagaauauaaauguaaaguauccaacaaaggccuaccuucaagcauagaaaaaaccauaucuaaagcaaaaggacaaccaagagaaccacaaguauacaccuuaccaccaucacaagaagaaaugacaaaaaaccaaguaucauuaacaugucuaguaaaaggauuuuacccuagcgauauagcaguagaaugggaaagcaacggccaaccagaaaauaacuacaaaacaacucccccaguauuagacucagacggcucauucuuccuauacucgagauuaaccguagacaaaucaagauggcaagaaggcaacguauucucauguucuguaaugcacgaagcucuucacaaucacuacacacagaaaagccuuaguuuaagccuagguaaa

SEQ ID NO: 46297 - RNA, 657 nt, Artificial Sequence
  derived and/or modified sequence opt6 from Ibalizumab_LightChain1
gacauaguaaugacacaaucaccagacucacuagcaguaucacuaggagaacgaguaacaaugaacugcaaaucaucacaaucacuacuauacucaacaaaucaaaaaaacuacuuagcaugguaccaacaaaaaccaggacaaucaccaaaacuacuaauauacugggcaucaacaagagaaucaggaguaccagacagauucuccggaucaggaucaggaacagauuucacacuaacaauaucaucaguacaagcagaagacguagcaguauacuacugccaacaauacuauuccuacagaacauucggaggaggaacaaaacuagaaauaaaaagaacaguagcagcaccaaguguauucauauucccaccauccgacgaacaacuaaaaucaggaacagcuucaguaguaugcuuacuaaacaacuuuuacccaagagaagccaaaguacaauggaaaguagacaacgcacuacaaucaggaaacucacaagaaucaguaacagaacaagacucaaaagacucaacauacucauuauccucaacauuaacacuaucaaaagcagacuacgaaaaacacaaaguauaugcaugcgaagucacacaucaaggccuaucaucaccaguaacaaaaagcuucaacagaggagaaugc

SEQ ID NO: 46298 - RNA, 1329 nt, Artificial Sequence
  derived and/or modified sequence opt6 from Ibritumomab_tiuxetan_HeavyChain
caagcauaccuacaacaaucaggagcagaauuaguucgaccaggcgccagcgugaaaaugucaugcaaagcaucaggauacacauuuacauccuacaacaugcacuggguaaaacaaacccccagacaagguuuagaauggauaggagccauuuauccaggaaauggcgacacaucauauaaucaaaaauucaaaggcaaagcuacacuaaccguagacaaaucaucaucaacagcuuacaugcaauuaucaagucuaacuuccgaagacuccgcaguauacuucugcgcaagagucguuuauuacucaaacucauauugguauuucgauguauggggcacaggaacaaccguaacaguaucagccccaucaguauauccacuagcaccaguuugcggagacacuaccggaucuucaguaaccuuaggaugccuuguaaaaggauauuucccagaacccguuacauuaacauggaacucaggaucacuaucaucaggaguacacacauuuccagcagucuuacaaucagacuuauauacacuuucaucauccguaaccguaaccuccaguacauggccuucacaaucaauuacauguaauguagcacacccagcaucuucaacaaaaguagacaaaaaaauagaacccagaggaccaaccauaaaaccauguccaccauguaaaugcccagcuccaaauuuauuaggcggccccaguguauucauauuucccccaaaaauaaaagacgucuuaaugauaucguuaucaccaauagucacaugcguaguaguagacguaucagaagacgaccccgacguccaaauuucaugguuuguaaacaacgucgaaguucacaccgcacaaacccaaacccaccgugaagauuacaacucuacauuacgaguaguauccgcacuacccauacaacaucaagacuggaugucaggcaaagaauucaaaugcaaagucaacaacaaagacuuaccagcccccauagaaagaaccauauccaaaccaaaaggcucaguaagagcaccccaaguauacguacuacccccuccagaagaagaaaugacaaaaaaacaaguaacauuaacaugcauggucaccgauuucaugccagaagauauauauguugaauggacaaacaauggcaaaaccgaacucaacuauaaaaacacagaaccuguacuagacucagaugguucauacuucauguauucaaaauuacgaguagaaaaaaaaaacuggguagaaagaaacuccuacucaugcucaguuguacacgaaggacuacacaaccaccacacaacaaaaucauucucuaga

SEQ ID NO: 46299 - RNA, 627 nt, Artificial Sequence
  derived and/or modified sequence opt6 from Ibritumomab_tiuxetan_LightChain
caaauaguauuaucacaaucaccagcaauauuaucagcuucaccaggagaaaaaguaacaaugacaugcagagcaucaucaucaguaucauauaugcacugguaccaacaaaaacccggaucaucaccaaaaccauggauauacgcaccauccaaccuagcauccggaguaccagcacgauucuccggaucaggaucaggaacauccuauucacuaacaauaucaagaguagaagcagaagacgcagcaacauacuacugccaacaauggucauucaacccaccaacauucggagccggcacaaaauuagaacuaaaacgagcagacgcagccccaacaguauucauauucccuccauccgacgaacaauuaaaaaguggaacagcaucaguaguaugccuauuaaacaauuucuacccaagagaagcaaaaguacaauggaaaguagacaacgcauuacaaucaggaaacucacaagaaagcguaaccgaacaagacucaaaagauucaacauacagccuaucaucaacacucacacuaucaaaagcagacuacgaaaaacacaaaguauacgcaugcgaaguaacacaccaaggauuaucaucacccguaacaaaaucauucaac

SEQ ID NO: 46300 - RNA, 1368 nt, Artificial Sequence
  derived and/or modified sequence opt6 from Icrucumab_HeavyChain1
caagcucaaguaguugaaucaggaggaggaguaguacaauccggaagaucuuuaagacuaagcugcgccgcaucaggguuugccuuuucaucauauggaaugcacugggucaggcaagcaccaggcaaaggacuagaauggguagcaguaauaugguaugacggaucaaacaaauacuaugcagauucuguaagaggaagauucacaauaucuagagacaauagcgaaaacacacuauacuuacaaaugaauaguuuaagagcagaagauaccgcaguauacuacugugccagagaucauuacggaaguggaguacaccacuacuucuauuacggauuagacguauggggacaagguacaacaguaacuguaucaucagcuaguacuaaaggcccaucaguauucccuuuagcaccaucaucuaaaucaacaucaggagguacagcugcacuagguugccugguaaaagauuacuuuccagaaccagucacaguaucauggaauucaggugcuuuaaccuccgguguacacacauuuccagccguauuacaaucaagcggacuauacucccuaagcagcguuguaaccguaccaucuucaucauuaggaacacaaacauauaucugcaauguaaaucacaaaccaucaaauacaaaaguagauaaacguguagaaccuaaaucaugugauaaaacacacacaugcccacccuguccagcaccugaacuacuaggugggccaagcgucuucuuauucccaccaaaaccaaaagauacccuuaugauaucacguacaccugaaguaacuugugucguuguagauguaucacaugaagauccagaaguaaaauucaacugguauguagauggaguagaaguacauaaugcaaaaacaaaaccacgagaagaacaauacaauucaacauauagaguuguaucuguauuaacaguucuacaccaagauuggcuaaacggaaaagaauacaaauguaaaguaagcaauaaagccuuaccagcaccaauagaaaaaacaauaucaaaagccaaaggacaaccaagagaaccccaaguauauacacucccaccaucaagagaagaaaugacaaaaaaucaaguaucauuaacaugccuaguaaaaggauucuauccaucagacauagcaguugaaugggaaucaaauggccaaccagaaaauaauuacaaaacuacaccaccaguuuuagacucagauggauccuucuuuuuauacucaaaacuuaccguagauaaaucaagauggcaacaaggaaauguuuucucuuguucaguaaugcaugaagcacuacauaaucacuauacacaaaaaaguuuauccuuaaguccuggcaaa

SEQ ID NO: 46301 - RNA, 645 nt, Artificial Sequence
  derived and/or modified sequence opt6 from Icrucumab_LightChain1
gaaauaguucuaacccaaucaccagguacacuaucauuauccccaggagaaagagccacauuaucaugccgagcaucacaaucaguaucaucaucauaccuagcaugguaucaacaaaaaccaggacaagcacccagauuacuaaucuacggagcaucaucaagagcaacaggaauaccagacagauucucaggaucaggaucaggaacagacuuuacacuaacaauaucaagacuagaaccagaagauuucgcaguauacuacugccaacaauacggaucauccccacuaacauuuggaggaggaacaaaaguagaaauaaaacgaacaguagcagcaccaucaguauucauauucccccccucagacgaacaacuaaaaucaggaacagcaucaguaguaugccuauuaaacaauuucuacccaagagaagcaaaaguacaauggaaaguagacaacgcacuacaaucaggaaauucacaagaaucaguaacagaacaagacucaaaagacucaacauacucacuaucaucaacacuaacacuaucaaaagcagacuacgaaaaacacaaaguauacgccugcgaaguaacacaccaaggccuaucaucaccaguaacaaaaagcuucaacagaggagaaugc

SEQ ID NO: 46302 - RNA, 675 nt, Artificial Sequence
  derived and/or modified sequence opt6 from Idarucizumab_HeavyChain1
caaguacaauuacaagaaaguggaccaggauuaguaaaaccaucagaaacacuaucacuaacaugcacaguaucaggauucucauuaacauccuacauaguagacuggaucagacaaccaccaggaaaaggauuagaauggauaggugucauaugggcaggaggaucaacaggauacaacucagcacuaagaagcagaguaucaauaacaaaagacacaucaaaaaaccaauucucauuaaaauuaucaucaguaacagcagcagacacagcaguauauuacugcgcauccgcagcauacuauucauacuacaacuacgacggauucgcauacuggggacaaggaacauuaguaacaguaucaucagcaucaacaaaagguccaucaguauucccacuagcaccaucaucaaaauccacauccggaggaacagcagcacuaggaugcuuaguaaaagacuacuucccagaaccaguaacaguaucauggaacucaggagcacuaacaucaggaguacacacauucccagcaguacuacaaucaucaggauuauacucauuaucaucaguaguaacaguaccaucaucaucacuaggaacacaaacauacauaugcaacguaaaccacaaaccaucaaacacaaaaguagacaaaaaaguagaaccaaaaucaugc

SEQ ID NO: 46303 - RNA, 657 nt, Artificial Sequence
  derived and/or modified sequence opt6 from Idarucizumab_LightChain1
gacguaguaaugacccaauccccacuaucacuaccaguaacacuaggacaaccagcaucaauaucaugcaaaucaucucaaucacuacuauacacagacggaaaaacauaccuauauugguucuuacaaagaccaggacaaucacccagaagacuaauauaccuaguauccaaauuagacucaggaguaccagacagauucucagguucaggaucaggaacagacuucacauuaaaaauaucaagaguagaagccgaagacguaggaguauacuacugccuacaaucaacacacuucccacacacauuuggaggaggaacaaaaguagaaauaaaaagaacaguagccgcaccaucaguauucauauucccaccaucagacgaacaacuaaaaucaggaacagcaucagucguaugccuauuaaacaacuucuacccaagagaagcaaaaguacaauggaaaguagacaacgcccuacaaucaggaaacucacaagaauccguaacagaacaagacucaaaagacucaacauacucacuaucaucaacacuaacauuaucaaaagcagacuacgaaaaacacaaaguauacgcaugcgaaguaacacaucaaggacuaucaucaccaguaacaaaaucauucaacagaggagaaugc

SEQ ID NO: 46304 - RNA, 1332 nt, Artificial Sequence
  derived and/or modified sequence opt6 from Igatuzuab_HeavyChain1
caaguacaauuaguacaaucuggagcagaagucaaaaaaccaggauccagugucaaagucuccuguaaagccucaggauuuaccuucacagacuacaaaauccacuggguccgacaagcacccggacaagguuuagaauggggauauuucaacccaaacucaggauacucaacauaugcacaaaaauuccaaggaagaguuacuauaacggccgauaaaucaacaucuacagccuacgaacuaucaucacuacgaagcgaagauacagcaguauauuacugcgcaagauuaucaccaggagguuacuacguagacgcauggggacaaggcacaaccguaacaguuucaagcgcaucaacaaaaggaccaagcgucuucccacuagcaccaucaucaaaaucaacaucaggaggaacagccgccuugggaugccuaguaaaagacuauuucccagaaccaguaacaguaucauggaacucaggagcauuaaccuccggcguacauacauucccagcaguacuccaauccucaggacuauacucauuaucauccguuguaacugucccaucaucaucacuaggaacacaaacauacauaugcaacguaaaccacaaaccuucaaacacaaaaguagauaaaaaagucgaaccaaaaucaugugacaaaacucacacguguccaccaugcccagcaccugaacuauuaggcgguccauccgucuuccuauuuccaccaaaacccaaagacacacuaauaagccgcacaccugaaguaacuugugucguaguagauguaucacacgaagauccagaaguaaaguuuaauugguacguagacggaguagaaguacacaacgcaaaaacaaaaccaagagaagaacaauauaacucaacuuaucguguaguaucaguauuaacagucuuacaccaagauuggcuaaacgguaaagaauauaaaugcaaaguauccaauaaagcauuacccgcaccaauagaaaaaacaaucucaaaagcaaaaggucaaccuagagaaccacaaguauacacauuaccaccaucaagagacgaacuaacaaaaaaucaagucuccuuaacaugcuuaguuaaagguuuuuaccccucagauauagcaguugaaugggaaucaaacggacaacccgaaaauaacuacaaaacaacaccaccaguacuagacucugauggaucauucuucuuauacucuaaauuaacagucgacaaaucacguuggcaacaagguaacguauuuucauguucaguucaugaagcacuacacaaccacuacacacaaaaaucucuuucauuaucucccgga

SEQ ID NO: 46305 - RNA, 636 nt, Artificial Sequence
  derived and/or modified sequence opt6 from Igatuzuab_LightChain1
gacauacaaacacaaucaccaucaucacuaucagcaucaguaggagaccgaguaacaauaacaugcagagcaucacaaggaauaaauaacuacuuaaacugguaccaacaaaaaccaggaaaagccccaaaaagacucauauacaacacaaacaacuuacaaacaggaguaccaucaagauucucaggaucaggaucaggaacagaauucacacuaacaauauccucacuacaaccagaagacuucgcaacauacuacugcuuacaacacaacuccuucccaacauucggacaaggaacaaaacuagaaaucaaaagaacaguagcagccccaucaguauucauauucccaccaucagacgaacaacuaaaaucaggaacagcaucaguaguaugccuacuaaacaacuucuacccacgagaagcaaaaguacaauggaaaguagacaacgcacuccaaucaggcaacucacaagaaucaguaacagaacaagacucaaaagacucaacauacucccuauccuccacccuaacccuaucaaaagcagacuacgaaaaacacaaaguauacgcaugcgaaguaacacaccaaggacucucaucaccaguaacaaaaucauuuaacagaggagaaugc

SEQ ID NO: 46306 - RNA, 357 nt, Artificial Sequence
  derived and/or modified sequence opt6 from IGF-IR_HUMAB-1A_HeavyChain
gaaguacaauuaguacaaaguggaggaggauuaguacauccaggaggaaguuuaagauuaaguugugcaggaaguggauuuacauuuagaaauuaugcaauguauuggguaagacaagcaccaggaaaaggauuagaauggguaagugcaauaggaaguggaggaggaacauauuaugcagauaguguaaaaggaagauuuacaauaaguagagauaaugcaaaaaauaguuuauauuuacaaaugaauaguuuaagagcagaagauauggcaguauauuauugugcaagagcaccaaauuggggaagugaugcauuugauauauggggacaaggaacaaugguaacaguuucaagu

SEQ ID NO: 46307 - RNA, 357 nt, Artificial Sequence
  derived and/or modified sequence opt6 from IGF-IR_HUMAB-23_HeavyChain
gaaguacaauuaguacaaaguggaggaggauuaguacauccaggaggaaguuuaagauuaaguugugcaggaaguggauuuacauuuucaaauuaugcaauguauuggguaagacaagcaccaggaaaaggacuagaauggguaagugcaauaggaaguggaggaggaacauauuaugcagauaguguaaaaggaagauuuacaauaaguagagauaaugcaaaaaauaguuuauauuuacaaaugaauaguuuaagagcagaagauauggcaguauaucauugugcaagagcaccaaauuggggaagugaagcauuugauauauggggacaaggaacaaugguaacaguaaguagu

SEQ ID NO: 46308 - RNA, 321 nt, Artificial Sequence
  derived and/or modified sequence opt6 from IGF-IR_HUMAB-23_LightChain
gacauacaaaugacacaaucaccaucaucacuaucagcaucaguaggagacagaguaacaauaacaugcagagcaucacaaggaauaucaucauggcuagcaugguaccaacaaaaaccagaaaaagcaccaaaaucacuaauauacgcagcaucaucacuacaaucaggcguaccaucaagauucucaggaucaggaucaggaacagacuucacacuaacaauaucaucacuacaaccagaagacuucgcaacauacuacugccaacaauacaacucauacccaauaacauucggacaaggaacaagacuagaaauaaaa

SEQ ID NO: 46309 - RNA, 357 nt, Artificial Sequence
  derived and/or modified sequence opt6 from IGF-IR_HUMAB-8_HeavyChain
gaaguacaauuaguacaaaguggaggaggauuaguacauccaggaggaaguuuaagauuaaguugugcaggaaguggauuuacauuuagaaguuaugcaauguauuggguaagacaagcaccaggaaaaggauuagaauggguaagugcaauaggaaguggaggaggaacauauuaugcagauaguguaaaaggaagauuuacaauaaguagagauaaugcaaaaaauaguuuauauuuacaaaugaauaguuuaagagcagaagauauggcaguauauuauugugcaagagcaccaaauuggggaagugaugcauuugauauauggggacaaggaacaaugguaacaguaaguagu

SEQ ID NO: 46310 - RNA, 321 nt, Artificial Sequence
  derived and/or modified sequence opt6 from IGF-IR_HUMAB-8_LightChain
gacauacaaaugacacaaucaccaucaucacuaucagcaucaguaggagacagaguaacaauaacaugcagagcaucacaaggaauaucaucauggcuagcaugguaccaacaaaaaccagaaaaagcaccaaaaucacuaauauacgcagcaucaucacuacaaucaggaguaccaucaagauucucaggaucaggaucaggaacagacuucacccuaacaauaucaucacuacaaccagaagacuucgcaacauacuacugccaacaauacaacucauacccaccaacauucggaccaggaacaaaaguagacauaaaa

SEQ ID NO: 46311 - RNA, 708 nt, Artificial Sequence
  derived and/or modified sequence opt6 from ImAb1_LightChain
auggacaugagagccccagcacaauucuucggaauacuacuacuaugguucccaggaauaagaugugacauaaaaaugacacaaucaccaucaucaauguacgcaagccuaggcgaaagaguaacaauaacauguaaagccucacaagacauaaaaucauaccucucaugguaccaacaaaaaccuuggaaaucaccaaaaauacuaaucuacuacgcaacaucacuagcagacggaguaccaagcagaauauccggaucaggaucaggacaagacuacucauuaacaaucucaucacuagaaucagacgacacagcaacauacuacugccuacaacacggagaaagcccauacacauucggaggaggaacuaaauuagaaauaaaaagagcagacgcagcaccaacagucaguauauucccaccaucaucagaacaauuaaccucaggaggagcaucaguaguaugcuuucuaaacaacuucuacccaaaagacauaaacguaaaauggaaaauagacggaucagaaagacaaaacgguguacuaaacagcuggaccgaccaagacucaaaagacucaacauacaguaugucaucuacacuaacacuaacaaaagacgaauacgaaagacauaacucauacacaugcgaagcaacacacaaaacaucaaccucaccaauaguaaaauccuucaacagaaacgaaugc

SEQ ID NO: 46312 - RNA, 681 nt, Artificial Sequence
  derived and/or modified sequence opt6 from ImAb1_gamma1-Chain
augaacuuuggauucucauuaauauuucuaguacuaguauuaaaaggaguacaaugugaaguaaaauuaguagaaucaggaggaggacucguaaaaccaggaggaucauuaaaauuaucaugugcagcaaguggcuucacauucucaaacuaugcaaugucauggguaagacaaacaccagaaaaaagauuagaauggguagcaucaauaucaagugauggagauacauauuucccagacaauguaaaaggaagauucacaauaucaagagaaaaugcaggaaauauauuauuuuuacaaaugucauccuuaagaagugaagacacagcaauguauuauugcgcacgaggauucaugaucacauucuggggacaaggaacauuaguaaccguaucagcagcaaaaacaacaccaccaucaguauauccauuagcaccaggaugcggagacacaacaggaucaucaguaacauuaggaugcuuagucaaaggauauuucccagaaucaguaacaguaacauggaauucaggaucauuaaguucaucaguacacacauucccagcacuacuacaaucaggauuauauacaaugucaucaucaguaacaguaccaucaagcacauggccaagccaaacaguaacauguucaguagcacauccagcaucaucaaccacaguagau

SEQ ID NO: 46313 - RNA, 1344 nt, Artificial Sequence
  derived and/or modified sequence opt6 from Imalumab_HeavyChain1
gaaguccaauuauuagaaaguggagguggacuaguacaaccaggaggaagucuccgauuauccugugcugcaucagguuuuacuuucucaauauacucaaugaacugggucagacaagcuccaggcaaaggauuagaauggguaucaagcaucggauccucaggaggaacaacauacuaugcagacucuguaaaaggaagauuuacaauaucaagagauaauucuaaaaauacccuauacuuacaaaugaacucacucagagcagaagacacagcaguauauuacugugcaggcucacaauggcuauacggcauggauguauggggccaaggaacaacaguaacagucucaucagcaaguaccaaaggaccuucaguauucccauuagccccuucaucaaaaucaacaucaggaggaacagcagcacucggaugccucguuaaagacuacuuuccagaaccgguaacaguaucauggaauucaggagcucuaacuuccggaguacacacauucccagcuguacuccaaucaaguggauuauacucuuuaucaucaguaguaacaguaccaucauccucuuuaggaacucaaacauauauuuguaacguuaaucacaaaccaucuaacacaaaaguugauaaaagagucgaaccaaaauccugugauaaaacacacacguguccuccaugcccagcacccgaacuacuuggcggaccaucaguauuccuuuuuccaccaaaaccaaaagauacauuaaugauaagcagaacaccagaaguaacaugcguugucguagauguaucacacgaagauccagaagucaaauuuaauugguacguagacggaguagaaguccauaaugcaaaaacaaaaccaagagaagaacaauauaauucaaccuaccguguagucuccguacuaacaguacuucaccaagacuggcuaaacggaaaagaauauaaaugcaaagucucaaauaaagcccuaccagcaccuauagaaaaaaccauaucaaaagcaaaaggacaaccaagagaaccccaaguauacacucuaccaccauccagagaagaaaugacaaaaaaccaaguaucauuaaccugccuagucaaaggauucuauccaucagacaucgcugucgaaugggaaagcaauggccaaccagagaauaacuauaaaacaacaccaccaguacuagacucugacggaucauuuuuucuauauucaaaacuaaccgucgacaaaucuagauggcaacaaggcaacguauuuagcuguucaguaaugcaugaagcuuuacacaaucacuacacacaaaagucauuaucccuaucuccaggcaaa

SEQ ID NO: 46314 - RNA, 642 nt, Artificial Sequence
  derived and/or modified sequence opt6 from Imalumab_LightChain1
gauauacaaaugacacaaucaccaucaucccuaucagcaucaguaggagacagaguaacaauaacaugcagaucaucccaacguauaaugaccuacuuaaacugguaccaacaaaaaccaggaaaagcaccaaaacuacuaauauuuguagcaagccacucccaaucaggaguaccaucaagauucagaggcucaggaucagaaacagacuucacacuaacaauaucaggccuacaaccagaagacucagcaacauacuauugccaacaaucauucuggacaccacuaacauucggaggaggaacaaaagucgaaauaaaaagaacaguagcagcaccaucaguauucauauucccaccaucagacgaacaacuaaaaucuggaacagcaucaguaguuugccuacuaaacaacuucuacccaagagaagcaaaaguacaauggaaaguagacaacgcauuacaauccggaaacucacaagaauccguaacagaacaagacucaaaagacucaaccuacucauuaagcucaacauuaacacuaucaaaagcagacuacgaaaaacacaaaguauacgcaugcgaaguaacacaccaaggauuaucaucaccaguaacaaaaucauuuaacagaggagaaugc

SEQ ID NO: 46315 - RNA, 1347 nt, Artificial Sequence
  derived and/or modified sequence opt6 from Imgatuzumab_HeavyChain1
caaguacaacuaguacaaucaggagcugaaguuaaaaaaccaggcucaucaguuaaagucucaugcaaagccucaggauuuacauuuaccgacuauaaaauacacugggucagacaagccccaggacaaggauuagaauggaugggauacuuuaacccuaauucagguuacuccacauacgcacaaaaauuucaaggaagaguaacaauaacagcagacaaaucaacaucaacagcauauauggaacuaucgucuuuaagaucugaagauaccgcagucuacuauugcgccagauuaucaccaggcggcuacuacgucauggaugccuggggacaagguacaacaguaacaguauccucugcauccacaaaaggaccaucuguauucccuuuagccccaaguucaaaaucaacaucaggcgguacagcagcucucggaugcuuaguaaaagacuauuucccagaaccaguaacagucucauggaauuccggugcuuuaaccagcggaguucauacauucccagcaguauuacaauccucaggucuauauucacuaucaucuguaguaacaguaccaucaucauccuuaggaacucaaaccuacauaugcaauguaaaccacaaaccaucaaacacaaaaguagauaaaaaagucgaaccaaaaucaugugacaaaacucacaccuguccaccuugccccgcaccugaacuuuuaggaggaccaucuguauuccuauuccccccaaaaccaaaagacacccucaugauaucaagaacuccagaagucaccugugucguaguagacguaucacaugaagauccagaaguaaaauucaacugguacguagacggaguagaaguccauaacgcaaaaacaaaaccaagagaagaacaauauaauucaacauacagaguaguaucaguacuaacaguuuuacaucaagacuggcucaacggaaaagaauauaaauguaaagucucuaacaaggcucuaccugcaccaauagaaaaaacaauaucaaaagccaaaggacaaccaagagaaccacaagucuacacauuaccaccaucaagagacgaacuaacaaaaaaccaaguaucacuaacaugcuuagucaaaggcuucuacccaucagauauagccguugaaugggaaagcaauggacaacccgaaaauaauuacaaaaccacaccccccguacuagacucagacggaucauuuuuccuauacucaaaacuaacaguagacaaaucacgauggcaacaaggaaacguauucucaugcucaguaaugcacgaagcauuacauaaccacuauacccaaaaaucacuaucauuauccccagga

SEQ ID NO: 46316 - RNA, 639 nt, Artificial Sequence
  derived and/or modified sequence opt6 from Imgatuzumab_LightChain1
gauauacaaaugacacaaucacccucaucacuaucagcaucaguaggagaccgcguaacaauaacaugcagagcaucacaaggaaucaacaacuaccucaacugguaccaacaaaaaccaggcaaagcaccaaaacgauuaauauacaacacaaacaacuuacaaacaggagucccaucuagauucucaggaucaggcucaggaacagaauucacacuaacaauaucaucccuacaaccagaagacuucgcaacauacuacugcuuacaacacaacucauucccaacauucggacaaggaacaaaacucgaaauaaaaagaacaguagcagccccaucaguauucauauucccaccaucagacgaacaacuaaaaucaggaacagcaucaguaguaugucuacuaaacaacuucuacccacgagaagcaaaaguccaauggaaaguagacaacgcacuacaaucaggaaacucacaagaaucaguaacagaacaagacucaaaagacucaaccuacucacuaucaucuacacucaccuuaucaaaagcagacuacgaaaaacacaaaguauacgcaugcgaagucacacaccaaggacuaucaucaccaguaacaaaaucauucaaccgaggagaaugc

SEQ ID NO: 46317 - RNA, 1353 nt, Artificial Sequence
  derived and/or modified sequence opt6 from Inclacumab_HeavyChain1
gaaguacaacuaguagaaucaggaggaggauuaguucgaccaggagguucccuacgacuaucaugugcagcauccggauuuacauucucaaauuaugauaugcauuggguacgacaagccacaggaaaagguuuagaauggguauccgcuaucacagcagcaggagacauuuacuacccagguucaguuaagggaagauuuacaauaaguagagaaaacgcuaaaaauucauuauauuuacaaaugaauucauuaagagcaggugacacagcaguauacuacugugcaagaggaagauauucaggaagcgguucauauuauaaugacugguuugaccccuggggacaagguacacuagugacaguaucuucagcaucaaccaaaggaccuagcguauuuccucuugcaccauguucaagaaguacaucagaaucaaccgccgcauuaggaugucuaguuaaagauuauuuuccagaaccaguaacagucucauggaauucaggggcuuuaacuuccggaguacauacauuuccggccguauuacaaucuucaggacuauauucauuaucaagcguaguuacaguaccaucaucaucacuagguacuaaaacauauacauguaacguagaucacaaaccaucuaacacaaaaguagauaaacgaguagaaucuaaauacggaccaccauguccaccaugcccagcuccugaauuugaaggagguccaucaguauuucuauuuccucccaaaccaaaagauacacuaaugauauccagaacaccugaaguaacuugcgugguaguagauguaagccaagaagauccagaaguacaauuuaauugguacguagauggaguagaaguucacaacgccaaaacaaaaccaagagaagaacaauuuaacucaacauaucgcguaguaucaguauuaacuguauuacaccaagauugguuaaaugguaaagaauacaaauguaaaguuucaaauaaaggacuuccaucaagcauagaaaaaacaauuuccaaagcaaaaggacaaccccgagaaccacaaguauauacacuucccccaucccaagaagaaaugacaaaaaaucaaguuucauuaacaugucugguaaaaggauucuauccauccgacauagcaguugaaugggaaagcaacggccaaccugaaaauaauuauaaaacaacaccucccguuuuagauucagacggaaguuuuuuccuauacucacgauuaacaguagauaaaucacgauggcaagaaggaaauguguuuucauguucaguaaugcaugaagcauuacauaaucacuacacacaaaaaucacuuucauuaucuuuaggaaaa

SEQ ID NO: 46318 - RNA, 642 nt, Artificial Sequence
  derived and/or modified sequence opt6 from Inclacumab_LightChain1
gaaauaguauuaacacaaucaccagcaacacuaagccuaagcccaggagaaagagcaacauuaucaugcagagcaagccaaucaguuucaucauacuuagcaugguaucaacaaaaaccaggacaagcaccaagacuacuaauauaugacgcaagcaacagagcaacaggaauaccagccagauucucaggaucaggaucaggaacagacuuuacauuaacaauaagcucacuagaaccagaagacuucgcaguauacuauugccaacaaagaucaaauuggccauuaacauucgguggaggaacaaaagucgaaauaaaaagaacaguagcagcaccaucaguauucauauucccaccaucugacgaacaauuaaaaucaggaacagcaucaguuguaugcuuacuaaauaacuucuacccaagagaagcaaaaguccaauggaaaguagauaacgcauuacaaagcggaaacucacaagaaagcguaacagaacaagacagcaaagacucaacauacagucuaucaucaacuuuaaccuuauccaaagcagacuacgaaaaacauaaaguauacgcaugcgaaguaacacaccaaggauuaagcucaccaguaacaaaaucauuuaauagaggagaaugc

SEQ ID NO: 46319 - RNA, 1347 nt, Artificial Sequence
  derived and/or modified sequence opt6 from Indatuximab_ravtansine_HeavyChain1
caaguacaacuacaacaaucaggaucagaacuaaugaugccaggcgcuaguguaaaaauaaguugcaaagcuaccggauauacuuuuucuaacuauuggauagaauggguaaaacaaagaccaggacacggauuagaauggauaggcgaaauauuaccagggacaggacgaacaauauauaacgaaaaauuuaaaggaaaagcaacauucacagccgacauaagcuccaauacaguacaaaugcaauuauccagucuaacuucagaagacucugcaguauauuauugugcaagaagagauuauuauggaaacuuuuacuacgcaauggacuauuggggccaaggaacaaguguaacaguaucaucagcauccacaaaaggaccaagcguauuuccauuagccccaugcagcagaaguacaucagaaucaacagcagcacuaggaugucuaguaaaagacuacuucccagaaccaguaacuguaucuuggaacucaggagcacuaacaaguggaguucacacauucccagcaguucuccaauccucaggauuauacucucucuccagcguaguaacaguuccaagcucuucacuaggaaccaaaacauauacauguaacguagaccacaaaccaucaaauacaaaagucgacaaacgaguagaaucaaaauacggaccacccugcccuuccugccccgcccccgaauucuuaggagguccaaguguauuccuauuuccaccaaaaccaaaagacacacuaaugauaagucgaacaccagaaguaacaugcguaguagucgacguaucccaagaagaccccgaaguacaauucaacugguacguagacggaguagaaguacacaaugcaaaaacuaaaccaagagaagaacaauuuaacucaacauacaggguaguaaguguucucacaguucuacaucaagacuggcuaaacgguaaagaauacaaauguaaagucucgaauaaaggauuaccauccuccauagaaaaaacaauaucaaaagcaaaaggacaaccaagagaaccacaaguauacacacucccuccaucacaagaagaaaugacaaaaaaucaaguaucauuaacaugccuaguaaaaggauuuuacccaucagauaucgcaguugaaugggaaagcaacggacaaccugaaaacaauuacaaaacaacaccaccaguauuagauucagacggcuccuuuuucuuauauagccgcuuaacagucgauaaaagcagauggcaagaaggaaacguuuucuccuguucuguaaugcacgaagcacuacacaaccauuacacacaaaaaucauuaagucuaucauuaggaaaa

SEQ ID NO: 46320 - RNA, 642 nt, Artificial Sequence
  derived and/or modified sequence opt6 from Indatuximab_ravtansine_LightChain1
gacauacaaaugacacaaucaacaucaagccuaagcgccucauuaggcgacagaguaacaauaagcugcagcgcaagccaaggaauaaacaauuacuuaaacugguaccaacaaaaaccagacggcacaguagaacuacuaauauacuacaccagcacacuacaaucuggaguaccaucaagauucucaggaucaggcucaggaacagacuacucacuaacaauaagcaacuuagaaccagaagacauaggaacauacuacugccaacaauacucaaaacuaccaagaacauucggcggaggaacaaaacuagaaauaaaaagaacaguagcagcaccaucaguauucauauucccaccaucagacgaacaauuaaaaucaggcacagcaucaguaguaugccuacuaaacaacuucuacccacgcgaagcaaaaguacaauggaaaguagacaacgcacuacaaagcggaaacucacaagaaaguguaacagaacaagacagcaaagacucaacauacucauuaaguucaacauuaacacuaagcaaagcagacuacgaaaaacacaaaguauacgcaugcgaaguaacacaccaaggauuaucaucaccaguaacaaaaagcuucaacagaggcgaaugc

SEQ ID NO: 46321 - RNA, 1347 nt, Artificial Sequence
  derived and/or modified sequence opt6 from Indusatumab_vedotin_HeavyChain1
caaguacaauuacaacaauggggcgcaggacuucuaaaaccaagcgaaacacuaucuuuaacaugcgcaguauuuggaggaucauuuucaggauacuauuggucauggaucagacaaccaccaggcaaaggucucgaauggauuggagaaauaaaccaccgaggaaacacaaacgauaacccaucacucaaaucaagaguaacaauauccguagacacaagcaaaaaucaauuugcacuaaaauuaucaucaguaacagcagccgacacagcuguauacuacugugcaagagaaagaggauacacauauggaaacuucgaucauuggggccaaggaacccucguaacaguaucaucugccuccacuaaaggaccaucaguauuccccuuagcccccucaucaaaauccacauccggaggaacagcagcuuuagguuguuuaguaaaagauuauuucccugaaccagucacaguaucauggaauuccggagcacuaaccucagguguucauacauucccagcaguuuuacagucaucuggccuauacucacuaagcucuguaguaaccguacccucaucaagcuuaggcacacaaacauacauauguaauguaaaccauaagccauccaacacaaaaguagacaaaaaaguagaaccaaaauccugugauaaaacccacacauguccaccaugcccagcucccgaacuacuuggaggccccucugucuuuuuauucccaccaaaacccaaagacacauuaaugauaucaagaacaccagaaguaacuugcguaguuguagacguaagucacgaagacccagaaguaaaauuuaacugguacguagacggaguagaaguacauaacgcaaaaacaaaaccaagagaagaacaauacaacuccacauacagagucgucucaguacuaaccguccuacaucaagacuggcuaaauggaaaagaauacaaaugcaaaguaucaaauaaagcgcuuccagcaccaauagaaaaaacuauaucuaaagcaaaaggacaaccaagagaaccccaaguauauacauuaccaccaucucgagaugaacuaacaaaaaaccaaguaucccucacaugucucguaaaagguuuuuacccauccgacauugcaguagaaugggaaucuaauggccagcccgaaaacaauuacaaaacaacaccaccuguacuagauagcgacgguucauuuuuucuauauucuaaacuaacaguagacaaaucaagauggcaacaaggcaacguauucucauguucuguaaugcaugaagcacuacauaaccacuacacacaaaaauccuuauccuuaucacccggaaaa

SEQ ID NO: 46322 - RNA, 642 nt, Artificial Sequence
  derived and/or modified sequence opt6 from Indusatumab_vedotin_LightChain1
gaaauaguaaugacacaaucaccagcaacucuaaguguaucaccaggagaaagagcaacauuaagcuguagagcaagccaaucaguaagcagaaacuuagcaugguaccaacaaaaaccaggacaagcaccaagacuauuaauauauggagcaagcacaagagcaacaggaauaccagcaagauucucaggaucuggaucuggcacagaauuuacacuaacaauaggaucacuacaaagcgaagacuuugcaguauacuauugccaacaauauaaaaccuggccaagaacauucggacaaggaacaaauguagaaauaaaaagaacaguagcagcaccaagcguauucauauucccaccaucagacgaacaacuaaaaucagguacagcaucaguaguaugcuuacuaaauaacuuuuacccacgagaagcaaaaguacaauggaaaguagauaacgcacuacaaagcggaaacucacaagaaagcguaacagaacaagauagcaaagacucgacauauaguuuaagcucaacauuaacacuaagcaaagcagauuacgaaaaacauaaaguauaugcaugcgaaguaacacaccaaggauuaagcucaccaguaacaaaaagcuuuaacagaggagaaugc

SEQ ID NO: 46323 - RNA, 1353 nt, Artificial Sequence
  derived and/or modified sequence opt6 from Inebilizumab_HeavyChain1
gaaguacaauuaguugaaucaggcggagguuuaguacaaccaggaggaucacuaagacucucaugcgcagcuucaggauuuacauuuagcucaucauggaugaacugggucagacaagcaccaggaaaaggauuagaauggguagguagaauauacccaggugacggagauacaaauuacaaugucaaauuuaaaggaagauuuacaauaucuagagacgauucaaaaaacagucuuuaucuccaaaugaacucauuaaaaacagaagauacagcagucuauuauugcgcaagauccggauuuauuacaacaguuagagauuucgauuacuggggacaaggaacauuaguaacaguaucaucagcaucaaccaaaggaccaaguguauuuccacucgcacccaguucaaaaucaacaucaggaggaacagcagcucuaggcugcuuaguaaaagacuauuucccagaaccaguaacaguauccuggaauucaggugcauuaacaaguggcguacacacuuucccugcagucuuacaaaguagcggccuauacucacuaucaagcguaguaacuguaccuucaucuagucucggaacucaaacauacauaugcaacgucaaucacaaaccuuccaacaccaaaguugacaaaagaguagaaccaaaaucaugcgauaaaacccacacaugcccaccaugcccagccccagagcucuuaggaggaccaucaguauuuuuauuuccuccaaaaccaaaagauacauuaaugauaucacguacuccagaagucaccuguguaguaguagacguaagccacgaagacccagaaguaaaauuuaacugguacguagacggaguagaaguucauaacgcaaaaacaaaaccacgagaagaacaauacaacaguacauauagaguaguuuccguacuaacaguacuacaccaagacugguuaaacgguaaagaauauaaauguaaaguaaguaauaaagcacuaccagcaccaaucgagaaaacaauaucaaaagcgaaaggacaaccacgagaaccacaagucuacaccuuaccaccuagcagagaagaaaugacuaaaaaccaaguauccuuaacaugcuuaguaaaagguuucuauccaucagauauagccguagaaugggaaucuaacggucaaccagaaaauaauuauaaaacaacaccaccaguacuagacagcgauggaucauucuuucuauauucaaaauuaacaguagacaaauccagauggcaacaaggaaacguauuuucauguaguguaaugcaugaagcacuacauaaccauuacacacaaaaaucuuuaucuuuaucaccugguaaa

SEQ ID NO: 46324 - RNA, 654 nt, Artificial Sequence
  derived and/or modified sequence opt6 from Inebilizumab_LightChain1
gaaauaguauuaacacaaucacccgacuuccaaagcguaacaccaaaagaaaaagucacaauaacuugccgagcaagcgaaaguguagacacauucggaauaucauucaugaauugguuccaacaaaaaccagaccaaucaccaaaacuauuaauacacgaagcaucaaaccaaggaagcggaguaccaagcagauucucaggaucaggcucaggaacagacuucacauuaacaauaaacucacuagaagccgaagacgcagcaacauacuacugccaacaaucaaaagaaguaccauucacauucggaggaggaacaaaaguagaaauaaaaagaacaguagcagcaccaagcguauucauauucccaccaucagacgaacaacuaaaaucaggaacagcaucaguaguaugccuacuaaacaacuucuacccaagagaagccaaaguacaauggaaaguagacaacgcacuacaaagcggaaauucacaagaaucaguaacagaacaagacagcaaagauucaaccuauagccuaagcucaacacuaacauuaucaaaagcagacuacgaaaaacacaaaguauaugcaugugaaguaacacaccaaggcuuaucaucaccaguaacaaaaagcuucaaccgaggagaaugc

SEQ ID NO: 46325 - RNA, 90 nt, Artificial Sequence
  derived and/or modified sequence opt6 from Insulin_peglispro_Fragment1
uucguaaaccaacacuuaugcggaagccaucuaguagaagcacuauaucuaguaugcggagaaagaggauuuuucuauacaaaaccaaca

SEQ ID NO: 46326 - RNA, 63 nt, Artificial Sequence
  derived and/or modified sequence opt6 from Insulin_peglispro_Fragment2
ggaauagucgaacaaugcuguacaucaauauguucauuauaccaacuagaaaacuauugcaau

SEQ ID NO: 46327 - RNA, 495 nt, Artificial Sequence
  derived and/or modified sequence opt6 from Interferon_beta-1b_chain1
ucauacaaccuacuaggauuccuacaaagaucaucaaacuuccaaucacaaaaacuacuauggcaacuaaacggaagacuagaauacugccuaaaagacagaaugaacuucgacauaccagaagaaauaaaacaacuccaacaauuccaaaaagaagacgcagcacuaacaauauacgaaaugcuacaaaacauauucgcaauauucagacaagacucaucaucaacaggauggaaugaaacaauaguagaaaaccuacuagcaaacguauaccaccaaauaaaccaccuaaaaacaguauuagaagaaaaacuagaaaaagaagacuucacaagaggaaaacuaaugucaucacuacaccuaaaaagauacuacggaagaauacuacacuaccuaaaagcaaaagaauacucacacugcgcauggacaauaguaagaguagaaauacucagaaacuucuacuucauaaacagacuaacaggauacuuaagaaac

SEQ ID NO: 46328 - RNA, 1347 nt, Artificial Sequence
  derived and/or modified sequence opt6 from Intetumumab_HeavyChain1
caaguucaauuaguagaaucagguggcggcguaguucaaccaggaagaucaagacgcuuaucaugcgcagcuucagguuuuacauucucaagauauacaaugcauuggguaagacaagcacccggaaaaggauuagaauggguagcaguaauaucauucgauggaucaaacaaauacuaugucgacucaguaaaaggucgauucacuauaucaagagacaacucagaaaacacauuauacuuacaaguaaacauauuacgcgcagaagacacagcuguauauuauugcgccagagaagcaagaggcucuuacgccuucgauauauggggccaaggaaccaugguaacaguaucauccgcauccacaaaaggaccaaguguuuuuccccuagccccuucaucaaaauccacaucaggcggaacagcagcccuaggaugccuaguaaaagacuauuucccagaaccagucacugucucauggaacaguggagcacuaacaucagguguacacacauuuccagcaguacuacaaucaucgggccucuauucacuaucauccgucguaacaguucccuccucaucccuagguacacaaacauacauaugcaauguaaaccauaaacccucaaauacaaaaguagauaaaaaagucgaaccaaaaucaugugauaaaacccacacauguccaccauguccagcaccagaacuauuaggaggaccaucaguuuucuuauuuccaccuaaaccaaaagauacacuaaugauauccagaacaccagaaguaacauguguuguaguagaugucucacacgaagacccggaaguaaaauuuaauugguacguagacggagucgaaguccacaacgcgaaaacaaaaccacgugaagaacaauauaacucaacauauagaguaguuucaguacuaacaguuuuacaccaagacugguuaaacgguaaagaauacaaaugcaaaguaucaaacaaagcccuaccagccccaauagaaaaaacaaucucaaaagcaaaaggacaaccaagagaaccacaaguuuauacauuaccacccucaagagaugaacuaacaaaaaaccaaguaucacuaaccugucuaguuaaagguuuuuauccauccgauauagcuguagaaugggagucaaauggccaaccagaaaacaacuacaaaacuacaccaccaguauuagauucagacggaucauucuuccuauauucuaaauuaacagucgacaaaucaagauggcaacaaggaaacgucuuuucaugcuccguuaugcaugaagcauuacacaaucauuacacacaaaaaucauuaucauuaucuccaggcaaa

SEQ ID NO: 46329 - RNA, 645 nt, Artificial Sequence
  derived and/or modified sequence opt6 from Intetumumab_LightChain1
gaaauaguacuaacacaauccccagcaacacuaucauuaucaccaggagaaagagcaacauuaucuugcagagcaucacaaucaguaucaucauaccuagcaugguaccaacaaaaacccggccaagcuccacgcuuacuaauauacgacgcaucaaaccgagcaacaggcauaccagcaagauucucuggaucaggaucaggaacagacuucacacuaacaaucucuucacuagaaccagaagacuucgcaguauacuacugccaacaaagaucaaacuggccaccauucacauucggaccaggaaccaaaguagacauaaaaagaacaguagcagcaccauccguauucauauucccaccaucagaugaacaacuaaaaucuggaacagcaucaguaguaugccuauuaaacaacuucuacccccgagaagcaaaaguacaauggaaaguugacaacgcuuuacaauccggaaacucacaagaaucaguaaccgaacaagacucaaaagacucaaccuacucacuaucaucaacacuaacacuaucuaaagcagacuacgaaaaacacaaaguauacgcaugcgaaguaacacaccaaggauuaucaucaccagucacaaaaucauucaacagaggcgaaugc

SEQ ID NO: 46330 - RNA, 1347 nt, Artificial Sequence
  derived and/or modified sequence opt6 from Iodine_(124I)_Girentuximab_HeavyChain1
gauguaaaauuaguagaaucaggaggaggccuaguaaaacuaggaggcuccuuaaaacuaucaugcgcagcaucuggauuuacauuuucaaacuacuacauguccuggguaagacaaacaccugaaaaaagacuagaauuagucgcagcaauaaacucggauggcggaauaacuuauuaccuagauacuguaaagggaagauuuacuauaucacgagauaacgcaaaaaauacuuuauacuuacaaaugucuucacuaaaaucagaagacacagcauuauucuacugcgcuagacaucgaagugguuauuuuucaauggacuacuggggacaaggaacaaguguaacaguauccuccgcaucaacaaaaggacccucaguuuucccauuagcaccaucaaguaaaucaacaucaggaggcacggcagcacucggaugccucguuaaagacuacuucccagaaccaguuaccguauccuggaacucaggagcauuaacaucaggaguacacacauucccagccguccuccaauccucaggacuauauucacucucauccguagucacaguuccuucuucaucauuagguacacaaaccuacauaugcaacguaaaccacaaacccucuaauaccaaaguagauaaaaaaguagaaccaaaaucgugugauaaaacacacacuugcccaccaugcccagcaccggaacuauuaggaggaccauccguauuuuuauuuccuccaaaaccaaaagacacccucaugauaucaagaacaccagaagucaccugcguagucguagacguaucacacgaagacccagaaguaaaauuuaacugguacguagacggugucgaaguacacaacgcaaaaacaaaaccaagagaagaacaauauaacucaacauacagaguaguaucaguacucacuguauuacaccaagacuggcuaaauggaaaagaauacaaaugcaaaguaagcaauaaagccuuaccagcaccaaucgaaaaaacaauauccaaagcaaaaggucaaccaagagaaccacaaguuuacacacuuccccccuccagagacgaacuaacaaaaaaucaaguaagccuaacaugccuaguaaaaggauuuuacccuucagauauagcagucgaaugggaaucaaacggacaaccagaaaacaauuacaaaacaacacccccaguacuagacucugauggaucauucuuccuauacucaaaauuaaccguugacaaaucaagauggcaacaaggaaauguauucucauguucaguaaugcacgaagcacuacacaaccacuauacacaaaaaucauuaucauuaucaccaggaaaa

SEQ ID NO: 46331 - RNA, 642 nt, Artificial Sequence
  derived and/or modified sequence opt6 from Iodine_(124I)_Girentuximab_LightChain1
gauauaguuaugacacaaucucaaagauucaugagcacuacaguaggagauagaguaucaauaacauguaaagcaagccaaaacguaguaucagcagucgcaugguaccaacaaaaaccaggacaaucacccaaacuauuaauauauagcgcaagcaauagauauacaggaguaccagacagauucacaggaucaggaucaggaacagacuuuacacuaacaauaucaaauaugcaaucagaagaccuagcagauuucuuuugccaacaauacagcaauuacccauggacauuuggaggaggaacaaaacuagaaauaaaaagaacaguagcagcaccaagcguauucauauucccaccaucagacgaacaauuaaaaucaggaacagcaucaguaguaugcuuacuaaauaacuuuuacccaagagaagcaaaaguacaauggaaaguagauaacgcacuacaaaguggaaacucacaagaaagcguaacagaacaagacagcaaagauucaaccuauucauuaagcucaaccuuaacccuaucaaaagcagauuacgaaaaacauaaaguauacgcaugcgaaguaacacaccaaggauuaagcucacccguaacaaaaagcuuuaacagaggagaaugc

SEQ ID NO: 46332 - RNA, 1335 nt, Artificial Sequence
  derived and/or modified sequence opt6 from Iodine_(131I)_derlotuxiab_biotin_HeavyChain1
cagguacaauuaaaagaaucagguccagguuuagucgccccaucccaaucauuaucaauaacuugcacaguaucaggauucucucuaacagacuacgguguaagauggauaagacaaccaccaggaaaaggcuuagaauggcuuggcguuauauggggaggaggaucuacauauuacaacucugccuuaaaaucaagacuaucuauaucaaaagacaauagcaaaucccaaguauuccucaaaaacucacuacaaacagaugacacagcauacuacugugcaaaagaaaaaagaagaggauacuacuacgcugacuacuggggacaaggaacaucugucacagucucaucugcaucaaccaaaggacccuccguauuuccacuagcaccaucaucaaaaucaacaucaggcggaaccgcagcacuagggugccuaguaaaagauuacuuccccgaaccaguaacaguaucauggaacucuggagcacuaacuucagguguacacacauuuccugcaguacuacaauccucaggacuauauucauuaucaucaguaguaaccguaccauccaguucucuaggaacacaaacauauaucugcaacguuaaccacaaaccaucaaauacaaaaguagauaaaaaagcugaaccaaaauccugcgauaaaacccacacauguccccccugcccagcaccagaacuauuaggugguccauccgucuuccuauuuccaccaaaaccaaaagauacucuaauaucccgaacaccagaagucacaugugucguaguagacguuucacacgaagauccagaaguaaaauucaauugguacgucgacggcgucgaaguacauaacgccaaaacaaaaccaagagaagaacaauacaacucaacauacagaguaguaucaguucuaacagucuuacaucaagacuggcuaaacggaaaagaauacaaauguaaaguaagcaacaaagcacuaccagcaccaauagaaaaaacaauaucaaaagcaaaaggccaaccacgagaaccacaaguuuacacauuacccccaucaagagacgaauuaacaaaaaaucaaguaucauuaaccugucuaguaaaagguuucuacccaucagauauagcaguagaaugggaaucaaacggacaaccagaaaacaacuacaaaacaacaccaccaguauuagacuccgacggaucauuuuuucucuacaguaaacuaacagucgacaaaucaagauggcaacaaggaaacguauucucaugcucaguacacgaagcacuccacaaccacuacacacaaaaaucccuaucucuaucuccuggaaaa

SEQ ID NO: 46333 - RNA, 639 nt, Artificial Sequence
  derived and/or modified sequence opt6 from Iodine_(131I)_derlotuxiab_biotin_LightChain1
gaaaacguauuaacacaaucaccagccauaucagcaucaccaggagaaaaaguaacaaccugccgagcaucaucaucaguaucaucaucauaccuacacugguaccaacaaaaaucaggagcaucaccaaaauuauggauauacucaacaucaaaccuagcaucaggugucccagcaagauucucaggaucaggaucaggcacaucauacucacuaacuauuuccuccguagaagccgaagacgcagcaacauacuacugccaacaauacucaggauacccauuaacauucggcggaggaacaaaacuagaaauaaaaagaacaguagcagcaccaucaguauucauauucccacccucagacgaacaauuaaaaucaggaacagcaucaguaguaugccuauuaaacaacuucuauccaagagaagcaaaaguacaauggaaaguagacaacgcacuacaauccggaaacucacaagaaucaguaacagaacaagacucaaaagacucaacauacucacuaucaucaacccuaacccuaucaaaagccgacuacgaaaaacacaaaguauacgcaugcgaaguaacacaccaaggacuaucaucaccaguaacaaaaucauuuaacagaggagaaugc

SEQ ID NO: 46334 - RNA, 1350 nt, Artificial Sequence
  derived and/or modified sequence opt6 from Iodine_(131I)_Derlotuximab_biotin_HeavyChain1
caaguacaacucaaagaaucaggcccaggacuaguagccccaucacaaucucuaucuauaacaugcaccguaucaggauucucucucaccgauuacggaguaagauggauaagacaaccacccggaaaaggacuagaaugguuaggaguaauauggggaggagggucgacauacuacaacagcgcacuaaaaucaagacuaucaauuagcaaagauaacucaaaaucacaaguuuuccuaaaaaugaacaguuuacaaacugaugacacagccauguacuauugcgcaaaagaaaaaaggcgaggauauuacuaugcaauggauuacuggggacaaggcacaucaguaacaguaucuucagcaucaacaaagggaccaagcguauucccauuagcacccaguaguaaaucaacaagcggaggaacagcagcccuuggaugucuaguaaaagacuacuucccagaaccaguuacaguaucauggaauucuggagcauuaacaucaggcguccacacauuuccagcaguuuuacaaucaucaggauuauacagucuaucaaguguaguaacgguaccaucaucaagccuaggaacccaaacauacauaugcaacguuaaucauaaaccaucuaacacaaaaguagacaaaaaagcagaaccaaaaucaugcgacaaaacacacacaugcccaccaugcccagcacccgagcuauuaggaggaccaucaguauucuuguucccaccaaaaccaaaagauacuuuaaugauaagcagaacaccagaaguaacaugcguagucguugacguaucccaugaagaccccgaagucaaauucaacugguauguagauggaguagaaguacauaacgcaaaaacaaaaccacgcgaagaacaauauaacucaacauauagaguuguaucaguacuuacaguucuacaccaagacuggcuaaauggaaaagaauacaaaugcaaaguaucaaacaaagcauuaccagcaccaauagaaaaaacuauaucaaaagcaaaaggacaaccaagagaaccccaaguauauacauuaccuccaagucgagacgaauuaacaaaaaaccaaguaucauuaacaugccucguaaaaggauucuaucccagcgacaucgcagucgaaugggaaucaaauggacaaccugaaaauaauuacaaaacaacaccaccaguauuagauucagacggaucauucuuuuuauacucaaaacuaacaguagauaaaucaagauggcaacaaggaaaugucuucaguugcucaguaaugcaugaagcacuacauaaucauuacacucaaaaaucauuaucacuauccccaggaaaa

SEQ ID NO: 46335 - RNA, 645 nt, Artificial Sequence
  derived and/or modified sequence opt6 from Iodine_(131I)_Derlotuximab_biotin_LightChain1
gaaaacguccuaacccaaucaccagcaauaaugucagcaucaccaggagaaaaaguaacaaugacaugcagagcauccucaucaguaucauccucauaccuacauugguaucaacaaaaauccggagcaucaccaaaacuauggauauacuccacaucaaacuuagcaucaggagucccagcaagauucucaggaucaggaucaggaacaucauacucauuaaccauaucaucaguagaagcagaagacgccgcaacauacuacugccaacaauauucaggauacccauuaacauucggaggaggaacaaaauuagaaaucaaaagaacaguagcagcaccaucuguauucauauucccaccaucagacgaacaacuaaaauccggaacagcaucaguaguaugccuacuaaacaacuucuauccaagagaagcaaaaguacaauggaaaguagacaacgcacuacaaucaggaaacucacaagaaucaguaacagaacaagacucaaaagacucaacauacucacuaucaucaacucuaacacuaucaaaagcagacuaugaaaaacacaaaguauacgcaugugaaguaacacaccaaggccuaucauccccaguaacaaaaucauucaacagaggagaaugc

SEQ ID NO: 46336 - RNA, 1344 nt, Artificial Sequence
  derived and/or modified sequence opt6 from Ipilimumab_HeavyChain
caaguacaauuaguagaaucaggaggagguguaguacaaccaggaaggucacuaagacuaucaugugcugcaucaggauucacauucucuucauacacaaugcauuggguacgacaagcaccaggaaaaggguuagaauggguaacauucauaucuuacgauggaaacaacaaauauuaugccgacuccguaaaaggucgcuucaccauaucaagagacaacuccaaaaacacuuuauacuuacaaaugaacucauuaagagcagaagacacugcuauauauuacugugccagaacaggauggcuaggcccuuucgacuacuggggacaaggaacacuagucacaguaucaucagcaucaacaaaagggccaucaguauucccauuagcaccaucuagcaaaucgacaucaggaggaacagcagcccuaggaugccucguaaaagacuauuuccccgaaccuguaacuguaucuuggaacucaggagcacuuacaucuggaguccacacuuuuccugccguacuacaaucuucaggauuauacucauuaucaucaguuguaacaguaccuucaucaucacuaggaacacaaacauacauaugcaacguaaaccacaaaccaucaaauacaaaaguagacaaacgaguagaaccaaaauccugcgacaaaacacauacauguccaccaugccccgcaccagaacucuuaggaggccccucaguauucuuauuuccaccuaaacccaaggacacauuaaugauaucaagaacacccgaaguaaccugcguaguaguagacgucucacacgaagauccagaaguuaaauuuaauugguacguagacggaguagaaguacacaaugcaaaaacaaaaccaagagaagaacaauacaauucaacauacagaguaguaucuguauuaacuguacuccaccaagacugguuaaacggaaaggaauacaaaugcaaagucucaaacaaagcacuacccgcacccaucgaaaaaacaauaucaaaagcaaaaggucaacccagagaaccccaagucuacacauuacccccauccagagaugaacuaacaaaaaaucaaguauccuuaacaugccuaguuaaaggguuuuacccauccgauauagcgguagaaugggaauccaacggacaaccagaaaacaauuauaaaacaacaccuccaguacuagacucagauggaucauucuuccuauauucaaaauuaacaguagacaaaucaagauggcaacaaggaaacguuuucucaugcuccguuaugcacgaagcacuacauaaucacuauacacaaaaaucacuuucccucucacccggaaaa

SEQ ID NO: 46337 - RNA, 645 nt, Artificial Sequence
  derived and/or modified sequence opt6 from Ipilimumab_LightChain
gaaauaguauuaacacaaucacccggaacauuaucacuaucaccaggagaaagagcaacacuaucaugcagagcaucacaaucaguaggaagcuccuaccuagcaugguaccaacaaaaaccaggacaagcaccaagacuacuaauauacggagcauuuucaagagcaacaggaauaccagauagauucucaggaucaggaucaggaacagacuucacacuaacaauaucaagauuagaaccagaagacuucgcaguauacuacugccaacaauacggaucaucaccauggacauucggacaaggaacaaaaguagaaaucaaaagaacaguagcagcaccaagcguauucauauucccaccaucagacgaacaauuaaaaucagguacagcaucaguaguaugccucuuaaacaacuucuacccaagagaagcuaaaguucaauggaaaguagacaacgcacuacaaagcggaaacucacaagaaucaguaacagaacaagacucaaaagacucaacauacucacuaucaucaacacuaacacuaagcaaagcagacuacgaaaaacacaaaguauacgcaugcgaaguaacacaccaaggucuaucaucaccaguaaccaaauccuucaacagaggagaaugc

SEQ ID NO: 46338 - RNA, 186 nt, Artificial Sequence
  derived and/or modified sequence opt6 from Iratumumab_HeavyChain1
caaguacaauuacaacaauggggagcaggauuauuaaaaccaagugaaacauuaagucuaacaugugcaguauauggaggaaguuuuagugcauauuauuggaguuggauaagacaaccaccaggaaaaggauuagaauggauaggagauuauuggggacaaggaaguuuaguaacaguaaguagu

SEQ ID NO: 46339 - RNA, 321 nt, Artificial Sequence
  derived and/or modified sequence opt6 from Iratumumab_LightChain1
gacauacaaaugacacaaucaccaacaucacuaucagcaucaguaggagacagaguaacaauaacaugcagagcaucacaaggaauaucaucauggcuaacaugguaccaacaaaaaccagaaaaagcaccaaaaucacuaauauacgcagcaucaucacuacaaucaggaguaccauccagauucucaggaucaggaucaggaacagacuucacacuaacaauaucaucacuacaaccagaagacuucgcaacauacuacugccaacaauacgacucauacccaauaacauucggacaaggaacaagacuagaaauaaaa

SEQ ID NO: 46340 - RNA, 1350 nt, Artificial Sequence
  derived and/or modified sequence opt6 from Isatuximab_HeavyChain1
caaguacaacuaguacaaucaggagcagaaguagccaaaccaggaaccucaguaaaacucucuugcaaagcaucaggauauacuuucacagacuacuggaugcaauggguaaaacaaagaccaggacaaggacucgaauggauaggaacaauauacccaggcgauggagauacuggauacgcccaaaaauuucaagguaaagccacacucacagccgacaaaucaucuaaaacaguuuacaugcauuuaucaucuuuagcaagcgaagauucagcaguauacuacugugcacgaggagacuauuauggaucaaauucauuagacuauuggggacaagguaccagcguaacaguuucuucagcaucaacaaaaggaccaucaguauuuccuuuagccccauccucaaaaucaacauccggaggaaccgcagccuuaggauguuuaguaaaagacuacuuuccagaacccguaacaguaucauggaacucaggagcuuuaacaucaggaguacauaccuucccagcaguauuacaaucaaguggauuauauucucuaagcagcguuguaacaguaccuucaucaucacuaggaacucaaacauauauauguaacgucaaucauaaaccaagcaacacaaaagucgauaaaaaaguagaaccaaaaagcugcgacaaaacacacacaugcccuccuugcccagcaccagaacuauuaggaggaccaucugucuucuuauuucccccaaaaccaaaagacacacuaaugaucucaagaacuccagaaguaacaugcguaguuguagacguaagucacgaagaccccgaaguaaaauuuaacugguacguagacggaguugaaguccacaaugcaaaaacaaaaccacgagaagaacaauauaacucuacauaucgcguaguaucuguacuuaccguuuuacaucaagacuggcuaaacggcaaagaauacaaaugcaaaguaucaaacaaagcauuaccagcaccaauagaaaaaacaauaagcaaagccaagggccaacccagggaaccccaagucuacacacuaccaccaucaagagacgaauuaacaaaaaaccaaguaucacuaacaugcuuagucaaaggauuuuacccaucagauaucgccguagaaugggaaaguaacggacaaccagaaaacaacuacaaaacaacaccaccaguacuagacucagauggaucauuuuuccuauauucaaaacucacaguagacaaaagucgauggcaacaaggaaacguauucuccugcucaguaaugcacgaagcauuacacaaccacuacacucaaaaaucuuuaucauuaucaccaggaaaa

SEQ ID NO: 46341 - RNA, 642 nt, Artificial Sequence
  derived and/or modified sequence opt6 from Isatuximab_LightChain1
gacauaguaaugacacaaucacaccuaucaauguccacaucacuaggcgacccaguauccauaaccugcaaagcaucacaagauguaucaacaguaguagcaugguaccaacaaaaaccaggacaaucaccaagaagacuaauauacucagcaucauacagauacauaggaguaccagacagauucacaggcuccggagcaggcacagacuucacauucacaauauccucaguccaagcagaagaccuagcaguauacuacugccaacaacauuacuccccaccauacacauucggaggcggaacuaaacuagaaauaaaaagaacaguagcagcaccaucaguauucauauucccaccaucagacgaacaacuaaaaucaggcacagcaucaguaguaugccuacuaaacaacuucuauccacgagaagcaaaaguacaauggaaaguagacaacgcauuacaaucaggaaacucacaagaaucaguaacagaacaagacuccaaagacucaaccuacucauuaucaucaacacuaacccuaucaaaagcagacuacgaaaaacacaaaguauacgcaugcgaaguaacacaccaaggauuaucaucaccaguaacaaaaucauuuaacagaggagaaugc

SEQ ID NO: 46342 - RNA, 1347 nt, Artificial Sequence
  derived and/or modified sequence opt6 from Itolizumab_HeavyChain1
gaaguccaauuaguugaaucaggaggaggacuaguaaaaccaggagguucauuaaaauuaucaugcgcagcaucaggauucaaauucucaagauaugcaaugucauggguaagacaagcaccuggaaaaagacuagaauggguagcaacaauauccucaggaggcucuuacauauacuaccccgacucagucaaaggccgauucacaauaucaagagacaacguaaaaaacacauuauauuuacaaaugucaucacuaagaucugaagacacagcuauguauuauugcgccagacgcgauuacgacuuagauuacuucgauuccuggggacaaggaacacuaguaacaguaucaucagcauccacaaaaggacccuccgucuucccccuagcaccaucaagcaaauccacauccggcggaacugcagcauuaggaugccuaguuaaagacuauuucccugaaccuguuaccguuucauggaacucaggagcacucacaucuggaguacauacauuuccugcagucuuacaaucaucaggacuauauucauuaucuucaguaguaacaguacccucaucaagcuuagguacacaaacauacauauguaacguaaaucacaaaccaucuaacacaaaaguagacaaaaaaguagaaccaaaaucaugcgauaaaacccauacaugcccacccuguccagcccccgaacuauuaggcggcccaucaguuuuuuuauucccuccaaaaccaaaagauacucuaaugauaucacgaacaccagaaguaaccugcguugucguagaugucucacaugaagauccagaagucaaauucaauugguauguagacgguguagaaguccacaacgcaaaaacaaaaccaagagaagaacaauauaacucaacauaccgaguagucagcguauuaacuguacuucaucaagacuggcuaaacggaaaagaauacaaauguaaaguaucaaacaaagcccuaccagccccaaucgaaaaaacaauaucaaaagcaaaaggucaaccaagagaaccccaaguauauacacuaccaccaucaagagacgaauuaacuaaaaaucaaguaucucuaacaugccucgucaaaggauucuacccuuccgauauagccguagaaugggaaucaaauggacaaccagaaaacaacuauaaaaccacaccaccaguacuagacuccgacggauccuucuuccuauacucaaaauuaaccgucgacaaaucacgauggcaacagggaaacgucuucucauguucagucaugcacgaagcccuacacaaucacuacacccaaaaaucuuuaagucuaucaccaggaaaa

SEQ ID NO: 46343 - RNA, 642 nt, Artificial Sequence
  derived and/or modified sequence opt6 from Itolizumab_LightChain1
gacauacaaaugacccaaucacccucuagcuuaucagcaucaguaggagacagaguaacaauaacauguaaagcaucaagagacauaagaucauaccuaacaugguaccaacaaaaacccggaaaagcaccaaaaacccuaauauauuacgccacaucacuagcagacggaguacccucaagauucuccggauccggaucaggacaagacuacucacuaacuauauccucacuagaaucagacgacacagcaacauacuacugccuacaacacggagaaucaccauucacacuaggaucaggaacaaaacuagaaauaaaaagaacaguagcagcaccaucaguauucauauucccaccaucagacgaacaacuaaaaucaggaacagcaucaguaguaugccuauuaaacaacuucuacccaagagaagcaaaaguccaauggaaaguagacaacgcacuacaauccggaaacucacaagaaucaguaacagaacaagacagcaaagacucaacauacucacuauccucaacauuaacacuauccaaagccgacuacgaaaaacacaaaguauacgcuugcgaaguaacacaccaaggccuaucaucacccguaacaaaauccuucaaccgaggagaaugc

SEQ ID NO: 46344 - RNA, 1335 nt, Artificial Sequence
  derived and/or modified sequence opt6 from Ixekizumab_HeavyChain1
caaguacaacuuguucaauccggagcggaagucaaaaaaccaggcucaagcgucaaaguuucauguaaagcaagcgguuauucauucacagauuaucacauucacuggguaagacaagcaccuggacaaggacuagaauggaugggaguaauuaauccaauguacggaaccacagacuauaaccaacgauuuaaaggaagaguaaccauaacagcagacgaaucaacaucaacagcauauauggaacucaguucauuaagaucagaagauacagcaguuuauuacugcgcaagauaugauuauuuuacaggcaccggaguauauuggggacaaggaacauuaguaacaguuucaagcgccucaacaaaaggacccuccguauucccauuagcaccaugcucaagaucaacauccgaaucaacagcagcauuaggaugucuagucaaagauuauuuuccagaaccuguaacaguauccuggaacucaggagcuuuaacuucaggaguacacacauucccugcagucuuacaaucauccggacuauauucauuaucauccgucguuacaguaccaucaucuucucuaggcacuaaaacauauacaugcaacguugaccacaaacccucaaacacaaaaguagacaaaagaguugaaucaaaauacggaccaccaugcccaccaugccccgcaccagaauuccuaggaggaccuucaguauuucuauuuccaccaaaaccaaaagacacacuaaugauaucacgaacaccagaaguaacaugcguaguaguagaugucucacaagaagauccagaaguucaauuuaacugguauguagauggaguagaaguccauaacgcaaaaacaaaaccaagagaagaacaauuuaacuccacauacagaguaguaucaguauuaacuguacuacaccaagacuggcuaaacggaaaagaauauaaauguaagguauccaacaaaggacuacccucaucaauagaaaaaacaauaagcaaagcaaaaggacaaccucgagaaccacaaguauauacauuaccaccuucacaagaagaaaugacuaaaaaccaaguaucuuuaacaugccuaguaaaaggauucuauccuucugauauagcugucgaaugggaaagcaacgggcaaccagaaaauaacuauaaaaccacaccaccaguauuagacuccgacggaagcuucuuucuauauagcagauuaacaguagacaaaucacgauggcaagaaggaaauguauucaguuguucuguaaugcaugaagcacuccauaaccauuauacucaaaaaucauuaucacuaucuuuaggc

SEQ ID NO: 46345 - RNA, 657 nt, Artificial Sequence
  derived and/or modified sequence opt6 from Ixekizumab_LightChain1
gacauaguaaugacacaaacaccccuaucacuaucaguaacaccaggacaaccagcauccauaucauguagaucaucacgaucacuaguacacucacgaggaaacacauaccuacacugguaccuacaaaaaccaggacaaucaccacaacuauuaauauacaaaguuucuaacagauucauaggaguaccagacagauucucaggaucaggaucaggaaccgacuucacacuaaaaauaucacgaguagaagcagaagacguaggaguauacuacugcucacaaucaacccaccuaccauucacauuuggacaaggaaccaaacuagaaauaaaacgcacuguagcagcaccaucaguuuucauauucccaccaucagacgaacaacuaaaaucaggaacagcuucaguaguaugccuacuaaacaacuucuacccacgagaagcaaaaguacaauggaaaguagauaaugcauuacaaucaggaaacucacaagaauccguaacagaacaagacucaaaagacucaacauacucacuaucaucaacacuaacccuaucaaaagcagacuacgaaaaacacaaaguauacgcaugcgaaguaacacaccaaggacuaucaucaccaguaacaaaaucauucaacagaggagaaugc

SEQ ID NO: 46346 - RNA, 1347 nt, Artificial Sequence
  derived and/or modified sequence opt6 from Labetuzumab_govitecan_HeavyChain1
gaaguucaauuaguagaaucagguggaggaguuguacaaccaggaagaagucuaagacuuucuuguucagcaucaggauuugacuucacaaccuacuggaugucauggguacgacaagcaccaggaaaaggacuugaauggauaggcgaaauacacccagacuccucaacuauuaacuacgcaccuucacuaaaagacagauucacaauaucacgagacaaugcaaaaaauacccuuuucuuacaaauggauucuuuaagaccagaagacaccggaguauauuucugcgccucuuuauacuucggauuuccaugguucgcauacuggggccaaggaacaccaguuacagucucaucugcuucaacuaaaggaccaucagucuuuccauuagcacccuccucuaaaucuacaucaggaggaacugcagcacuaggaugcuuaguaaaagacuacuucccagaaccaguuacaguauccuggaauucaggagcccuaacaucaggaguacacacauuuccagcaguacuucaaucaucaggauuauauucacucaguuccguaguaaccguaccaucuucuucacuaggaacacaaacauauauuugcaacgugaaccauaaacccucaaacacaaaagucgauaaaagaguagaaccaaaaucaugugauaaaacccacacuugccccccuugcccagcaccugaacuacuaggaggaccaucuguauuccucuucccaccaaaaccaaaagauacacucaugauaucaagaacacccgaagucacaugcguaguaguagauguaucacacgaagacccggaaguaaaauucaacugguacguugauggagucgaaguacacaacgcaaaaacaaaacccagagaagaacaauauaacucaaccuaccgaguaguaucaguccuaacaguacuucaccaagauuggcuaaacgguaaagaauacaaaugcaaaguuucuaacaaagcacuacccgcccccauagaaaaaaccaucuccaaagcaaaaggacaaccaagagaaccacaagucuacacacuaccaccaucucgagaagaaaugacaaaaaaccaaguaucauuaacaugccuugucaaaggauucuaccccucagacauagcaguagaaugggaaucaaacggccaaccagaaaacaacuacaaaacaacacccccaguucuugacucagacgguucauucuuucuauacucaaaacuaacaguugacaaauccagauggcaacaaggcaacguauucucaugcucaguaaugcacgaagcacuacacaaucacuauacacaaaaaucacuaucauuaucaccaggaaaa

SEQ ID NO: 46347 - RNA, 639 nt, Artificial Sequence
  derived and/or modified sequence opt6 from Labetuzumab_govitecan_LightChain1
gacauacaacuaacacaaucaccaucaucacuaucagccucaguaggagacagaguaacaauaacaugcaaagccucacaagacguaggcacauccguagccugguaccaacaaaaaccaggaaaagcaccaaaacuauuaaucuacuggacaucaacaagacacacaggaguaccaucaagauucucaggcucagguucaggaacagacuucacauucacaauaucaucacuacaaccagaagacaucgcaacauacuacugccaacaauacucacuauacagaucauucggacaaggaacaaaaguagaaauaaaaagaacaguagcagcacccucagucuucauauucccaccaucagaugaacaacuaaaaucaggaacagcauccguaguaugccuacuaaacaacuucuacccaagagaagccaaaguccaauggaaaguagacaacgcauuacaaucagguaacucacaagaaucaguaacagaacaagacucaaaagacucaacauacucacuauccucaacacuaacauuaucaaaagcagauuacgaaaaacacaaaguauacgccugcgaaguaacacaccaaggacuaucaucacccguaaccaaaucauucaacagaggagaaugc

SEQ ID NO: 46348 - RNA, 1341 nt, Artificial Sequence
  derived and/or modified sequence opt6 from Lambrolizumab_HeavyChain1
caaguacaacuaguacaaucaggugucgaaguuaaaaaaccuggagcgucaguaaaaguaaguugcaaagcuagcggauacacauuuacaaauuauuauauguauuggguaagacaagccccaggacaaggauuagaauggaugggagguauuaacccaucaaacggaggaacaaacuucaacgaaaaauucaaaaaucgaguaacccucacuacagauucaagcacaacaacagcauauauggaauuaaaaucacuccaauucgacgacacugcagucuacuauugugcuagaagagauuaccgauucgacaugggauuugauuauuggggccaaggaacaacaguaaccguaucaucagcuucaacaaaaggacccucuguauucccauuagcaccauguucaagaagcacaucagaaucaacagcagcacuaggaugcuuaguaaaagacuacuuuccagaaccugucacaguaucuuggaacucaggagcauuaaccuccggaguacacacuuucccagcuguauuacaaucuuccggacuauauucauuaucaucaguagucacagucccaucaucauccuuaggaacaaaaacauacacaugcaacguagaccacaaaccaucaaacacaaaaguagacaaaagaguagaaucaaaauauggaccaccaugccccccauguccggccccggaauucuuaggcggcccuucagucuucuuauucccuccaaaaccaaaagauacacuaaugauaucaagaacacccgaagucacaugcguaguaguagauguaucucaggaagauccagaaguccaauucaacugguacguagacggaguagaaguacacaaugcaaaaacaaaaccaagagaagaacaauuuaacucaacauaucgcguaguaucaguccuaacaguacuacaccaagauugguuaaacgguaaagaauacaaauguaaaguaucaaacaaaggauuaccaucaucaaucgaaaaaaccauaagcaaagcaaaaggacaaccaagagaaccacaaguauacacauuaccaccaucucaagaagaaaugacaaaaaaucaaguaucacuaaccugcuuagucaaagguuuuuacccaucagauaucgcaguagaaugggaaucuaauggacaaccagaaaacaauuacaaaacaacaccaccuguacuagacucagacggaaguuuuuuccuauacucacgccuaacaguagauaaaagcagauggcaagaaggaaacguauucucauguucaguaaugcacgaagcuuuacacaaucauuacacccaaaaauccuuaucauuaucacuaggaaaa

SEQ ID NO: 46349 - RNA, 654 nt, Artificial Sequence
  derived and/or modified sequence opt6 from Lambrolizumab_LightChain1
gaaauaguacuaacacaaucuccagcaacauuaagcuuaagcccaggagaaagagcaacauuaagcuguagagcaagcaaaggcguaucaacaucuggauacucuuacuuacacugguaccaacaaaaaccaggacaagcaccaagacuauuaauauaucuagcaucauaucuagaaagcggaguaccagcaagauucucaggaucaggaucaggaacagacuuuacauuaacaauaagcucauuagaaccagaagacuuugcaguauacuauugccaacacucaagagaccuaccacuaacauucggaggagguacaaaaguagaaauaaaaagaacaguagcagcaccaagcgucuucauauucccaccaucagaugaacaauuaaaaucaggcacagcaucaguaguaugcuuacuaaacaauuuuuacccaagagaagcaaaaguacaauggaaaguagauaacgcacuccaaucaggcaacucacaagaaucaguaacagaacaagauucaaaagacucaaccuauucacuaagcucaacacuaaccuuaagcaaagccgacuacgaaaaacauaaaguuuacgcaugcgaaguaacacaccaaggauuaagcucaccaguaaccaaauccuuuaacagaggagaaugc

SEQ ID NO: 46350 - RNA, 669 nt, Artificial Sequence
  derived and/or modified sequence opt6 from Lampalizumab_HeavyChain1
gaaguacaauuaguacaaucaggaccagaacuaaaaaaaccaggagcaucaguaaaagucagcuguaaagcaucaggauacacuuucacaaacuauggaaugaacuggguacgacaagcaccaggacaaggucuagaauggaugggauggauaaauacauauacaggagaaacaacauaugcagacgacuuuaaaggaagauuugucuuuucacuagacacaucaguaucaacagcauaucuacaaauaucaucacuuaaagcugaagacacagcaguauauuacugugaaagagaaggaggagucaacaauuggggacaaggaacacuaguaacuguaaguucagcaucaacaaaaggaccaaguguauuuccacuagcaccaucaucaaaaucaacaucaggaggaacagcagcacuaggaugucuaguaaaagauuacuuuccagaaccaguaaccguaaguuggaacucaggagcacuaacaucagguguacauacauuuccagcaguauuacaaaguucaggucuauauucguuaucaucagucguaacaguaccaagcucaucacuaggaacacaaacauauauauguaacguaaaccauaaaccaucaaacacuaaaguagauaaaaaaguagaaccaaaaucaugugacaaaacacauaca

SEQ ID NO: 46351 - RNA, 642 nt, Artificial Sequence
  derived and/or modified sequence opt6 from Lampalizumab_LightChain1
gacauacaaguaacacaaucaccauccucacuaagcgcaucaguaggagaccgaguaacaauaacaugcauaacaucaacagacauagacgaugacaugaacugguaccaacaaaaaccaggaaaaguacccaaacuccuaauaucaggaggaaacacgcuaagaccaggaguaccaucaagauucucaggaucaggaucaggaacagacuucacacuaacaauauccucacuacaaccugaagacguagcaacauacuacugccuacaaucagacucacuaccauacacauucggacaaggaacaaaaguugaaauaaaaagaacaguagccgcaccaucaguauucauauucccaccaucagacgaacaacuaaaaucaggaacagcauccgucguaugcuuacuaaacaacuucuacccacgagaagcaaaaguacaauggaaagucgauaacgcauuacaaucaggaaacucgcaagaaucaguaacagaacaagacuccaaagacucaaccuacucacuaucaucaacacuaacacuaucaaaagcagacuacgaaaaacacaaaguauaugcaugcgaagucacacaccaaggcuuauccucacccguaaccaaaucauucaacagaggagaaugc

SEQ ID NO: 46352 - RNA, 1353 nt, Artificial Sequence
  derived and/or modified sequence opt6 from Lanadelumab_HeavyChain1
gaaguacaacuacuagaaucaggaggaggacuaguacaaccaggugguucacuuagauuaucaugcgcagcuucugguuuuacauucucacacuacauaaugauguggguaagacaagccccaggaaaaggacuagaauggguaucaggaaucuauuccucuggaggaauaacaguauacgcagauuccguaaaaggaagauuuacaauaucaagagauaacucaaaaaacacacucuauuuacaaaugaacagucuuagggcagaagacacagcaguauacuacugcgccuacagacgaauaggaguaccaagaagagacgaauucgauauauggggacaaggaacuaugguuacaguaucaucagcaucaacaaaaggacccucaguauuuccccuagcucccucaucaaaaucaacaucaggaggaacagcagcuuuaggaugccuuguaaaagauuauuucccagaaccaguaacaguaucauggaauucuggagcuuuaacaucaggaguacacacuuuuccagccguucuacaauccucaggauuauacucuuuaucuucaguaguaacagucccaagcucaucauuaggaacacaaaccuacauauguaacguaaaucauaaaccaucaaacacuaaagucgacaagagagucgaaccaaaauccugcgauaaaacucacacaugccccccauguccagcaccagaacuauuaggcggaccaucaguauuucuauucccucccaaaccaaaggauaccuuaaugauaucaagaaccccagaagucacaugcguaguuguagauguaucacaugaagacccugaaguaaaauucaacugguacguugauggcguagaaguacacaacgccaaaaccaaaccaagagaagaacaauacaacucaacauacagaguaguaaguguauuaacaguauuacaucaagacuggcuaaauggaaaagaauauaaauguaaaguaucaaacaaagcacuaccagcaccaauagaaaaaacaauuuccaaagcuaaaggacaaccaagagaaccccaaguauacacacucccacccucaagagaagaaaugacaaaaaaucaaguaucccuuacaugccuaguaaaaggauuuuauccaucagauauagcaguagaaugggaaucuaacggacaaccggaaaacaacuauaaaacaacaccaccaguacuagauucagauggaucauuuuucuuauacucaaaacucacaguagauaaaucaagauggcaacaagggaacguauuuucaugcucaguaaugcacgaagccuuacacaaccauuacacacaaaaaucauuaucacuauccccagga

SEQ ID NO: 46353 - RNA, 639 nt, Artificial Sequence
  derived and/or modified sequence opt6 from Lanadelumab_LightChain1
gacauacaaaugacacaaucacccucaacauuaucugcaucagucggagacagaguaacaauaacaugcagagccucacaaucaauaucaagcuggcuagcaugguaucaacaaaaaccaggaaaagccccuaaauuacuaauauacaaagcaucaacauuagaaucaggagucccaucaagauucuccggaucaggaucaggaaccgaauucacacuaacaauaucaagccuacaaccagacgacuucgcaacauacuacugccaacaauacaacacauacuggaccuucggacaaggaaccaaaguagaaauaaaaagaacaguagcagcaccaucaguauucauauuuccaccaucagaugaacaacuaaaaucaggcaccgcaucaguaguaugccuauuaaacaacuucuacccaagagaagcaaaaguacaauggaaaguagacaacgcauuacaaucaggaaacucacaagaaucaguaacagaacaagacucaaaagacucaacauacucacuaucaucaacacuaacauuaucaaaagcagacuacgaaaaacauaaaguauacgcaugcgaaguaacacaccaaggacuaucaucaccaguaacaaaauccuucaauagaggagaaugc

SEQ ID NO: 46354 - RNA, 1317 nt, Artificial Sequence
  derived and/or modified sequence opt6 from Landogrozumab_HeavyChain1
gaaguacaacuaguagaaucaggaggaggauuaguacaaccaggagguucauuaagacuaucaugugcagcaucugguuuaacauuuaguagauauccuaugucauggguaagacaagcaccagguaaaggccuaguuuggguauccgccauaacaucaucuggaggaucaacuuacuauucagauacuguuaaaggccgauuuacaauuucaagagauaacgcaaaaaacacuuuauaccuacaaaugaauucauuaagagcagaagacacagcaguauacuauugugcuagacugccugacuauuggggacaagguacacucguaacaguaucuuccgcaucaacaaaaggaccauccguauuuccauuagcacccugcucccgaagcacaucugaaucuacugcagccuuaggauguuuaguaaaagauuacuuuccagaacccguuacaguaucauggaacucuggagcacucaccucugguguccauacauuuccugcaguuuugcaaucaucaggccuauacucuuuaucuucaguaguaacaguaccauccucuucauuaggaaccaaaacauauacaugcaacguugaccauaaacccucuaacacgaaaguugacaaaagaguagaaucaaaauacggcccaccuugcccaccuuguccagccccagaauucuuaggaggcccaucuguauuuuuauucccaccuaaaccuaaagacaccuuaaugauaucaagaacaccagaaguuacaugcguagucguagauguaucacaagaagauccagaaguacaauucaacugguacguugacggaguagaaguacacaaugccaaaacaaaacccagagaagaacaauuuaacuccacuuaccgaguuguuucaguauuaacaguacuucaccaagauugguuaaauggaaaagaauacaaauguaaaguuuccaauaaaggauuaccaucaucaauagaaaaaacuauaucaaaagcuaaaggacaaccacgagaaccacaaguauauaccuuaccaccuucucaagaagaaaugacaaaaaaucaaguuucauuaaccugucuaguaaaaggcuuuuacccaucagauauugcaguagaaugggaaucaaacggacaaccugaaaauaauuauaaaacaaccccuccaguacuagauucagauggaucauucuuucuauacucaagacuaacaguagauaaaucucguuggcaagaaggaaacguauuuucaugcucagucaugcaugaagcucuccauaaccauuauacucaaaaaucauuaucacucucauuagga

SEQ ID NO: 46355 - RNA, 645 nt, Artificial Sequence
  derived and/or modified sequence opt6 from Landogrozumab_LightChain1
gaaauaguacuuacacaaucaccaggaacacuaucacuaucaccaggagaacgagcaacacuuuccugcagagcaucaucaucaguaucaucaucauaccuacacugguaccaacaaaaacccggacaagcaccaagauuacuaauauacucaacaucaaaccuaguugcaggaauaccagacagauucucaggaucaggcuccggaaccgacuucacacuaacaauaucaagacuagaaccagaagacuucgcaguauacuacugucaacaccacucaggauaccacuucacauucggaggaggaacaaaagucgaaauaaaaagaacaguagcagcacccucaguauucauauucccaccaucagaugaacaacuaaaaucaggcacagcaucaguaguaugccuacuaaacaacuucuauccuagagaagcaaaaguacaauggaaaguagacaaugcauuacaauccggaaauucccaagaaucaguaacagaacaagacucaaaagacucaacauacucacuaucaucaacauuaacacuauccaaagcagacuacgaaaaacacaaaguauacgcaugcgaagucacacaccaaggcuuaucaucaccaguaacaaaaucauucaacagaggcgaaugc

SEQ ID NO: 46356 - RNA, 1344 nt, Artificial Sequence
  derived and/or modified sequence opt6 from Laprituximab_emtansine_HeavyChain1
caaguacaacuaguacaaaguggcgcagaagucgcaaaaccaggagcuucaguaaaacuaucauguaaagcaucaggguacacuuucacaucauacuggaugcaauggguaaaacaaagaccuggacaaggacucgaauguauuggaaccauuuauccaggagauggugauacuacauacacccaaaaauuccaaggaaaagcuacacucacagcagacaaaucuuccucuacagcuuauaugcaacuaucaucacuacgaucugaagacuccgcaguauacuacugugcacgauaugaugccccaggauaugcaauggacuauuggggacaaggaacuuuaguaacaguaucaucagcuucuacaaaaggaccaagcguauucccauuagcuccaucaucuaaaucaacaucuggcggaacagcagcacuaggaugccuagucaaagacuauuucccagaaccaguaacaguaucuuggaacucaggcgcauuaacaucagguguacacacauucccagcaguacuacaaucaucaggauuauacucauuaucaucaguaguaacaguaccaucauccuccuuaggaacacaaacauacauaugcaacgucaaccauaaaccauccaauacaaaaguagauaaaaaaguagaacccaaaucuugugacaaaacacauacauguccuccauguccugcaccagaauuauuagguggaccauccguauuuuuauuuccaccaaaaccaaaagauacauuaaugauaucucgaacaccagaaguaacaugcguuguaguagacguaucacaugaagacccggaaguaaaauuuaacugguacgucgaugguguagaaguacauaacgcaaaaacaaaaccaagagaagaacaauacaauucaacauaucgcguaguuucaguacuaacaguacuacaucaagacuggcuaaauggcaaagaauacaaaugcaaaguaucaaauaaagcacuacccgcaccaauagaaaaaacuauaucuaaagccaaaggacaaccaagagaaccacaaguuuacacacuaccaccaucacgagaugaauuaacaaaaaaccaaguaagcuuaacaugccuaguuaaaggcuucuacccaucagacauagcaguagaaugggaaucaaacggccaaccagaaaacaauuauaaaacaacccccccuguacuagauucagacggaucauucuuucuauacuccaaauuaaccguagauaaauccagauggcaacaaggaaacgucuucucuuguucaguaaugcaugaagcacuacauaaccacuauacucaaaaaagcuuaagccuaucaccugga

SEQ ID NO: 46357 - RNA, 642 nt, Artificial Sequence
  derived and/or modified sequence opt6 from Laprituximab_emtansine_LightChain1
gacauacaaaugacacaaucacccuccuccuuaucagcaucaguaggagacagaguaacaauaacaugcagagcaucacaagacauaaacaacuacuuagcaugguaccaacacaaaccaggaaaaggaccaaaacucuuaauccacuacacaucaacauuacacccaggaauaccaucaagauucucaggaucaggaucaggaagagacuacucauucucaauauccucacuagaaccagaagacauagcuacauacuacugccuacaauaugacaaccuacuauacacauucggacaaggaacaaaauuagaaauaaaaagaacagucgcagcaccauccguauucauauucccaccaucagacgaacaacuaaaaucaggaacagcaucaguaguaugccuacuaaacaacuucuacccaagagaagcaaaaguacaauggaaaguagacaacgcauuacaaucaggaaacucacaagaaucaguaacagaacaagacucaaaagacucaacauacucacuaucaucaacacuaacacuaucaaaagccgacuacgaaaaacacaaaguauacgcaugcgaaguaacacaccaaggacuauccucaccaguaaccaaaagcuucaacagaggagaaugc

SEQ ID NO: 46358 - RNA, 1314 nt, Artificial Sequence
  derived and/or modified sequence opt6 from Lealesoab_HeavyChain1
caaguacaacuacaagaaucaggaccagaauuaaaaaaaccaggugaaacaguaaagauaucaugcaaagccucaggauacacauuuagaaacuauggaaacugggucaaacaagcaccaggcaaaggacuaaaauggggauggauaaacacauacacaggcgaacccacauacgcagaugauuuuaaaggacgcuucgcauucucacuagaaacaucagcaucaacagcauaccuacaaauuaacaacguaaaaaacgaagauacagcaaccuacuucugcgcaagaaaaggaugggauuuuaacggaucaucacuugacuacuggggacaaggaaccacaguaacaguaucaucugcaaaaacaacccccccaucuguauacccauuagcaccaggauccgcagcccaaacuaacagcguaacauuaggcugccuaguaaaaggcuacuucccagaaccagucacagucacauggaauucuggaucacuaucuuccggcguucauacauuuccagcaguacuacaaucugauuuauacacacuaucauccucaguaaccguaccaaguuccccaagaccaucagaaaccguaacaugcaacguagcacauccagcaucaucaacaaaaguugacaaaaaaaucguaccaagagauugcggaugcaaaccaugcauaugcacagucccagaaguaucauccgucuuuauuuuuccaccuaaaccaaaggacguauuaacaauaacauuaacaccaaaaguaacauguguaguaguagacauaagcaaagacgacccagaaguccaauucuccugguucguugacgacguagaaguccacacagcccaaacacaaccaagagaagaacaauuuaacucaacauucagaucagucucagaauuaccaauacaccaagacuggcuaaacggcaaagaauucaaaugcagaguaaacuccgcagcauucccagcaccaauagaaaaaacaauaagcaaaacaaaaggaagaccaaaagcuccacaaguauacacaauacccccaccaaaagaacaagcuaaagacaaaguuucacuaacaugcauaaccgauuuuuucccagaagauauaacaguagaauggcaauggaacggacaaccagcagaaaauuauaaaaacacacaaccaaucaacaccaauggauccuacuuuguauacucaaaauuaaacguacaaaaaucaaacugggaagcaggaaauacauuuaccuguucaguauuacacgaaggacuacauaaccaucauacagaaaaaucacuaucccacucaccaggcaaa

SEQ ID NO: 46359 - RNA, 654 nt, Artificial Sequence
  derived and/or modified sequence opt6 from Lealesoab_LightChain1
gacauacaacuaacacaaacaccacuaucacuaccaguaagccuaggagaccaagcaucaauaucaugcagaucaucacaaucaauaguacauucaaacggcaacacauaccucgaaugguaccuacaaaaaccaggucaauccccaaacuuacuaauauacaaaguaucaaacagauucucaggaguaccagacagauucucaggcucaggaucaggaaccgauuucacauuaaaaauaucacgaguagaagcagaagaccuuggaguauacuacugcuuccaaggaucacacguaccaccaacauucggaggaggaacaaaacuagaaauaaaacgagccgacgcagcaccaacaguaucaauauucccaccaucaucagaacaacuaacaucaggaggagcaucaguaguaugcuuccuaaacaacuuuuacccaaaagacauaaacguaaaauggaaaauagacggaucagaaagacaaaacggaguacuaaacucauggacagaccaagacucaaaagauucaacauacucaucauccacacuaacacuaacaaaagacgaauacgaacgccacaacucauacacaugcgaagcaacacacaaaacaagcacaucaccaauaguaaaaucauucaacagaaacgaaugc

SEQ ID NO: 46360 - RNA, 1335 nt, Artificial Sequence
  derived and/or modified sequence opt6 from Lebrikizumab_HeavyChain1
caaguaacacuaagagaauccggccccgcccucguaaaaccaacacaaacccuaacauuaacaugcacuguaucaggcuucucucuuucugcauacucaguaaacuggauaagacaaccaccaggaaaagcauuagaaugguuagcaaugauauggggagacggcaaaauaguauacaacagcgccuuaaaaagccgccuaacaauaucaaaagauacaucaaaaaaccaagugguauuaaccaugacaaauauggauccaguagacacagccacauacuacugcgcaggagacggauauuacccauacgcuauggacaacuggggacaaggaaguuuaguaacaguaucaucagcaucaacaaaaggacccucaguauucccacucgcaccaugcucaagaucaacuagugaaucaacagcugcauuaggaugcuuagucaaagauuauuuuccagaaccagucaccguuucuuggaauucaggagcccuaacgucgggaguacacaccuucccagccguccuacaaucaucaggucuauacuccuuaucaucuguagucacaguuccaucuucaucauuagguacaaaaacauacacaugcaacguagaccacaaaccauccaauacaaaaguagacaaacgcguagaaucuaaauacggaccaccaugccccccaugcccagcaccugaauuccuaggaggaccaucaguauuccuauucccaccaaaaccaaaagacacuuuaaugauaucaagaacaccagaagucaccugcguagucgucgacgucucacaagaagauccagaaguacaauucaacugguauguagacgguguagaaguccauaaugcaaaaacaaaaccaagagaagaacaauucaauucaacauacagaguagucucaguucuaacagucuuacaccaagacuggcuaaacggaaaagaauacaaaugcaaaguaucaaacaaaggauuacccucuuccauagaaaaaacaauaucuaaagccaaaggacaaccuagagaaccucaaguauauacauuaccaccaucacaagaagaaaugaccaaaaaccaaguauccuuaacauguuuaguaaaaggauuuuauccaucagacauagcaguugaaugggaauccaacggacaacccgaaaacaauuauaaaacuacaccaccaguacucgacucggauggauccuuuuuucuauacucacguuuaacaguagauaaaagccgauggcaagaaggaaauguauucucaugcucagucaugcacgaagcuuuacacaaccacuacacucaaaaaucacuaucauuaucacucggaaaa

SEQ ID NO: 46361 - RNA, 654 nt, Artificial Sequence
  derived and/or modified sequence opt6 from Lebrikizumab_LightChain1
gauauuguaaugacacaaucacccgauagccuaucaguaagcuuaggcgaaagagcaacaauaaacugcagagcaagcaaaagcguagacucauacgggaacucauucaugcacugguaccaacaaaaaccaggacaaccaccaaaauuauuaauauaucuagcaaguaaccuagaaagcggaguaccagacagauucucaggaucaggaucaggaacagacuuuacuuuaacaauaagcucacuucaagcagaagacguagcaguauacuauugccaacaaaacaaugaagacccacgaacauuuggaggaggaaccaaaguagaaauaaaaagaacaguagcagcaccaagcgucuucauauuuccaccaucagacgaacaauuaaaaucaggaacagccucaguaguaugcuuacucaauaacuuuuacccaagagaagcaaaaguacaauggaaaguagacaacgcauuacaaucaggaaacucacaagaaucaguaacagaacaagauucaaaagacucaacauacaguuuaaguucaacauuaacacuaagcaaagcagacuacgaaaaacauaaaguauaugcaugcgaagucacacaccaaggcuuaagcucacccguaacaaaaaguuuuaacagaggagaaugc

SEQ ID NO: 46362 - RNA, 1227 nt, Artificial Sequence
  derived and/or modified sequence opt6 from Lenercept_chain1
cuaguaccacaccuaggagacagagaaaaaagagacucaguauguccacaagguaaauacauacacccucaaaacaacuccauaugcugcacaaaaugucacaaaggaacauaccuauauaacgacugcccaggaccaggacaagauacagacugcagagaaugcgaaucaggcucauucacagcuucagaaaaucacuuaagacacugcuuaucaugcucaaaaugcagaaaagaaaugggccaagucgaaauauccucaugcaccguugauagagacacaguauguggauguagaaaaaaccaauauaggcauuacuggucagaaaacuuauuccaaugcuucaauugcucccuaugccuaaauggaaccguacaccuauccugccaagaaaaacaaaacacaguaugcaccugucacgcuggauucuuccuaagagaaaacgaaugcgucucaugcagcaacugcaaaaaaucauuagaaugcacaaaacucugucuaccacaaauagaaaacguaaaaggaaccgaagacucaggaacaaccgacaaaacucauacaugccccccaugcccagcacccgaacuacuaggaggaccaagcguauuucucuucccaccaaaaccaaaagauacacucaugaucucccgcacaccagaaguaacauguguuguaguagauguaucacacgaagacccagaagucaaauucaacugguaugucgacggcgucgaaguacauaacgcaaaaacaaaaccaagagaagaacaauacaacuccacauaccgcguaguaucaguacucacaguacuacaccaagacuggcuaaacggcaaagaauacaaauguaaaguaagcaacaaagcauuaccagcaccaauagaaaaaaccauaucaaaagccaaaggacaaccaagagaaccccaaguauacacauuaccaccaucaagagaagaaaugaccaaaaaccaagucucccuaacaugucucguaaaaggcuucuauccaucagacauagcaguagaaugggaaucaaauggccaaccugaaaacaacuacaaaacaacuccaccaguacuagacucagacggcuccuucuuuuuauauucaaaacuaacaguugauaaaucaagguggcaacaaggcaacgucuuuuccugcucaguaaugcacgaagccuuacacaaucauuacacacaaaaaucacuaucacuaucaccagguaaa

SEQ ID NO: 46363 - RNA, 1347 nt, Artificial Sequence
  derived and/or modified sequence opt6 from Lenzilumab_HeavyChain1
caaguacaauuaguacaauccggugcagaaguaaaaaaacccggagcauccguaaaagucucaugcaaagcaucaggauacucuuucacaaacuacuacauccauuggguaagacaagcacccggucaaagacucgaauggauggguuggauaaaugcaggaaacggaaacacaaaauauucacaaaaauuccaaggaagaguaacaauaacaagagacaccucagcaucaacagcauacauggaacuaucaucccucagaucagaagauacagcagucuacuacuguguuagacgacaacguuucccauacuacuucgacuacuggggacaaggaacacuaguuacagucucaucagcaucaacaaaaggcccuuccgucuucccacucgcaccauccucaaaaucaacauccggaggaacagcagcacucggaugccuaguaaaagauuacuuuccugaaccaguaaccguaucauggaauucuggcgcucuaacuuccggaguacacacauuccccgcaguacuacaaucaucaggcuuauacucccuuucaucaguagucacaguacccucaucaucacuuggcacacaaacauacauaugcaacguaaaccacaaaccaucuaacaccaaaguagauaaaagagucgaaccuaaaucuugcgacaaaacucacaccugccccccaugcccagcaccagagcuauuagguggccccucaguauuccuauucccaccaaaaccuaaagacacacucaugauaucaagaacacccgaaguaacauguguaguaguugacguaucccacgaagauccagaaguaaaauucaacugguaugucgacggaguugaaguacauaaugcaaaaacuaaaccacgagaagaacaauacaacucaacauacagaguaguaucaguauuaacaguccuucaccaagacugguuaaauggcaaagaauacaaaugcaaaguaucaaacaaagcauuaccagcaccuauagaaaaaacaaucuccaaagcaaaaggccaacccagagaaccacaaguauauacacuaccaccaucaagagaagaaaugacuaagaaccaaguaucucucacaugccuagucaaaggauuuuacccaucagacauagcaguagaaugggaaucaaauggacaaccugaaaacaauuacaaaacaaccccaccagucuuagacucagaugguuccuucuuccuauauucaaaacucacaguagacaaaucaagauggcaacaaggcaacguauucucaugcucaguaaugcacgaagcacuucauaaccauuacacacaaaaaucauuaucacuaucaccaggaaaa

SEQ ID NO: 46364 - RNA, 642 nt, Artificial Sequence
  derived and/or modified sequence opt6 from Lenzilumab_LightChain1
gaaaucguacuaacacaaucaccagcaacauuaucaguaucaccaggagaaagagcaaccuuaucaugcagagcaucccaaucaguaggaacaaacguagcaugguaccaacaaaaaccaggacaagcaccaagagucuuaauauacucaacaucaucaagagcaacaggaauaacagacagauucuccggauccggaucaggaacagacuucacacuaaccauaucaagacuagaaccagaagacuucgcaguauacuacugccaacaauucaacaaaucaccacuaacauucggaggaggaacaaaaguagaaauaaaaagaacaguagcagccccaagcguauucauauucccaccaucagacgaacaauuaaaaucaggaacagcaucaguaguaugccuacuaaacaacuucuaccccagagaagcaaaaguacaauggaaaguagacaacgcacuacaaucaggaaacucacaagaaucaguaacagaacaagacucaaaagacucaacauauucacuaucauccacccuaacacuaagcaaagcagacuacgaaaaacacaaaguauacgcaugugaaguaacacaccaaggacuaucaucaccaguaacaaaaucauucaacagaggagaaugc

SEQ ID NO: 46365 - RNA, 1326 nt, Artificial Sequence
  derived and/or modified sequence opt6 from Lerdelimumab_HeavyChain1
gaaguacaacuaguagaaucaggaggaggaguaguacaaccaggaagaucuuuaagacuaucaugugcggcaagcggauucaccuuuagcaguuacggaaugcacuggguaagacaagcacccggaaaaggauuagaauggguagcaguaauaugguacgauggaucaaauaaauacuaugcagacucagucaaaggaagauucacaauaaguagagauaauagcaaaaacacccuauauuuacaaauggacucacuaagagcagaagauacagcaguuuauuauugcggacgaacauuagaaucaucacuuuggggacaaggaacccuaguuacaguaucauccgcuagcaccaaaggaccaucaguauucccauuagcuccaugcaguagaaguaccucagaaucaacagcugcauuagguugucuaguaaaagauuauuuuccagaaccaguaacaguaaguuggaacuccggagcauuaacaaguggaguacauacuuucccagcaguacuacaaagcucaggucuauauucacucucaucaguaguaacagucccaucauccagccuaggaacaaaaacauauaccuguaacguagaccacaaaccuuccaacacaaaaguagauaaacgaguagaaucaaaauauggaccaccuuguccuucauguccagcuccagaauucuuaggaggaccaucaguauuuuuauucccaccaaaaccaaaagauacauuaaugauaucaagaacccccgaaguaacaugugucguuguagauguaucucaagaagacccagaaguacaauuuaacugguauguagauggaguagaaguacauaacgcaaagacaaaacccagagaagaacaauuuaauuccacauaccgaguagucucaguauuaacuguauuacaucaagauuggcuaaauggaaaagaauauaaauguaaaguaagcaauaaaggucuaccuaguucaauagaaaaaacaauaucaaaagcaaaaggacaaccaagagaaccacaagucuauacauuaccaccaagccaagaagaaaugacaaaaaaucaaguaucccuaacaugccucguaaaaggauuuuauccaucagacauagcaguagaaugggaaucuaacggacaaccagaaaauaauuauaaaacaacaccaccuguauuagacucagauggaucauucuuucuauauagcagacuaacagucgauaaaucacgauggcaagaaggaaacguauucucauguucaguaaugcacgaagcucuacacaaucacuacacacaaaaaagcuuaucauuaucacuaggcaaa

SEQ ID NO: 46366 - RNA, 645 nt, Artificial Sequence
  derived and/or modified sequence opt6 from Lerdelimumab_LightChain1
ucaucagaacuaacacaagacccagcaguaucaguagcacucggucaaaccguaagaauaacaugccaaggagacuccuuaagaucauacuacgcuucaugguaccaacaaaaaccaggacaagcaccaguacuaguaaucuacggaaaaaacaacagaccaucaggaauaccagacagauucucaggaucaucuucaggaaacacagcaucacuaacaaucacaggagcacaagcagaagaugaagcagacuacuacugcaauucaagagacucaucaucaacacacagaggaguauucggcggaggaacaaaacuaacaguauuaggacaaccaaaagcagcaccaucaguaacacuauucccaccauccuccgaagaauuacaagcaaacaaagcaacauuaguaugccuaauaucagacuucuaccccggcgcaguaacaguagcauggaaagcagacucaucaccaguaaaagcaggaguagaaacaacaacaccaucaaaacaaucaaacaacaaauacgcagcaucaucauaccuaucacuaacaccagaacaauggaaaucacacagaucauacucaugucaaguaacacacgaaggaucaacaguagaaaaaacaguagcaccaacagaaugcucc

SEQ ID NO: 46367 - RNA, 1353 nt, Artificial Sequence
  derived and/or modified sequence opt6 from Lexatumumab_HeavyChain1
gaaguacaauuaguacaaagcggcggaggaguagaaagaccaggaggaagucuuagacuaucaugcgccgccucaggauuuacauucgacgacuacggaaugagcuggguacgacaagcccccggaaaagguuuagaauggguaucaggaauaaauuggaauggaggaucaacaggcuacgcagacucaguuaaaggaaggguuacaauaucuagagacaaugcaaaaaacuccuuauaucuacaaaugaauaguuuaagagccgaagauacagcuguauauuacugugcaaaaauccuaggugcaggacgaggaugguacuuugauuuaugggguaaagguacaacaguaacagucucuucugccagcacgaaaggaccaucaguauuccccuuagcaccaaguucaaaaucaacaucuggcggaacugcugccuuaggauguuuaguuaaagauuacuuuccagaaccaguaaccguaucuuggaacaguggagcuuuaacaagcggcguacauacuuuuccagcaguauuacaaagcucaggacuauacucacuaaguaguguaguaacaguaccaaguucaucacucggcacacaaacuuauauaugcaacguaaaucacaaaccaaguaauacaaaaguagacaaaagaguagaaccaaaaucaugugacaaaacacauacauguccuccaugccccgcaccagaacugcuaggaggaccaucaguauuccuauuccccccaaaaccaaaagacacauuaaugauauccagaacuccagaaguaacaugcguaguaguagacguaucccaugaagauccagaaguaaaauucaauugguaugucgauggaguagaaguacacaaugcaaaaacaaaaccaagagaagaacaauauaauaguacauauagaguaguaucagucuuaacaguauuacaucaagacuggcuuaauggcaaagaauauaaauguaaagucaguaacaaagcacuuccagccccaauagaaaaaacaauauccaaagcaaaaggacaaccaagagaaccucaaguuuacacgcuaccaccaucaagagaagaaaugacaaaaaaccaaguaucucucacaugcuuagucaaaggcuuuuacccaucagacauagcagucgaaugggaaucaaauggacaaccagaaaacaacuacaaaacaacuccaccuguauuagacucugaugguucauuuuucuuauauucaaaauuaacaguugauaaaucacgauggcaacaaggaaacguauuuucaugcagugucaugcacgaagcccuacauaaccacuauacacaaaaaucacuaagucuaucaccaggaaaa

SEQ ID NO: 46368 - RNA, 1353 nt, Artificial Sequence
  derived and/or modified sequence opt6 from Lexatumumab_HeavyChain
gaaguacaauuaguacaaucaggaggaggagucgaacgaccaggaggaucauuaagauuaucaugugcagcaagcggauuuacauuugaugacuauggaaugagcugggucagacaagcuccaggaaaaggcuuagaauggguaucagguauaaauuggaauggcggaucaacaggauacgcagauaguguuaaaggaagaguaacuauaucaagagacaaugcaaaaaauagucuauaccuccaaaugaauucccuaagagcagaagauacagcuguauacuauugugcaaaaauccuaggagcaggaagaggaugguacuucgaucuauggggaaaagguacaacagucacagucagcucagcuucaacaaaaggaccaucaguuuuuccacuugcaccaucaucaaaaucaacauccggaggaacugcagcacuuggauguuuaguaaaagauuacuucccagaacccguaacaguaucauggaacucaggagcucuaaccucgggaguacauaccuuucccgcaguuuuacaaagcagcgggcuauauagucuaucaucaguaguaacaguccccagcucaagcuuaggaacacaaacuuacauauguaacguaaaccauaaaccaucaaauacuaaaguagauaaaagaguagaacccaaaucaugcgacaaaacacauacauguccuccaugcccagcuccagaacuacuaggaggaccuagcguauuucucuucccuccaaagccaaaagacacacuaaugauaucaagaacaccagaaguaacaugcguuguaguagauguaucacacgaagauccagaaguaaaauucaacugguauguagacggaguugaaguacacaaugcaaaaacaaaaccaagagaagaacaauauaauucaacauauagaguagucucuguacuaaccguacuacaucaagauuggcuaaaugguaaagaauacaaaugcaaaguuucuaacaaagcauuaccagcaccuauagaaaaaaccauaaguaaagcuaaaggacaaccacgagaaccacagguauacacauuaccuccaucaagagaagaaaugacaaaaaaccaagucucucucacaugccuaguaaaaggauucuauccaucagacauagcaguagaaugggaaaguaacggacaaccugaaaacaacuauaaaacaacaccaccuguauuagacucagauggaaguuuuuuccuauacaguaaauuaacaguagacaaaucaagauggcaacaaggaaacguguuuucaugcucaguaaugcacgaagcacuccacaaucacuauacccaaaaaucacuaucauuaaguccaggaaaa

SEQ ID NO: 46369 - RNA, 642 nt, Artificial Sequence
  derived and/or modified sequence opt6 from Lexatumumab_LightChain1
ucuucagaauuaacacaagacccagcaguaucuguagcauuaggacaaacaguaagaauaacaugccaaggagacagcuuaagaucauacuacgccucaugguaccaacaaaaaccaggacaagccccaguacuaguaauauacggaaaaaauaacagaccaucaggaauaccagaccgauucagcggaucuucaagcggaaacacagccagucuaacaauaacaggagcacaagcagaagacgaagcagacuauuacugcaacucaagagacucaucaggaaaccacguaguauucggaggaggaacaaaacuaacaguacuaggacaaccaaaagcagcaccaucaguaacacuauuuccuccaucaucagaagaauuacaagcaaacaaagcaacacuaguaugcuuaauaucugacuucuacccaggagcaguaacaguagcauggaaagcagacucaucaccaguaaaagcaggaguagaaaccacaacaccaucaaaacaaucaaauaacaaauacgcagcaucaucuuaccuaucacuuacaccagaacaauggaaaucacacagaucauacucaugucaaguaacacacgaaggcucaacaguagaaaaaacaguagccccaaccgaaugcuca

SEQ ID NO: 46370 - RNA, 642 nt, Artificial Sequence
  derived and/or modified sequence opt6 from Lexatumumab_LightChain
ucaucagaacuaacucaagacccagcaguaucaguagcacuuggacaaacaguaagaauaacaugccaaggcgacucacuacgaucauacuacgcaucaugguaccaacaaaaaccaggacaagcaccaguauuaguaauauacggaaaaaacaacagaccaucaggaauaccagacagauucucaggaucaucaagcggcaacacagcaucacuaacaauaacaggagcacaagcugaagacgaagcagacuacuacugcaacucaagagacucaucaggaaaccacguaguauuuggcggaggaacuaaacuaacaguauuaggacaaccaaaagcagcaccaucaguaacauuauuccccccaucaucagaagaacuacaagcaaacaaagcaacacuaguaugccuaaucucagacuucuacccaggagcaguaacaguagccuggaaagcagacagcucaccaguaaaagcaggcguagaaaccacaacaccaucaaaacaaucaaacaacaaauacgcugcaucaagcuacuuaucacuaacacccgaacaauggaaaucacacagaucauacagcugccaaguaacacacgaaggaucaacaguagaaaaaacaguagcaccaaccgaaugcuca

SEQ ID NO: 46371 - RNA, 1377 nt, Artificial Sequence
  derived and/or modified sequence opt6 from Libivirumab_HeavyChain1
caaguccaauuaguagaaucaggaggaggaguaguaagaccuggcagaucacuacgacuaucaugugcagcauccggauucgcauucucagauuauucaauaaauuggguaagacaagcuccagguaaaggacuagaauggguagcaauaauaucuuaugauggaagaauaacuuacuaccgagacucaguaaaaggaagauuuaccauauccagagacgauucaaaaaauacccuauaucuccaaaugaauucacuaagaacagaagacaccgcuguauauuacugugccagacaauauuaugauuucuggucaggaucaagcguuggccgcaauuacgauggaauggacguauggggucuaggaacaacaguaacaguaucaucagccucaacaaaaggaccaucaguauuuccauuagcaccaucaucuaaaucaacaucaggaggaacagcagcacuaggaugucuaguaaaagauuacuuccccgaacccgucaccguauccuggaacucgggagcacuaacaucaggaguacauacauucccagcaguauuacaaucauccggucuauauagcuuaaguucaguaguaaccguaccuucaagcucauuaggaacacaaaccuacauaugcaaugugaaccacaaaccuucaaacacaaaaguagauaaaagaguagaaccuaaaucgugugacaaaacacauacaugcccaccuugcccagcaccagaauuacucggaggacccagcguuuuucuuuucccaccaaaaccaaaagacacacuaaugauaucaagaacacccgaaguaacaugcguuguaguagacguuagucaugaagauccugaaguaaaauuuaacugguaugucgauggaguagaaguucacaacgcaaaaaccaaaccuagagaagaacaauauaauucaacauacagaguuguaucuguccuuacaguauuacaccaagacugguuaaacgguaaagaauacaaauguaaaguaucaaacaaagcccuaccagcaccaauagaaaaaacaauaucaaaagcaaaaggacaaccacgagaaccccaaguauauacacuaccaccaucaagagaagaaaugacaaaaaaccaaguaucacuaaccuguuuaguaaaaggauucuacccaucagacauagcaguagaaugggaaaguaauggacaaccagaaaauaacuacaaaacaacaccaccaguacuagacucagacggaucauuuuuucuauacucaaaacucacaguagacaaaucaagauggcaacaaggaaacgucuucuccugcucaguaaugcaugaagcauuacacaaccacuauacacaaaaaucacuuucacucucaccaggcaaa

SEQ ID NO: 46372 - RNA, 657 nt, Artificial Sequence
  derived and/or modified sequence opt6 from Libivirumab_LightChain1
gacauaguaaugacacaaucaccauuaucauuaucaguaacaccaggagaaccagcuucaauaucaugcagaucaucacaaucucuacuacauagaucaggaaauaacuaccuagauugguaccuacaaaaacccggacacucaccacaacuacuaauauauguaggaucaaaccgagcaucaggaguaccagacagauucucaggaucaggaucaggaacagaauacacccuaaaaauaucaagaguagaagcagaagacguaggaguauacuacugcaugcaagcacuacaaacaccacgaacauucggacaaggaaccaaacuagaaauaaaaagaacaguagcugcaccaagcguauucauauucccaccaucagacgaacaauuaaaaucaggaacagcaucaguaguaugucuacuaaacaacuuuuacccaagagaagccaaaguacaauggaaaguagauaacgcacuacaaucaggaaacucucaagaauccguaacagaacaagacucaaaagauucaacauacucacuaucaucaacacucacacuaucaaaagcagacuacgaaaaacacaaaguauacgcaugcgaaguaacacaccaaggccuaucaucaccaguaaccaaaucauucaacagaggagaaugc

SEQ ID NO: 46373 - RNA, 1350 nt, Artificial Sequence
  derived and/or modified sequence opt6 from Lifastuzumab_HeavyChain
gaaguacaacuaguagaaucaggcggaggacuaguacaacccggcggauccuuaagacuauccugugcagcaagcggauuuucauuuucagauuucgcaaugucuuggguaagacaagcaccaggaaaaggacuagaauggguagcaacaauaggaagaguagcauuccacacauacuauccagauaguaugaaaggaagauucacuauuucuagagacaacucuaaaaacacacuauaccuccaaaugaacucacucagagcagaagacacagccgucuauuacugugcaagacacagaggcuuugacguaggacauuucgauuucuggggacaaggcacacucgucacagucucauccgcaucuacaaaaggcccaaguguuuucccccucgcaccaucaucaaaaucuacaucagguggaacagcagcauuaggaugccucgucaaagauuauuucccugaaccaguaacagucuccuggaacucaggagcucuaacaagcggaguucacacauucccugcaguauuacaaucuucaggacuauacucacuaucuucagucgucaccguaccaucaucaucauuaggaacacaaacauacaucuguaacguaaaccauaaaccaucaaacacuaaagucgacaagaaaguagaacccaagucaugugacaaaacacacaccugccccccaugcccagcacccgaauuacuaggaggaccaucaguuuuccuauuuccacccaaaccuaaagauacucuaaugauauccagaacaccagaaguaacaugcguaguuguagauguaucccacgaagaucccgaaguaaaauuuaacugguauguagacggcguagaaguacauaaugcaaaaaccaaaccaagagaagaacaauacaauucaacauacagaguaguaucaguacuaacugucuuacaccaagacugguuaaacggaaaagaauacaaaugcaaaguauccaauaaagcacucccagcacccauagaaaaaacaauaucaaaagccaaaggacaaccaagagaaccacaaguauauacauuaccaccaucaagagaagaaaugacaaaaaaccaaguaucccuaaccugccuaguaaaaggauuuuaccccucagauaucgcuguagaaugggaauccaauggacaaccugaaaacaacuauaaaacaacacccccuguauuagacucagauggaucauucuuccuauacucuaaacuaacaguagauaaaucacgauggcaacaaggaaacgucuucuccuguucaguaaugcaugaagcauuacauaaccauuauacucaaaaaucacuaucguuaucacccggaaaa

SEQ ID NO: 46374 - RNA, 657 nt, Artificial Sequence
  derived and/or modified sequence opt6 from Lifastuzumab_LightChain
gacauacaaaugacacaaucaccaucaucauuaucagcaucaguaggagacagaguaacaauaacaugcagaucaucagaaacauuaguacacucaucaggaaacacauaccuagaaugguaccaacaaaaaccaggaaaagcacccaaacuacuaauauauagaguaucaaacagauucucaggcguaccaucacgauuuuccggcucaggaucaggaacagacuucacacucacaauaucaucacuacaaccagaagacuucgcaacauacuacugcuuucaaggauccuucaacccauuaacauuuggacaaggcacaaaaguagaaauaaaaagaacaguagcagcaccaucaguauucauauuuccaccaucagaugaacaauuaaaaucaggaacagcaucaguaguaugucuacuaaacaacuucuacccaagagaagcaaaaguacaauggaaaguagacaacgcacuacaaucaggaaacucacaagaaucaguaacagaacaagacucaaaagacucaacauacucacucucaucaacacuaacccuaucaaaagcagacuacgaaaaacacaaaguauacgcaugcgaaguaacacaccaaggacuaucaucaccaguaaccaaaucauucaacagaggagaaugc

SEQ ID NO: 46375 - RNA, 1347 nt, Artificial Sequence
  derived and/or modified sequence opt6 from Lifastuzumab_vedotin_HeavyChain1
guacaauuaguagaaucaggaggaggacuaguacaaccaggcggcucacuacgacuaucaugcgccgcaucaggauucucauucagugauuucgccaugucauggguacgccaagcuccaggaaaaggauuagaauggguugcaaccauaggaagaguagcauuucacacauacuacccagacucaaugaaaggcagauuuacuauaucuagagauaacucaaaaaauacauuauacuuacaaaugaauucacuaagagcugaagacacagcaguauacuacugcgcccgccacagaggauucgauguaggacacuucgacuuuuggggccaaggaacacuaguaacagucuccucagcaucaaccaaaggaccuucaguauucccauuagcaccuucaucuaaaucaacauccggcggcacagccgcacuuggauguuuagucaaagacuacuuccccgaaccaguaacagucucauggaacucaggagcauuaacaucaggaguacacaccuuucccgcaguacuccaaucaagcggauuauauucucuaucuucaguaguaacaguaccaucaucuucacuaggaacccaaacauauauaugcaauguaaaucauaaaccaagcaacacaaaaguagacaaaaaagucgaacccaaaucaugcgacaagacacacaccugccccccuugcccagcaccagaacuuuuaggcggaccaucaguuuuccuauucccaccaaaacccaaagauacacuaaugauaucuagaacaccagaagucaccugcguaguaguagacguaucgcacgaagauccagaaguaaaauucaacugguaugucgacggaguagaaguacacaacgcaaaaaccaaaccacgagaagaacaguauaauuccaccuacagaguaguauccgucuuaacaguauuacaucaagacuggcuaaacggaaaagaauacaaaugcaaaguaucuaacaaagcacuaccagcaccaauugaaaaaacaauaucuaaagcaaaaggacaaccacgagaaccacaaguauacacauuaccaccaucaagagaagaaaugacaaaaaaccaagucucacuaacaugccuaguaaaaggauuuuauccaucugauauagcaguagaaugggaaucaaacggacaacccgaaaacaacuacaaaaccacaccaccaguauuagauucugacggaucauucuuccuauauucaaaacuaacuguagauaaaucuagauggcaacaaggaaacguauucuccugcucaguuaugcaugaagcuuuacacaaccacuacacacaaaaaucauuaucucuuucuccagguaaa

SEQ ID NO: 46376 - RNA, 657 nt, Artificial Sequence
  derived and/or modified sequence opt6 from Lifastuzumab_vedotin_LightChain1
gacauacaaaugacucaaucaccaucuucacucucagcaucaguaggagacagaguaacaaucacaugcagaucaucagaaacacuaguacacucaucaggaaacacauaccuagaaugguaccaacaaaaaccaggaaaagcaccaaaacuacuaauauacagaguaucaaacagauucucaggagucccaucaagauucucaggaucagguuccggaacagacuucacacucacaaucuccucacuacaaccagaagacuucgccacauacuacugcuuccaaggaucauucaacccacuaacauucggacaaggaacaaaagucgaaauaaaaagaacaguagcagcaccaucaguauucauauucccaccaucagacgaacaacuaaaaucaggaacagcaucaguaguaugcuuacuaaacaacuucuacccaagagaagcaaaaguccaauggaaaguagacaacgcacuacaaucaggaaacucacaagaaucagucacagaacaagacucaaaagacucaacauacucacuaucaucaacacuaacauuaucaaaagcagacuacgaaaaacacaaaguauacgcaugcgaaguaacacaccaaggacuaucauccccaguaacaaaauccuucaacagaggagaaugc

SEQ ID NO: 46377 - RNA, 1359 nt, Artificial Sequence
  derived and/or modified sequence opt6 from Ligelizumab_HeavyChain1
caaguacaauuaguccaauccggagcagaaguaaugaaacccggaucuucaguaaaaguuucaugcaaagcauccggcuacaccuucucaugguauugguuagaauggguccgccaagcaccuggccacggauuagaauggaugggagaaauugaucccggaacauucacaacaaacuacaacgaaaaauucaaagcacgagucacuuucacugcagacacuucaacaucaacagcauauauggaauuauccucacuacgauccgaagacacagccguauacuauugcgccagauuuucacacuucucaggaaguaacuacgacuauuuugauuacuggggucaaggcacauuaguaacaguaucaucagccucaacuaaaggucccucaguauucccacuagcacccaguucaaaaagcacaucaggaggaaccgcagcacuaggaugucucguaaaagacuacuucccugaaccaguaacaguuucauggaacucuggcgcacuaacaucagguguacacacauucccugcaguacuacaaagcucaggacuauacucacuaucaucaguuguaaccguaccaucaucaucgcuagggacucaaacuuacauaugcaacguaaaccacaagccgucaaacacaaaaguugauaaaaaaguagaaccaaaaucaugugauaaaacacacacaugucccccauguccagcaccagaacuauuagguggaccaucaguauuucuuuucccaccuaaacccaaagacacacucaugauauccagaacaccagaaguaacaugcguugucguagacguaucacacgaagacccagaaguaaaauucaauugguaugucgacggcguagaaguacauaaugcuaaaaccaaaccacgagaagaacaauacaacuccaccuacagaguaguaucaguacuaacaguacuacaccaagacuggcuaaacggaaaagaauacaaaugcaaaguuucaaacaaagcacucccagcaccaauagaaaaaacaauaucaaaagcaaaaggacaaccaagagaaccacaagucuauacacuacccccaucuagagaugaauuaacaaaaaaccaaguaucauuaacaugccuagucaaaggauucuauccauccgauauagcuguagaaugggaaucaaauggccaacccgaaaauaauuauaaaacgacaccaccaguauuagacucagacggcucauucuucuuauacuccaaauuaacaguagauaaaucaagauggcaacaaggaaacguauucuccuguucaguaaugcacgaagccuuacauaaccacuacacacaaaaaagucuaagccuaucaccaggaaaa

SEQ ID NO: 46378 - RNA, 642 nt, Artificial Sequence
  derived and/or modified sequence opt6 from Ligelizumab_LightChain1
gaaauaguaaugacacaaucaccagcaacacuauccguauccccaggagaaagagcaacauuaaguugcagagcaagccaaagcauaggcacaaacauucacugguaccaacaaaaaccaggacaagcaccaagacuauuaauauauuacgcaagugaauccauaagcggaauaccagcaagauucucuggaucaggauccggaacagaauuuacauuaacaauaagcucacuacaaagcgaagacuuugcaguauacuauugccaacaaucauggucauggccaaccacauucggaggaggaacaaaaguagaaauaaaaagaacaguagcagcaccaucaguauucauauucccaccaucggacgaacaauuaaaaucaggaacagcaucaguaguaugccuacuaaauaacuuuuacccaagagaagcaaaaguacaauggaaaguagauaacgcacuacaaagcggaaacucacaagaaucaguaacagaacaagacagcaaagacucaacauauagccuaagcucuacacuaacauuaagcaaagcugauuaugaaaaacacaaaguauacgcaugcgaaguaacacaccaaggacuaagcucaccaguaacaaaaagcuuuaacagaggcgaaugc

SEQ ID NO: 46379 - RNA, 1329 nt, Artificial Sequence
  derived and/or modified sequence opt6 from Lilotomab_HeavyChain1
gaaauacaacuacaacaaucaggaccugaauuagucaaaccaggagcaucaguaaaaguaucaugcaaagcaucuggauauucauuuacagacuacaacauguacuggguaaaacaaagccaugguaaaucucuagaauggaucgguuauauagaccccuauaacggugacacaacauauaaccaaaaauuuaaaggaaaagcaacacucacaguagauaaaucaucaucaacagcauucauacaucucaauucacucaccucugaagacucagcaguuuacuacugugcaagaucuccauauggacauuacgcaauggacuauuggggccaaggaacaucaguaaccguaagcagcgcaaaaacaacaccaccaagcguauacccauuagcaccaggaucugcagcgcaaacuaauucaaugguaacacuaggcugccuaguuaaaggauauuucccagaaccugucacaguaacauggaacucaggaucauuaucaucaggaguacacacauuuccagcuguacuacaaucagauuuauauacacuaucaucaucuguaacaguaccaucaucaacauggccaucagaaacaguaaccugcaacguagcccaccccgcaucaucuacaaaaguugacaaaaaaaucguuccaagagauuguggaugcaaaccaugcauaugcacaguaccugaaguaaguuccguuuucauauucccaccaaaaccaaaagacguuuuaaccauuacacuaaccccaaaaguaaccugcguaguaguagauauaucaaaagacgacccagaaguccaauuuucaugguucguagacgacguagaaguccacacagcacaaacacaacccagagaagaacaauucaacagcacauuucgcucaguaagcgaauuaccaauaaugcaccaagacugguuaaacggaaaagaauucaaaugcagaguaaauagcgcagcauucccagcaccaauagaaaaaacaauaucaaaaacuaaaggacgaccaaaagcaccacaaguauacacuauucccccaccaaaagaacaaauggcaaaagauaaaguuucacuaacaugcaugauaacagacuucuucccagaagauauaaccguagaauggcaauggaacggacaaccagccgaaaacuacaaaaacacucaaccaauaauggacacagacggaucauauuucguauacagcaaacuaaauguacaaaaaucaaacugggaagcagguaacacauucacauguucaguccuccacgaaggacuacacaaccaucacacugaaaaaucuuuaucucauucuccagguaaa

SEQ ID NO: 46380 - RNA, 642 nt, Artificial Sequence
  derived and/or modified sequence opt6 from Lilotomab_LightChain1
gacauaguaaugacacaaucacacaaacuacuaucaacaucaguaggagacagaguaucaauaacaugcaaagcaucacaagacguaucaacagcaguagacugguaccaacaaaaaccaggacaaucaccaaaauuauuaauaaacugggcaucaacacgacacacaggaguaccagacagauucacaggaucaggaucaggaacagacuauacacuaacaauaucaucaaugcaagcagaagaccuagcacuauacuauugcagacaacauuauucaacaccauucacauucggaucaggaaccaaacuagaaauaaaaagagcagacgcagcaccaacaguaagcauauucccacccucaagcgaacaacuaacaucaggaggagcaucaguaguaugcuuccuaaacaacuucuacccaaaagacauaaacguaaaauggaaaaucgacggaucagaaagacaaaacggaguacuaaacucauggacagaccaagacaguaaagauucaacauacucaaugucaucaacacuaacauuaacaaaagacgaauacgaaagacacaacucauacacaugcgaagcaacacacaaaacaucaacaucaccaauaguaaaaucauucaacagaaacgaaugc

SEQ ID NO: 46381 - RNA, 1338 nt, Artificial Sequence
  derived and/or modified sequence opt6 from Lintuzumab_HeavyChain1
caaguccaauuaguacaaucaggagcagaaguaaaaaaaccaggaucaucaguaaaagucagcugcaaagcaaguggauauacuuucacagauuauaacaugcacugggucagacaagcaccaggacaaggacuagaauggauagguuacauauacccauacaauggaggcacaggauacaaccaaaaauuuaaaucaaaagcaacaauuaccgcagacgaaucaaccaacacugcauacauggaauuaucaucacuaagaagcgaagacacagcaguauacuacugugcccgaggacgaccagccauggacuauuggggacaaggaacacuaguaacaguaucaucagccucaacaaaaggaccaagcguauucccuuuagcaccaucaucaaaaucuacaagcgguggaacugccgcccucggcugucuaguaaaagacuacuucccagaaccaguaacagucucuuggaacucaggagcacucaccucaggaguccacacuuuuccagcugucuuacaaagcuccggauuauauucuuuaucauccgucgucacaguaccuuccucuucauuaggaacacaaacauauauaugcaacguaaaccacaaacccucaaacacaaaaguagacaaaaaaguagaaccaaaaucaugcgacaaaacacauaccugccccccaugucccgcaccagaacuacuaggaggcccaucaguauuccuauucccaccuaaaccaaaagacacacuaaugauaucacgaacaccagaaguuacuugcguaguagucgacgucagucacgaagaccccgaagucaaauucaauugguacguagacggagucgaaguacauaacgcuaaaacaaaaccaagagaagaacaauacaacucaacauauagaguaguauccguacuaacagucuuacaucaagacuggcuaaacggaaaagaauacaaaugcaaaguaucaaauaaagcauuacccgcuccaauagaaaaaacuauaucaaaagccaaaggacaacccagagaaccccaaguuuacacauuaccaccuagucgagacgaacuaacuaaaaaccaaguaucacuaaccugucuaguaaaaggauucuacccauccgauaucgcagucgaaugggaaucaaauggacaaccugaaaacaauuauaaaacaacuccccccgucuuagauucagauggauccuucuuccuauacuccaaauuaacaguugacaaaaguagauggcaacaaggaaacguauucuccuguucaguaaugcaugaagcauuacauaaccacuacacacaaaaaucucuuucacuauccccuggaaaa

SEQ ID NO: 46382 - RNA, 654 nt, Artificial Sequence
  derived and/or modified sequence opt6 from Lintuzumab_LightChain1
gacauacaaaugacacaaucaccaucaaguuuaagcgcaagcguaggagacagaguaacaauaacaugcagagcaagcgaaucaguagacaauuacggaauaucauuuaugaacugguuccaacaaaaaccaggaaaagcaccaaaacuacuaauauacgcagcaucaaaccaaggaucaggaguaccaucaagauucucaggaucaggaucaggaacagacuucacacuaaccauaucaucacuccaacccgacgacuuugcaacauacuacugccaacaaucaaaagaaguaccauggacauucggacaaggaaccaaagucgaaauaaaacgaacaguagcagcaccaucaguauucauauucccaccaucagacgaacaacucaaaucuggaacagcaucaguaguaugccuacuaaacaacuucuacccccgagaagccaaaguacaauggaaaguagacaacgcauuacaaucaggaaauucacaagaaucaguaacagaacaagacagcaaagacucaacauacucacuaucaucaacacuaacacuaucaaaagcagacuacgaaaaacacaaaguauacgcaugcgaaguaacacaccaaggcuuaagcucaccaguaacaaaaagcuucaacagaggagaaugc

SEQ ID NO: 46383 - RNA, 1350 nt, Artificial Sequence
  derived and/or modified sequence opt6 from Lirilumab_HeavyChain1
caaguacaauuaguacaaucaggagcagaaguuaaaaaaccaggaucuagcgucaaagucucaugcaaagcaucagguggaacauucucauucuacgccauaucaugggugcgucaagcaccuggacaaggacuagaauggaugggaggauucauuccaauauuuggagcagcaaacuaugcacaaaaauuucaaggaagagucacaauuaccgcagaugaaucaacaucaaccgcauauauggaacuaucaucacuaagaucugacgauacagcuguauacuauugcgcaagaauaccuucaggaucauacuauuacgacuaugacauggacguauggggacaaggaacaacugucacuguaucaucagcuucuaccaaaggcccaagcguauuuccacuagcacccugcuccagaucaacaucagaaucaacagcagcacucggaugucuaguuaaagacuacuucccagaaccaguaacaguaucuuggaauucaggcgcucucaccucaggcguucacacauuuccagcuguauuacaaucaucagguuuauauuccuuaucaaguguaguaacaguacccucauccucucuaggaacaaaaacuuauacauguaacgucgaccauaaaccaucaaauacaaaagucgacaaaagaguagaaucaaaauacgguccaccauguccaccaugcccagcaccugaauuccucggaggaccaucaguauuccuauucccuccaaaaccaaaagacacucuuaugauaucaagaacuccagaagucacauguguaguaguagacguaucucaagaagacccugaaguacaauucaacugguacguagauggaguugaaguucacaaugcaaagaccaaaccaagagaagaacaauucaauucaacauaccgagucgucucuguacuaacuguacuccaccaagacuggcuaaacggaaaagaauacaaaugcaaaguaucaaacaaaggacuaccauccucuauagaaaaaacuauaucaaaagcaaaaggacaaccaagagaaccacaaguauacacauuaccaccaagucaagaagaaaugacaaaaaaccaaguaucacuaacuugccuaguaaaaggauuuuauccaucagacauagcaguagaaugggaaagcaauggacaaccagaaaacaauuacaaaacaaccccaccaguacuagacuccgacggaucauucuuccuauacucucgacuaacagucgauaaauccagauggcaagaaggaaauguauuuucuugcucaguaaugcacgaagcacuacauaaccauuauacacaaaaaagccuauccuuaucacucgguaaa

SEQ ID NO: 46384 - RNA, 642 nt, Artificial Sequence
  derived and/or modified sequence opt6 from Lirilumab_LightChain1
gaaauaguauuaacacaaucacccguuacauuaucauuaagcccaggcgaaagagcaacuuuaagcugucgagcaagucaaagcguaaguucauacuuagcaugguaccaacaaaaaccaggacaagcaccaagacuacuaauauaugacgcaagcaauagagcgacaggaauaccagcaagauucucaggcucaggaucaggaacagacuuuacacuaacaauaagcucauuagaaccagaagacuucgcaguauacuauugccaacaaagauccaauuggauguacacauucggacaaggaacaaaacuagaaauaaaaagaacaguagcagcaccaagcguauucauauucccaccaucagacgaacaauuaaaaucaggaacagcaucaguagugugccuacuaaauaacuuuuacccaagagaagcaaaaguacaauggaaaguagauaaugcacuccaaagcggaaauucacaagaaagcguaacagaacaagauagcaaagacucaacauauagcuuaagcucaacauuaacacuaagcaaagcagauuacgaaaaacauaaaguauacgcaugcgaaguaacacaccaaggauuaagcucaccaguaaccaaaaguuucaacagaggcgaaugc

SEQ ID NO: 46385 - RNA, 1344 nt, Artificial Sequence
  derived and/or modified sequence opt6 from Lodelcizumab_HeavyChain1
caaguucaauuaguccaaucaggagcagaaguaaaaaaaccuggagccucaguaaaaguaucaugcaaagcaucaggcuacacauucucaacuauguacaugucauggguaagacaagcaccaggacaaggacuagaauggaugggacgaauagaccccgccaaugaacacacaaauuacgcacaaaaauuccaggguagaguaacaaugacacgagacacaucaauaucaaccgcauacauggaacuauccagauuaacuuccgacgacacagcagucuacuacugugcaagauccuacuacuacuauaauauggacuacuggggacaaggaacuuuaguaacugucuccucagcaucaacaaaaggcccaucaguauuuccacuagcaccaucaucuaaaucaaccucaggaggaacagcagcacuuggcugccuaguaaaagauuacuuccccgaacccgucacagucuccuggaauaguggcgcacuaacauccggaguccauacauucccugcaguacuacaaaguucaggccuauacucccuaucaucaguugucacaguccccucaucaucacucggaacacaaaccuauaucuguaacguaaaccacaaaccgucaaauacaaaaguagauaaaagaguagagccaaaaucuugugacaaaacccauacaugcccaccauguccagcaccagaagccgcuggaggaccaucaguauuuuuauuuccuccaaaaccaaaagacacccuaaugauaucaagaaccccagaaguaacaugcguaguaguagauguaucacaugaagacccagaaguuaaauucaauugguacguagacggaguugaaguacauaacgcaaaaacaaaaccaagagaagaacaauauaacucuacauauagaguaguaucaguauuaacaguuuuacaucaagacuggcuaaacgggaaagaauacaaauguaaaguuucuaacaaagcacuaccagccccaaucgaaaaaacaauuuccaaagcaaaaggacaaccaagagaaccucaaguauauacacuaccaccauccagagaagaaaugacaaaaaaccaaguaucacuaacaugccuaguaaaaggauucuaccccuccgauauagcaguagaaugggaaucaaacggacaaccagaaaacaacuacaaaacaacaccaccuguacuagacucagacggaucauucuuucuauacucaaaacuaacagucgacaaaagucgauggcaacaaggcaacguauuuucaugcuccguaaugcacgaagccuuacauaaccacuacacacaaaaaaguuuaaguuuaucacccggaaaa

SEQ ID NO: 46386 - RNA, 639 nt, Artificial Sequence
  derived and/or modified sequence opt6 from Lodelcizumab_LightChain1
caaauaguacuaacacaaucaccagcuacacuauccguuucaccaggagaaagagcaacacuaucaugcagagccucacaaucaguaucauacaugcacugguaccaacaaaaaccaggccaagcaccaagacuacuaauauacggaguauucagaagagcaacaggaauaccagacagauucuccggaucaggauccggaaccgacuuuacauuaacaauaggaagacuagaaccagaagauuucgcaguauacuacugccuacaauggucaucagacccaccaacauucggacaaggaacaaaacuagaaauaaaaagaacaguagcagcaccaagcguauucauauucccaccaucagacgaacaacuaaaaucaggaacagcaucaguaguaugcuuacuaaacaacuucuacccaagagaagcaaaaguacaauggaaaguagauaacgcacuccaaucaggaaacucacaagaaagcguaacagaacaagacucaaaagacucaacauacaguuuaucaucuacauuaacacuaucaaaagcagacuacgaaaaacacaaaguauaugcaugcgaagucacacaccaaggacuaucaucaccaguaacaaaaagcuucaacagaggagaaugc

SEQ ID NO: 46387 - RNA, 1356 nt, Artificial Sequence
  derived and/or modified sequence opt6 from Lokivetmab_HeavyChain1
gaaguacaauuaguagaaucuggaggugauuuagucaaaccuggaggaucacuacguuuauccuguguagcaagcggauuuacauuuucuaauuaugguaugucauggguuagacaagcaccuggaaaaggccuacaauggguagcaacaauaucguacggaggaucauacacauauuacccagacaauauaaaaggaagauucacaauaaguagagacaacgcuaaaaacacauuauauuuacaaaugaauuccuuaagagcagaagacacagcaauguacuauuguguaagaggauacggauacgacacaauggacuauuggggacaaggaacacuuguaacaguaucaagugcaucaacaaccgcuccaagcguauuuccauuagcacccucauguggcuccacuuccggaucuacaguugcauuagcuugucuaguuucaggauacuuuccagaaccaguaacagucucauggaacucaggaucacuaacaucaggaguucauacauuuccuagcguccuccaaaguuccgguuuauauucccuauccucaaugguaacaguaccauccucgagauggccaucagaaacuuucaccuguaauguagcacaucccgcaucaaaaacaaaagucgacaaaccaguaccuaaaagagaaaacggacgaguaccacgaccaccagauugcccuaaauguccagcaccugaaaugcucggagguccaucaguauuuauauucccaccaaaaccuaaagauacucuccuaauugcaagaaccccagaaguaaccuguguagucguagaucuagauccagaagacccagaaguacaaauaucaugguucgucgacggaaagcaaaugcaaacugcuaaaacacaaccaagagaagaacaauucaauggaacuuacagaguaguuucaguauuaccaauaggacaucaagauuggcuaaaagggaaacaauucacuugcaaagucaauaauaaagcauuaccaucacccaucgaaagaacuauaucaaaggcacgaggucaagcccaccaaccaagcguauacguauuacccccaagcagagaagaacuaagcaaaaauacaguaucauuaaccugccuaauaaaagacuucuuuccaccagacauugacguagaauggcaaucaaacggacaacaagaaccugaaucaaaauacagaacaacaccuccacaacuagaugaagacggaucuuacuuuuuauauucaaaacuaucuguagauaaaucaagauggcaaagaggagauacauuuauaugugcaguaaugcacgaagcacuucauaaucauuacacccaagaaucauuaagccauucucccgga

SEQ ID NO: 46388 - RNA, 651 nt, Artificial Sequence
  derived and/or modified sequence opt6 from Lokivetmab_LightChain1
gaaauaguaaugacacaaucaccagcaagcuuaagccuaagccaagaagaaaaaguaacaauaacaugcaaagcaucccaaucaguaucauucgcaggaacaggacuaaugcacugguaccaacaaaaaccaggacaagcaccaaaauuacuaaucuacagagcaucaaauuuagaagcaggaguaccaucaagauucucaggaucaggaucaggcacagacuucucauucacaauaucaucacuagaaccagaagacguagcaguauacuacugccaacaaucaagagaauacccauggacauuuggacaaggaacaaaacuagaaauaaaacgaaacgacgcacaaccagccguauaccuauuccaaccaucaccagaucaauuacacacagguucagccucaguaguaugccuacuaaacucauucuacccaaaagacauaaacguaaaauggaaagucgacggaguaauacaagacacaggaauacaagaaucaguaacagaacaagacaaagacagcacauauucacuaucaucaacacuaacaaugucaucaacagaauaucuaucacacgaacuauacucaugcgaaauaacacacaaaucacuaccaucaacacuaauaaaaucauuccaaagaucagaaugc

SEQ ID NO: 46389 - RNA, 1344 nt, Artificial Sequence
  derived and/or modified sequence opt6 from Lorvotuzumab_mertansine_HeavyChain1
caaguacaacuaguagaaucaggaggaggaguaguucaaccaggaagaucuuuaagacucucaugcgccgccucaggauucacauuuaguucauucggaaugcacuggguccgccaagcaccaggaaaaggacucgaaugggucgcuuacaucucauccggaucauuuacaauauacuaugcagauucaguaaaaggacgauucacaauaucaagagacaacucaaaaaauacucuuuacuuacaaaugaacucacuaagagcugaagacacagcagucuacuacugugcuagaaugagaaaggguuacgccauggacuauuggggccaaggaacauuaguuaccguaucaucugcaucaacaaaaggaccauccguauuucccuuagcaccauccucaaaaucaacauccgguggaacagcagcauuagguugcuuagucaaagacuacuuuccagaaccaguaacaguaagcuggaauucaggagcacuaacaaguggaguacacaccuucccagcaguucuacaaucauccgguuuauacucccuaucauccguaguaacaguacccagcucaucauuagguacucaaaccuacauauguaacguaaaccacaaaccauccaauaccaaaguagacaaaaaaguagaaccaaaaaguugcgacaaaacacauacauguccaccaugcccagcaccugaacuauuagguggaccuuccguauuuuuauucccaccuaaaccuaaagacacauuaaugauaucaagaacuccagaagucacuugcguaguaguagacguaucccaugaagacccugaaguaaaauucaacugguauguagauggaguagaaguacacaacgcaaaaacaaaaccaagagaagaacaguacaauucaacauaucguguaguaucaguucucacaguacuucaucaagacugguuaaacggaaaagaauacaaaugcaaagucuccaacaaagcacuacccgcacccauagaaaaaacaauaucuaaagcaaaaggacaaccaagagaaccccaagucuauacauuaccaccaucacgagaugaauuaacaaaaaaucaaguuucacuuacuugccuaguuaaaggauuuuauccaucugacauagcaguagaaugggaaucaaacggacaaccugaaaacaauuauaaaacaacaccaccaguacuagauucugacggcucauuuuuuuuauacucuaaacuaacagucgacaagucaagauggcaacaagguaauguuuucuccuguucaguaaugcacgaagcauuacacaaccacuauacccaaaaaucauuaucauuauccccaggcaaa

SEQ ID NO: 46390 - RNA, 657 nt, Artificial Sequence
  derived and/or modified sequence opt6 from Lorvotuzumab_mertansine_LightChain1
gacguaguaaugacccaaucaccacuaucacuuccaguaacacuaggacaacccgcaucaauaucaugcagaucaucacaaauaauaauacacucagacggaaacacauaccuagaaugguuccaacaaagaccaggacaaucaccacgaagacuaauauacaaaguaucaaacagauucucaggaguaccagacagauucucaggcuccggcucaggaacagacuuuacacuaaaaauaucaagaguagaagcagaagacguaggaguauacuacugcuuccaaggaagccacguaccacacacauucggacaaggaacaaaaguagaaaucaaacgaacaguagcagcaccaagcguauucauauucccaccaucagacgaacaauuaaaaucaggaacagcaucaguaguaugccuacuaaacaacuucuacccacgagaagcaaaaguacaauggaaaguagacaacgcccuccaaucaggaaauucacaagaaucaguaacagaacaagacagcaaagacucaacauauucacuaucaucaacauuaacauuaucaaaagcagacuacgaaaaacacaaaguauacgcaugcgaaguaacacaccaaggacuaucaucaccaguaacaaaaucauucaacagaggcgaaugc

SEQ ID NO: 46391 - RNA, 336 nt, Artificial Sequence
  derived and/or modified sequence opt6 from Lpathomab_VL
gacguaguaaugacacaaacaccacuaucacuaccaguaucacuaggagaccaagcaucaauaucaugcacaucaggacaaucacuaguacacauaaacggaaacacauaccuacacugguaccuacaaaaaccaggacaaucaccaaaacuacuaauauacaaaguaucaaaccuauucucaggaguaccagacagauucucaggaucaggaucaggaacagacuucacacuaaaaauaucaagaguagaagcagaagaccuaggaguauacuucugcucacaaucaacacacuucccauucacauucggaacaggaacaaaacuagaaauaaaa

SEQ ID NO: 46392 - RNA, 366 nt, Artificial Sequence
  derived and/or modified sequence opt6 from Lpathomab_gamma1-Chain_VDJ-Region
caaguacaauuacaacaaagcggagcagaacuaguaagaccaggaacaagcguaaaaguaagcuguaaagcaagcggauacggauucauaaacuaucuaauagaauggauaaaacaaagaccaggacaaggacuagaauggauaggauuaauaaauccaggaagcgauuacacaaacuauaacgaaaacuuuaaaggaaaagcaacauuaacagcagacaaaagcucaaguacagcauauaugcaucuaucaagcuuaacaucagaagauagcgcaguauauuucugugcaagaagauuuggauauuacggaagcggaaacuauuucgauuacuggggacaaggaacaacauuaacaguaagcuca

SEQ ID NO: 46393 - RNA, 1350 nt, Artificial Sequence
  derived and/or modified sequence opt6 from Lucatumumab_HeavyChain1
caaguccaacuaguagaaucuggaggaggaguaguacaaccaggacgaucauuaagacuaucaugcgcugcauccgguuuuaccuucuccucauacggaaugcauuggguacgacaagcacccggaaaaggauuagaauggguagcaguaauaucauacgaagaauccaacagauaccacgccgauucaguaaaaggaagauuuacaauauccagagauaauuccaaaauaacacuauacuuacaaaugaauucauuaagaacagaagacacugcaguauacuauugugcaagagauggaggaauagcagcaccaggaccagauuauuggggacaagguacccuaguaacagucucaucagcaucaacaaaaggaccaucaguauuuccacuagcaccagcaucaaaauccaccucaggcggaaccgcagcauuagguugccuaguuaaagacuacuuccccgaaccaguaaccguaucauggaacucaggagcacuaacaucuggaguccauacauuccccgccguacuacaaucauccggacuauacucccucagcucaguaguaacaguaccaucaucaucauuaggaacacaaacuuauauauguaacguaaaucacaaaccaagcaacacaaaaguagacaaacgaguugaaccaaaaucaugugauaaaacucacacuugucccccaugucccgcucccgaacuacuaggaggaccaaguguauuccucuuuccacccaaacccaaagacacccucaugaucucaagaacaccagaaguaacauguguaguaguagauguaucccacgaagacccagaaguaaaauuuaacugguauguagacggaguagaaguacauaacgcaaaaacuaaaccacgagaagaacaauacaauucaacguauagaguagucucaguccuaaccguauuacaucaagacuggcuaaacggaaaagaauacaaaugcaaaguaucaaacaaagcacuaccagcacccauagaaaaaacaauaucgaaagcaaaaggccaaccaagagaaccacaaguauauacauuaccacccucaagagaagaaaugacaaaaaaccaaguuucuuuaaccuguuuagucaaaggauucuacccaucugacauugcaguugaaugggaaagcaacggacaaccagaaaacaauuacaaaaccacaccaccaguacuagacuccgacggaucauucuuucuauacucaaaacuaacuguugauaaaucaagauggcaacaagggaacguuuucucaugcucaguaaugcacgaagcacuacacaaccauuacacccaaaaaucacuaucacucuccccaggaaaa

SEQ ID NO: 46394 - RNA, 657 nt, Artificial Sequence
  derived and/or modified sequence opt6 from Lucatumumab_LightChain1
gacauaguaaugacacaaucaccauuaucccuaacagucaccccaggagaaccagcaucaauaucaugcagaucaucacaaucacuauuauacucaaacggauauaacuacuuagauugguaccuacaaaaaccaggacaaucaccccaaguacuaauaucacucggauccaacagagccucaggaguaccagacagauuuucaggcucuggaucaggaacagacuucacacuaaaaauaucaagaguagaagcagaagacguaggaguauacuacugcaugcaagcaagacaaacaccauucacauucggaccaggaacaaaaguagacauaagaagaacaguagcagcaccaucaguauucauauuccccccaagcgacgaacaacuaaaaucaggaacagccuccguaguaugccuacuaaacaacuucuacccaagagaagcaaaaguacaauggaaaguagauaacgcauuacaaagcggaaacucacaagaaucaguaacagaacaagacucaaaagacucaacauacucauuaucaucaacauuaacacuauccaaagcagacuaugaaaaacacaaaguauacgcaugcgaaguaacacaccaaggacuaucaucaccaguaacaaaaucauucaaccgaggagaaugc

SEQ ID NO: 46395 - RNA, 324 nt, Artificial Sequence
  derived and/or modified sequence opt6 from Lulizumab_pegol_LightChain1
gacauacaaaugacacaaucaccaucaucccuaucagcaucaguaggagacagaguaacaauaacaugcagagcaucaagaccaauauggccauuccuagaaugguaccaacaaaaaccaggaaaagcaccaaaauuacuaauauacuucacaucaagacuaagacacggaguaccaucaagauucucaggaucaggaucaggaacaugcuucacacuaacaauaucaucacuacaaccagaagacuucgcaacauacuacugccuacaaaacguagcaaacccagcaacauucucacaaggaacaaaaguagaaauaaaaaga

SEQ ID NO: 46396 - RNA, 324 nt, Artificial Sequence
  derived and/or modified sequence opt6 from Lulizumab_pegol_LightChain
gacauacaaaugacacaaucaccaucaucacuaucagcauccguaggagacagaguaacaauaacaugcagagcaucaagaccaauauggccauuccuagaaugguaccaacaaaaaccaggaaaagcaccaaaacuacuaauauacuucacaucaagacuaagacacggaguaccaucaagauucucaggaucaggaucaggaacaugcuucacacuaacaauaucaucacuacaaccagaagacuucgcaacauacuacugccuacaaaacguagcaaacccagcaacauucucacaaggaacaaaaguagaaauaaaaaga

SEQ ID NO: 46397 - RNA, 1194 nt, Artificial Sequence
  derived and/or modified sequence opt6 from Lumiliximab_HeavyChain1
gaaguacaauuaguagaaucaggcggaggacucgcaaaaccaggaggaucucuacgccuaucuugcgcagcaucaggcuucagauuuacauuuaacaacuacuacauggacuggguaagacaagcaccaggacaagguuuagaauggguauuaacaacaggaucugauuccuggggacaaggaguacuaguuacaguaucauccgcaucuaccaaaggaccaucaguauuuccacuagcaccaaguuccaaaucuacaucaggaggcaccgccgcacuaggaugccucguaaaagacuacuucccagaaccaguaacagucucauggaacucaggagcacucacaucaggaguacacacauuuccagcaguacuccaaucaucaggacuauacagucuaucaucaguaguaaccguaccaucaucaucacuaggaacacaaacuuauauauguaacguaaaccauaaaccaagcaacacaaaaguagauaaaaaagucgaaccaaaaucuugcgacaaaacacauaccuguccaccauguccagccccagaacuacuaggaggcccaucaguauuccuauucccuccaaaaccaaaagacacacuaaugauaucaagaacaccagaaguaaccuguguaguaguagacguaagccacgaagauccagaaguaaaauucaacugguauguagauggcguagaaguacauaaugccaaaacaaaaccuagagaagaacaauacaauucaaccuaccgaguaguaucaguauuaacaguacuacaucaagacuggcucaacggaaaagaauauaaaugcaaaguuucaaacaaagcacuaccagcaccuauagaaaaaacaauaucaaaagcaaaaggacaaccaagagaaccacaaguauacacacuacccccaucuagagacgaacucacaaaaaaucaaguaucccuuacaugcuuaguuaaaggauucuauccaucagacauagccguagaaugggaaucaaauggacaaccagaaaacaauuacaaaacuacaccaccaguacuagacucagacggaucauucuuccuauauucuaaacuaacagucgacaaaucaagauggcaacaaggaaauguuuuuucaugcucaguaaugcacgaagcacuacauaaccauuauacacaaaaaucacuaucacuaucaccaggaaaa

SEQ ID NO: 46398 - RNA, 642 nt, Artificial Sequence
  derived and/or modified sequence opt6 from Lumiliximab_LightChain1
gacauacaaaugacacaaucacccucaagccuaagcgcaagcguaggagacagaguaacaauaacauguagagcaucacaagacauaagauacuaucuaaacugguaccaacaaaaaccaggaaaagcaccaaaacuauuaauauacgucgcaucaucacuacaaaguggagucccaucaagauucucaggaucaggaucaggaacagaauuuacacuaacaguaagcucacuacaaccagaagacuucgcaacauacuauugccuacaaguauacucaacaccaagaacauucggacaaggaaccaaaguagaaauaaaacgaacaguagcagcaccaagcguauucauauuuccaccaucagacgaacaacuaaaaucaggaacagcaucaguaguaugccuacuaaacaacuucuacccaagagaagcaaaaguccaauggaaaguagacaacgcacuccaaagcggaaacucacaagaaucaguaacagaacaagacucaaaagacucaacauacagcuuaaguucaacacuaacacuaagcaaagcagauuacgaaaaacacaaaguauaugcaugcgaaguaacacaccaaggacuaagcucaccaguaacaaaaagcuucaacagaggagaaugu

SEQ ID NO: 46399 - RNA, 1347 nt, Artificial Sequence
  derived and/or modified sequence opt6 from Lumretuzumab_HeavyChain1
caaguacaauuaguccaaucaggagcagaaguaaaaaaaccaggagccuccguaaaaguaucaugcaaagcaucuggcuacacuuucagaucaucauauauaucauggguaagacaagcaccaggacaagguuuagaauggaugggauggauauacgccggcaccggaucccccuccuacaaucaaaaacuacaaggcagagucaccaugacaacagacaccucaacuucaacagcauacauggaacuccguucacuacgcucagaugacacagcaguauacuacugugcaagacaccgagacuacuacucaaacucucuaacauauuggggacaaggaacacuaguuacaguaucaucugcuuccacaaaaggaccaaguguauucccccuagcaccaaguucaaaauccacauccggcggaacagcagcacuaggaugccuaguaaaagacuauuucccugaaccaguaacaguaucauggaauucaggagcucuaaccucaggaguccacacauucccagcaguauuacaaucuucaggauuauacuccuuaaguuccguaguuacaguaccaucaucaucauuaggaacacaaacauacauaugcaauguaaaccacaaaccuucaaauaccaaaguagacaaaaaagucgaaccaaaaucaugugacaaaacucacacauguccuccaugcccagcaccagaacuacuuggagguccauccguauuccuauucccaccaaaaccaaaagauacccuaaugaucucaagaacaccagaaguaaccugcguaguaguugacguaagccacgaagacccagaaguuaaauucaauugguacguagacggcguagaagugcacaacgcaaaaacaaaacccagagaagaacaauauaauagcacauacagaguaguauccguauuaacuguacuacaucaagacugguuaaacggaaaagaauauaaaugcaaagucucaaauaaagcucuaccagccccuauagaaaaaacaauauccaaagcuaaaggacaaccaagagaaccacaagucuacacauuaccaccaucacgcgacgaacuaacaaaaaaccaagucucauuaaccugucuaguaaaaggauuuuacccuuccgauaucgcaguagaaugggaauccaacgggcaaccagaaaauaauuauaaaacaacaccaccaguauuagacucagacggaucauucuucuuauauucaaaacuaacagucgacaaaucaagauggcaacaagguaauguauucuccuguucaguaaugcacgaagcccuucacaaccacuacacacaaaaaucauuaucucuaucaccaggu

SEQ ID NO: 46400 - RNA, 660 nt, Artificial Sequence
  derived and/or modified sequence opt6 from Lumretuzumab_LightChain1
gauaucguaaugacacaaucaccugacagccuagcaguaucacuaggagaaagagcaacaauaaacugcaaaucaagccaaagcguccucaacucaggaaaccaaaaaaacuauuuaacaugguaccaacaaaaaccaggacaaccaccaaaacuauuaauauauugggcaucaacaagagaaagcggaguaccagacagauucucaggaucuggaucaggaacagacuucacccuaacaauaucaucacuacaagccgaagacguagccguauauuacugccaaucagacuacuccuacccauacacauucggacaaggaacaaaauuagaaauaaaaagaacaguagcagccccaucaguauucauauucccaccaucagacgaacaauuaaaaucaggcacagcaucagucguaugccuacuuaacaacuucuacccaagagaagcaaaaguacaauggaaaguagacaacgcacuacaaucaggaaacucacaagaauccguaacagaacaagacucaaaagacucaacauacagcuuaaguucaacacuaaccuuaucaaaagcagacuacgaaaaacacaaaguauacgcaugcgaaguaacacaccaaggccuaucaucaccaguaacaaaaucauucaacaggggagaaugc

SEQ ID NO: 46401 - RNA, 1329 nt, Artificial Sequence
  derived and/or modified sequence opt6 from Lutetium_(177Lu)_lilotomab_satetraxetan_HeavyChain1
gaaauacaauuacaacaaucaggaccagaauuagucaaaccaggugcaucaguaaaaguaucaugcaaagcaucaggauauucauucacagacuacaacauguacuggguaaaacaaucacacggaaaaucauuagaauggauaggauacauugauccauacaacggagacacuaccuacaaucaaaaauucaaaggaaaagccaccuuaacaguagacaaaucaucaucaacagcauuuauacaccuaaacucauuaacauccgaagauagugccgucuauuauugcgcaagaucacccuacggacauuaugcaauggacuacuggggucaaggaacuucaguuacaguuucaucagcaaaaacaacaccaccaucagucuauccacuagccccaggaucagcagcacaaaccaauucaaugguaacacuagguugccucguaaaaggcuacuuuccagaacccguaacagucacauggaacuccggaucacuuucaucaggaguacauacauuuccagcaguacuacaaucagaucucuacacacuuucauccucugucacaguaccauccucaacauggccaucagaaacaguaaccugcaacguagcacauccagcaucaucaaccaaaguugacaaaaaaaucgucccacgagauugcggauguaaacccuguauuuguacaguaccagaaguaucaucaguauucauauucccaccaaaaccaaaagacguauuaacaauaacccuaacaccaaaaguaacaugcguaguugucgauauauccaaagaugaccccgaaguacaauucucaugguuuguagacgacguagaaguccauacagcacaaacacaaccaagagaagaacaauuuaacucaacauucagaagcguauccgaacuuccaauaaugcaccaagacugguuaaauggaaaagaauucaaaugccgagucaauucugcagcuuuccccgcacccauagaaaaaacaaucucaaaaacaaaaggaagacccaaagcaccacaaguauacacaauaccaccaccaaaagaacaaauggcaaaagacaaaguaucccucacaugcaugauaaccgacuuuuucccugaagauauaaccguagaauggcaauggaauggccaaccagccgaaaacuauaaaaacacacaacccauaauggauacagacggcucauacuucguuuacuccaaacuaaacguccaaaaaagcaauugggaagcaggaaacacauucaccugcucaguacuacaugaaggacuucauaaucaccacaccgaaaaaagucuaucacauuccccuggaaaa

SEQ ID NO: 46402 - RNA, 642 nt, Artificial Sequence
  derived and/or modified sequence opt6 from Lutetium_(177Lu)_lilotomab_satetraxetan_LightChain1
gacauaguaaugacacaaucacacaaauuauuaucaacaucaguaggagaccgaguaucaauaacaugcaaagcaucacaagauguaucaacagccguagacugguaccaacaaaaaccaggacaaucaccaaaacuauuaauaaacugggcaucaacacgacauacaggagucccagacagauucacaggaucaggauccggaacagacuauacacuaacaauaucaucaaugcaagcagaagaccuagcacuauacuacugccgacaacacuacucaacacccuucacauucggaucaggaacaaaacuagaaauaaaaagagccgacgcagcaccaacaguauccauauucccaccaucauccgaacaacuaacaucaggaggagcaucaguaguaugcuucuuaaauaacuucuacccaaaagacauaaacguaaaauggaaaauagacggaucagaaagacaaaacggaguacuaaacucauggaccgaccaagacucaaaagacucaacauacuccauguccucaacacuaaccuuaacaaaagacgaauaugaaagacacaacucauacaccugcgaagccacccauaaaacaucaacaucaccaauaguaaaaucauucaacagaaacgaaugu

SEQ ID NO: 46403 - RNA, 1350 nt, Artificial Sequence
  derived and/or modified sequence opt6 from Margetuximab_HeavyChain1
caaguacaacuacaacaaucaggaccagaacuaguaaaaccuggugcaucacuuaaauuaucaugcacagcaucaggauucaacauaaaagacaccuauauacacuggguaaaacaacguccagaacaaggacuagaauggauaggacgcauuuaccccacaaacggauauacuagauaugacccaaaauuccaagacaaagcaacaauaaccgcagacacauccucaaacaccgccuaccuucaaguaucaagauuaacaucagaagauacagcaguauauuacugcucacgaugggguggcgacggcuucuaugcaauggacuacuggggccaaggagcuucaguaacaguaucaucagcaucaacaaaaggaccaaguguauuccccuuagcaccaucaucaaaaucaaccucuggagguacagcugcacuaggaugccuaguaaaagacuauuucccagagccagucacaguauccuggaacucaggagcucuaacaucaggcguacauaccuuccccgccguucuacaauccucaggacuauacuccuuaucaucaguuguaaccguaccaucaucaucacuuggaacucaaacauauaucugcaacguaaaccacaaaccaucaaauacaaaaguagacaaacgaguagaacccaaaucaugcgacaaaacacacaccugcccuccauguccagcacccgaauuaguaggaggcccaucaguauuucuacucccaccaaaacccaaagauacccuaaugauaucaagaacacccgaagucaccugcguuguaguagauguaucacacgaagacccagaaguaaaauucaauugguaugucgacggaguagaaguacacaacgcuaaaacuaaaccaccagaagaacaauacaauucaacacucagagucgucucaguauuaacaguacuacaucaagacuggcuaaacgguaaagaauacaaaugcaaaguaucaaauaaagcccuaccagccccaauagaaaaaaccauaucaaaagcaaaaggacaacccagagaaccucaaguuuauacacuuccaccaucaagagaugaauuaacaaaaaaccaagucuccuuaacaugccuaguaaaagguuucuauccaucugauauugcaguagaaugggaaucaaauggacaaccagaaaacaacuauaaaacaacaccauuaguacuagacuccgacggaucauucuucuuauacucuaaacuaacaguagauaaaucacgauggcaacaagguaacguauucucaugcucaguaaugcacgaagcacuacauaaccacuacacacaaaaaucacuaucacuaagcccaggaaaa

SEQ ID NO: 46404 - RNA, 642 nt, Artificial Sequence
  derived and/or modified sequence opt6 from Margetuximab_LightChain1
gacauaguaaugacacaaucacacaaauucauguccacaucaguaggagacagaguaucaauaaccugcaaagcaucacaagacguaaauacagccguagcaugguaccaacaaaaacccggacacucaccaaaacuauuaauauacucagcaucauucagauauacuggaguaccagacagauucacaggaucaagaucaggaacagacuuuacauucacaauaucaucaguacaagcagaagacuuagcaguauacuacugccaacaacacuacacaacaccaccaacauucggagguggaacaaaaguugaaauaaaacgaacaguagcagcaccaucaguauucauauucccaccaucagacgaacaacuaaaaucaggcacagcaucaguaguaugccuauuaaauaacuucuacccaagagaagcaaaaguacaauggaaaguagacaacgcacuucaaucaggaaacucacaagaaucaguaacagaacaagacucaaaagacucaacauacucacuaucaucaacccuaacacuauccaaagcagauuacgaaaaacacaaaguauacgcaugcgaaguaacacaccaaggauuaucaucaccaguaacaaaaucauucaacagaggcgaaugc

SEQ ID NO: 46405 - RNA, 762 nt, Artificial Sequence
  derived and/or modified sequence opt6 from Marzeptacog_alfa_HeavyChain1
auaguaggaggaaaaguauguccaaaaggagaauguccauggcaaguacuacuacuaguaaauggagcacaauuguguggaggaacauuaauaaauacaauauggguaguaagugcagcacauuguuuugauaaaauaaaaaacuggcguaacuuaauagcaguauuaggagagcaugauuuaagugaacaugauggagaugaacaaucaagaagaguagcacaaguaauaauaccaucaacauauguaccaggaaccacaaaucacgauauagcacuacuaagacuacaucaaccaguaguauuaacagaucauguaguaccauuaugccuaccagaaagaacauuuagugaaagaacacuagcauuuguaagauuuagcuuaguaucagguuggggaagauuauuagaucgaggagcaacagcacuagaacuacaaguauuaaacguaccaagauuaaugacccaagauuguuuacaacaaucaagaaaaguuggugauucaccaaauauaacagaauauauguuuugugcuggauauagcgauggaaguaaagauaguuguaaaggagauucaggaggaccacaugcaacacauuauagaggaacaugguaccuaacaggaauagucucauggggacaaggaugugcaacaguaggacauuuuggaguauauacaagaguaucucaauauauagaaugguuacaaaaacuaaugagaagugaaccacgaccaggcguacuuuuaagagcaccauuucca

SEQ ID NO: 46406 - RNA, 456 nt, Artificial Sequence
  derived and/or modified sequence opt6 from Marzeptacog_alfa_LightChain1
gcaaacgcauucuuagaagaacuaagaccaggaagcuuagaaagagaauguaaagaagaacaaugcucauucgaagaagcaagagaaauauuuaaagaugcagaaagaacaaaauuauucuggauaucauacucagacggagaccaaugcgcaagcucacccugucaaaauggaggaagcuguaaagaucaauuacaaucauacauaugcuuuugcuuaccagcauucgaaggaagaaacugugaaacacacaaagacgaucaauuaauauguguaaaugaaaauggaggaugcgaacaauauugcucagaccauacaggaacaaaaagaucaugcagaugccaugaaggauacucacuauuagcagacggaguaagcuguaacgcaacaguagaauauccauguggaaaaauaccgauauuagaaaaaagaaaugcaucaaaaccacaaggaaga

SEQ ID NO: 46407 - RNA, 669 nt, Artificial Sequence
  derived and/or modified sequence opt6 from Matuzumab_HeavyChain1_variant_3c08_H
caaguacaauuaguacaaucaggagcagaaguaaaaaaaccaggcgcuucaguaaaaguaagcuguaaagcaucaggauacacauucacaucacauuggaugcacuggguaagacaagcaccaggacaaggacucgaauggauaggagaauucaauccaucaaauggaagaacaaacuauaacgaaaaauucaaaucaaaagcaaccaugacaguagacacaucaacaaacacagcauauauggaacuaucaucauuaagaucagaagauacagcaguauauuacugugcaucaagagauuacgauuacgauggaagauacuuugacuauuggggacaaggaacauuaguaacaguaucaagcgcuagcacaaaaggaccaucaguauuuccauuagcaccaucaucaaaaucaacaucaggaggaacagcugccuuaggaugucucguaaaagauuacuuuccagaacccguaacaguaagcuggaacucaggagcucuaacaagcggaguacauacauuuccagcaguauuacaaucaagcggauuauauagcuuaucaucuguaguaacaguaccaucaagcucacuaggaacccaaaccuacauauguaacguaaaccauaaaccaucaaauacaaaaguagauaaaaaaguagaaccaaaauca

SEQ ID NO: 46408 - RNA, 669 nt, Artificial Sequence
  derived and/or modified sequence opt6 from Matuzumab_HeavyChain1_variant_3c09_C
caaguacaauuaguacaaagcggagcagaaguaaaaaaaccaggagcaagcguaaaaguaagcuguaaagcaucagguuacacauucacaagucauuggaugcacuggguaagacaagcacccggacaaggacuagaauggauaggagaauucaauccaucaaacggaagaacaaacuauaacgaaaaauucaaaucaaaagcaacaaugacagucgacacaucaacaaacacagcauauauggaacuaucaucacuaagaucagaagauacagcaguauauuauugcgcaucaagagacuacgauuaugcuggaagauacuuugacuauuggggacaaggcacauuagucacaguaucaagcgcaagcacaaaaggaccaucaguauuuccauuagcaccaucaucuaaaucaacaucaggaggaacagcagcauuaggauguuuaguaaaagauuacuuuccagaacccguuacaguaaguuggaacucaggagcacuaacuucaggaguacacacuuuuccagcaguauuacaaucaucaggacuauauagcuuaucaucaguagucaccguaccaucaagcucauuaggaacacaaacauauauauguaacguaaaccauaaaccaagcaauacaaaaguagauaaaaaagucgaaccaaaauca

SEQ ID NO: 46409 - RNA, 636 nt, Artificial Sequence
  derived and/or modified sequence opt6 from Matuzumab_LightChain1_variant_3c08_L
gacauacaaaugacccaaucaccaucauccuuaucagcaucaguaggagacagaguaacaauaacauguuccgcaucaucaucagucacauacauguacugguaccaacaaaaaccaggaaaagcaccaaaacuucuaauauacgacacaagcaaccuagcaucaggaguaccaucaagauuuucaggaucaggaucaggaacagacuacaccuucacaauauccucacuacaaccagaagacauagcaacauacuacugccaacaauggucaucacacauauucacauucggacaaggaacaaaaguagaaauaaaaagaacaguagcagcaccaucaguauucauauucccaccaucagacgaacaacuaaaauccggaacagcaucaguaguaugccuacucaacaacuucuacccaagagaagcaaaaguacaauggaaaguagacaacgcauuacaaucaggaaacucacaagaaucaguaacagaacaagacucuaaagacucaacauacucacuaucaucaacauuaacauuaucaaaagcagacuacgaaaaacacaaaguauacgcaugcgaagucacacaccaaggacuaucaucacccguaacaaaaucauucaacagaggagaa

SEQ ID NO: 46410 - RNA, 636 nt, Artificial Sequence
  derived and/or modified sequence opt6 from Matuzumab_LightChain1_variant_3c09_B
gacauacaaaugacacaauccccaucaucacucucagcaucaguaggagacagaguaacaauaacaugcucagcaucaucaucaguaacauauauguacugguaccaacaaaaacccggaaaagcacccaaauuacuaauauacgacacaucaaacuuagcaucuggagucccaucaagauucucaggaucaggcucaggaacagacuacacauucacaauauccucacuacaaccagaagacauagcaacauacuacugccaacaaugguccucacacauauucacauucggacaaggcacaaaaguagaaauaaaaagaacaguagcagcaccaucaguauucauauucccaccauccgacgaacaacuaaaaucaggaacagcaucaguaguaugccuauuaaacaacuucuacccaagagaagccaaaguacaauggaaagucgacaacgcacuacaaucaggcaacucacaagaauccguaacagaacaagacucaaaagacuccacauacucauuaucuucaacccuaacauuaucaaaagcagacuacgaaaaacacaaaguauacgcaugcgaaguaacacaccaaggacuaucaucacccguaacaaaaucauucaacagaggagaa

SEQ ID NO: 46411 - RNA, 1341 nt, Artificial Sequence
  derived and/or modified sequence opt6 from Mavrilimumab_HeavyChain1
caaguacaacuaguacaaucaggagcugaagucaaaaaaccaggagcaaguguaaaaguaucaugcaaaguauccggcuauacauuaacagaacucucaauucauuggguucgacaagccccaggaaaaggccuagaauggaugggcggauuugaccccgaagaaaacgaaaucguauacgcacaaagauuucaaggcagagucacaaugacagaagauaccucuacugauacagcauauauggaauuaucuucacuaagaucagaagauacagcaguauauuauugugcaauaguaggaucuuucucaccacucacacucgguuuauggggacaaggaacaaugguaaccguauccucagcuucuacaaaaggucccucaguauucccauuagcaccauguucacgaucaacaucugaaagcacagcugcauuaggauguuuaguaaaagacuauuuuccagaaccaguaacaguaucauggaauucaggugcacuuacauccggaguacauacauuuccagcuguauuacaaucaucaggacuauauucacuuucaucaguugucacaguacccucaagcucauuagguacaaaaacauauacauguaauguagaucauaaaccaucaaauacuaaaguagauaaaagaguagaaucaaaauacgguccaccaugcccaucaugucccgcaccagaauuuuuaggagguccaucaguauuuuuauuuccaccaaaaccaaaagauacacucaugauaucuagaacuccagaaguaacaugugucgucguagauguuucucaagaagacccugaaguacaauuuaacugguauguagacggcguagaaguacacaacgccaaaacuaaacccagagaagaacaauuuaauucaacauauagaguaguaucaguauuaacuguucuacaccaagauuggcuaaauggcaaggaauauaaauguaaaguuucuaauaaaggauuaccauccuccauagaaaaaacuauuucaaaagcaaaaggacaaccaagagaaccucaaguauauacuuuaccaccaucucaagaagaaaugacuaaaaaucaaguaucacuuacuuguuuaguaaaaggauucuauccauccgacauagccguagaaugggaguccaacggucaaccagaaaacaauuauaaaacuacacccccugucuuagauucugauggaucauucuuucuauauucaagauuaacaguagauaaaucaagauggcaagaaggcaauguauuuucauguucagucaugcaugaagccuuacauaaccauuacacacaaaaaucauuaucacuaagccucggaaaa

SEQ ID NO: 46412 - RNA, 651 nt, Artificial Sequence
  derived and/or modified sequence opt6 from Mavrilimumab_LightChain1
caaucaguacuaacacaaccaccaucaguaucaggagcaccaggacaacguguaaccauaucaugcacaggauccggaucaaacauaggagcaccauacgacguaucaugguaccaacaacuaccaggaacagcuccaaaacuacuaauauaccacaacaacaaaagaccaucaggcguaccagacagauucucaggaucaaaaucagguaccucagcaucucuagcaauaacaggauuacaagcagaagacgaagcagauuacuacugcgcaacaguagaagcaggccuaucaggaucaguauucggaggaggcacaaaacuaacaguacuaggacaaccaaaagcagcaccauccguaacauuauucccaccaucaucugaagaacuacaagcaaauaaagcaacacuagucugccuaauaucagacuucuacccaggagcaguaacagucgcauggaaagcagacucaucaccaguaaaagcaggaguagaaacaacaacaccaucaaaacaaucaaacaacaaauacgcagccuccucauacuuaucauuaacaccagaacaauggaaaucacacagaucauacucaugccaaguaacacacgaaggaucaaccguagaaaaaacaguagcaccaacagaauguuca

SEQ ID NO: 46413 - RNA, 1359 nt, Artificial Sequence
  derived and/or modified sequence opt6 from MDX-1303_HeavyChain1
caaguacaacucguugaaucaggaggcggaguaguacaacccggacgaucccuaagauuaucaugcgcagcaucaggcuucacauucucauauuacggaaugcacuggguaagacaagcacccggaaaaggauuagaauggguugcaguaauauggcacgaugaaagcauagucuauuacgcagauaguguuaaaggaagauucacaauauccagagacaacucaaaaaacacacucuaucuacaaaugaauucacuaagagccgaagacacagcaguauauuacuguacccgugauccaggagacccauacuauuacuauuauggacuagacgucuggggacaaggaacuacaguuacaguaucaucagcauccacuaaaggaccaucaguuuuuccauuagcacccucaucaaaaucaacuucaggaggcacugcugcacuaggcugccuaguaaaagacuauuuuccugaaccaguaacagucucauggaacucaggcgcacuuaccucaggaguacauacauuuccagcaguuuuacaauccucaggacuauacucauuaucaaguguuguaacaguaccaagcucuucucuaggcacccaaacauacauaugcaauguaaaucacaaacccucaaacacaaaaguagauaaacgaguagaaccaaaaucaugcgacaaaacacauacaugccccccguguccagcaccagaacuauuaggcggaccaucaguauuccuauuuccaccaaaaccaaaagauacauuaaugauaucacguacacccgaagucacaugcguuguagucgauguaucacacgaagauccagaaguaaaauucaauugguacguggacggaguugaaguacacaacgcuaaaacaaaaccaagagaagaacaauacaacucaacauacagaguaguaucuguauuaaccguacuacaccaagauugguuaaaugguaaagaauacaaaugcaaaguaucaaauaaagcauuacccgcaccaauagaaaaaacaauaucaaaagcaaaaggacaaccacgugaaccacaaguauacacacuucccccaucacgcgaagagaugaccaaaaaccaaguaucauuaacuugcuuaguaaaaggcuucuacccuucagauauugcaguagaaugggaaucaaacggucaaccagaaaacaauuacaaaacaacaccaccaguauuagauucugauggaaguuuuuuccuauacucaaaauuaacaguugacaaaucacgauggcaacaaggaaacguauuuucauguucaguaaugcacgaagcccuucacaaucacuacacacaaaaaucucucucacuaucaccagguaaa

SEQ ID NO: 46414 - RNA, 645 nt, Artificial Sequence
  derived and/or modified sequence opt6 from MDX-1303_LightChain1
gaaauaguacuaacacaaucaccaggaacacucucacuaucuccaggagaaagagcaacacuaucaugcagagcaucacaaucaguaucaucaucauaccuagcaugguaucaacaaaaaccaggacaagcaccaagacuacuaauauacggagcaucaucaagagcaacaggaauaccagacagauucucaggaucaggaucaggaacagacuuuacccuaacaauaucacgacuagaaccagaagacuuugcaguauacuacugccaacaauacggaucaucaauguauacauucggacaaggaacaaaacuagaaauaaaaagaacaguagcagcaccaucaguauucauauucccacccucugacgaacaacuaaaaucaggcacagcaucaguagucugucuacuaaacaacuucuacccaagagaagcaaaaguacaauggaaagucgacaaugcauuacaauccggaaacucccaagaaucaguaacagaacaagauucaaaagacucaacauacucacuauccucaacauuaacacuaucaaaagcagacuacgaaaaacacaaaguauacgcaugcgaaguaacacaccaaggacucucaucaccaguaacaaaauccuucaacagaggagaaugc

SEQ ID NO: 46415 - RNA, 1347 nt, Artificial Sequence
  derived and/or modified sequence opt6 from Mepolizumab_HeavyChain1
caaguaacauuaagagaaucaggaccagcacucguaaaacccacucaaacauuaacacuuacaugcacaguauccggauuuucacuaacaucauacucaguacacuggguaagacaaccaccaggaaaaggccuugaauggcuaggaguaaucugggcaucaggaggaacagacuacaacuccgcacucaugucuagacuuucaauaucuaaagauaccucaagaaaccaaguaguuuuaacaaugacuaacauggacccagucgacacagcuacauauuauugugcaagagauccaccaucaucacuacuaagauuagauuacuggggacgaggaaccccaguaacaguaaguucagcaucaacaaaaggaccaucagucuucccccucgcccccucuucaaaauccacauccggaggaacugccgcacucggaugccucguaaaagauuacuucccagaaccaguaacaguaucauggaauucaggcgcacucacaucuggaguacacacauucccagcuguucuccaaucaucaggccuauauagccucucauccguaguaacaguaccauccucaucccuuggcacccaaacauacauauguaauguaaaccacaaaccauccaauacaaaaguugauaaaagaguagaacccaaaucaugcgacaaaacucacaccugcccaccaugcccagccccagaauuacuaggaggcccaucuguauucuuauucccaccaaaacccaaagacacccuaaugauaucacgcacaccagaaguuacuuguguaguaguugacguaucacaugaagauccagaaguuaaauucaacugguacguagauggaguagaaguacacaaugccaaaacuaaaccacgagaggaacaauacaacuccacauauagaguaguaucaguccuaacaguauuacaucaagauuggcuaaauggaaaagaauacaaaugcaaagucuccaacaaagcucuaccugcaccaauagaaaaaacuauaucaaaagccaaaggucaaccuagagaaccacaaguuuacacauuaccacccucaagagaagaaaugacaaaaaaccaaguaucauuaacaugccuaguaaaaggguucuauccaagcgacaucgccgucgaaugggaaucaaacggacaaccagaaaauaacuacaaaacaacaccaccaguacuagacuccgacgguagcuuuuuuuuauacucaaaacuaacaguagauaaaucacgauggcaacaaggcaauguauucaguuguagcgucaugcacgaagcauuacauaaccacuacacacaaaaaucauuauccuuaucuccaggaaaa

SEQ ID NO: 46416 - RNA, 660 nt, Artificial Sequence
  derived and/or modified sequence opt6 from Mepolizumab_LightChain1
gacauaguaaugacacaaucaccagauagccuagcaguaucacuaggagaaagagcaacaauaaacugcaaaucaucacaaucacuacuaaacucaggaaaucaaaaaaacuacuuagcaugguaccaacaaaaaccaggacaaccaccaaaacuacuaauauacggagcaucaaccagagaaagcggaguaccagacagauucucaggaucaggaucaggaaccgauuuuacacuaacaauaagcucauuacaagcagaagacguagccguauacuacugccaaaacguacacucauucccauucacauucggaggaggaacaaaacuagaaauaaaaagaacaguagcagcaccauccguauucauauuccccccaucagaugaacaacuaaaaucaggaacagccucagucgucugcuuacuaaacaacuucuacccaagagaagcaaaaguacaauggaaaguagacaacgcauuacaaucaggaaacucacaagaaucaguaaccgaacaagauagcaaagacucaacauacucacuaagcucaacacuaacauuaucaaaagcagacuacgaaaaacacaaaguauacgcaugcgaaguaacacaccaaggcuuaucaucaccaguaacaaaaucauucaacagaggugaaugu

SEQ ID NO: 46417 - RNA, 1350 nt, Artificial Sequence
  derived and/or modified sequence opt6 from Metelimumab_HeavyChain1
gaaguacaacuuguugaaaguggaggaggaguaguacaaccaggaagaucuuuaagacuauccugugccgcaagcggauucacauucucaucauacggaaugcacuggguaagacaagcccccggcaaagaacucgaauggguagcaguaauaucauacgacgguucaauaaaauauuacgcagauucaguuaaaggaagauuuacaauaucuagagacaacucaaaaaacacauuauaccuacaaaugaacucauuaagagccgaagacacagcaguguauuacugugcaagaacaggagaauacucaggauacgacacagacccgcaauauuccuggggacaaggaacaacaguuacaguuucaucagcaucaaccaagggaccauccguauucccauuagcaccaugcucaagaucaacaucagaaucaacagcugcacuaggcugccuuguaaaagauuacuucccagaaccaguaacaguaucuuggaacuccggugcacuaacaucagguguacacacauuuccagccguauuacaauccucaggauuauacucucuaucaagcguaguaacaguaccaucaucuucacuaggcacaaaaacauauacauguaacguagaccauaaaccuucaaacacaaaagucgacaaaagaguagaaagcaaauacggcccaccaugcccaucaugcccagcaccagaauuucuuggaggacccucagucuuccuauucccuccaaaaccaaaaccuacacuaaugauaucacgaacaccugaaguaacuuguguaguaguagauguaucucaagaagacccagaaguacaauuuaacugguacguugacgguguagaaguacacaacgcaaaaacuaaaccaagggaagaacaauuuaacucaacauaccgcguaguauccguuuuaacaguccuucaccaagacugguuaaacggcaaagaauauaaaugcaaaguaucaaacaaaggucucccaucaucaauugaaaaaacaauaucaaaagcaaaaggacaaccaagagaaccacaaguauauacacuaccaccaucacaagaagaaaugacaaaaaaccaaguaucacuaacuugccuagucaaaggauucuaccccucugauauagcaguagaaugggaauccaacggacaaccagaaaauaacuacaaaacaacaccuccaguucuagacucugacggcucauuuuuucuauauucccgacuaacuguagauaaaucaagauggcaagaaggcaacguauucucauguucaguaaugcaugaagcucuacauaaucacuacacacaaaaauccuuaagcuuaucacucggcaaa

SEQ ID NO: 46418 - RNA, 639 nt, Artificial Sequence
  derived and/or modified sequence opt6 from Metelimumab_LightChain1
gaaauaguacuaacacaaucaccaucaaguuuaagugcaagcguaggagauagaguaacaauaacauguagagcaagccaaggcauaggagacgaccuaggaugguaccaacaaaaaccaggaaaagcaccaauauuauuaauauacggaacaagcacacuacaaagcggaguaccaaguagauucucaggaucaggaucaggaacagacuuuacacuaacaauaaacucauuacaaccagaagacuuugcaacauacuauugcuuacaagauagcaauuacccacuaacauucggaggaggaacaagacuagaaauaaaaagaacaguagcagcaccaagcguauucauauucccaccaucagacgaacaauuaaaaucaggaacagcaucaguaguaugcuuauuaaauaacuuuuacccaagagaggcaaaaguacaauggaaaguagacaacgcauuacaaagcggaaacucacaagaaagcgugacagaacaagacaguaaagacucaacauauagcuuaagcucgacacuuacauuaaguaaagcagauuacgaaaaacauaaaguauacgcaugcgaagucacacaccaagguuuaucaccaguaacaaaaucauucaauagaggagaaugc

SEQ ID NO: 46419 - RNA, 1350 nt, Artificial Sequence
  derived and/or modified sequence opt6 from Milatuzumab_HeavyChain1
caaguccaauuacaacaaucagguuccgaauuaaaaaaaccuggagccucaguaaaaguaucaugcaaagcauccggauacacuuucacaaauuacggaguaaacuggauaaaacaagcacccggacaaggccuacaauggaugggauggaucaauccaaauaccggcgaaccaacauucgaugacgacuuuaaaggccgauucgccuucucacuagacacauccguaucaacagcauacuuacaaauauccagccuuaaagcagacgauaccgcaguuuacuucugcucuagaucucgaggaaaaaaugaagccugguucgcuuacuggggacaaggaacacuaguaacaguaucaucagcauccaccaaaggaccaagcguauuuccacuagcaccaagcaguaaauccacaagcggaggcacagcagcucucggcuguuuagucaaagacuacuucccagaaccaguaacagucucuuggaacagcggagcacuaacaucagguguacacacauucccagcaguacuucaaaguaguggucuauauucccuuucaucaguaguaacaguacccuccucaucacuagggacacaaaccuacaucugcaacgucaaccacaaaccaucaaacacaaaaguagacaaaagaguugaaccaaaaucuugcgacaaaacacacacaugcccaccauguccagcaccagaauuacuaggugguccaucaguauuucuauuuccaccuaaaccaaaagacacauuaaugauaucuagaacaccagaaguaacaugcguaguaguagacguaucucacgaagauccagaaguaaaauucaauugguacgucgauggagucgaaguacauaacgcuaaaaccaaacccagagaagaacaauacaacuccacauauagaguaguaucaguauuaacaguucuacaccaagacugguuaaacggcaaagaauauaaauguaaaguaucuaacaaagcacuaccugcaccaauagaaaaaacaauuucaaaagcaaaaggccaaccaagagaaccucaaguauauacacuaccaccaucaagagaagaaaugacaaaaaaucaaguauccuuaacaugccuaguaaaagguuucuaccccucagacaucgcuguagaaugggaaucaaacggccaaccagaaaauaacuauaaaacaacuccaccaguauuagauuccgacgguucauucuuccuauacucaaaauuaacuguagacaaaucuagauggcaacaaggaaacguauucucauguagcguaaugcacgaagcucuccacaaccauuacacacaaaaaucacuaucauuaucacccggaaaa

SEQ ID NO: 46420 - RNA, 657 nt, Artificial Sequence
  derived and/or modified sequence opt6 from Milatuzumab_LightChain1
gacauacaauuaacacaaucaccacuaucacuacccguaacuuuaggacaaccagcaucaauaucaugcagaucaucacaaucacuaguacacagaaacggaaacacauaccuacacugguuccaacaaagaccaggacaaucaccaagacuacuaauauacacaguaucaaacagauucuccggaguaccagacagauucucaggaucaggaucaggaacagacuucacacuaaaaauauccagaguagaagcagaagacguaggaguauacuuuugcucacaaucaucacacguuccaccaacauucggagcaggaacaagauuagaaauaaaaagaacaguagcagcaccaucaguauucauauucccaccaucagacgaacaacuaaaaucaggaacagccucaguaguaugucuacuaaacaacuucuacccaagagaagcaaaaguacaauggaaaguagacaacgcacuacaaucaggaaacucacaagaauccguaacagaacaagacucaaaagacucaacauacucccuaucaucaacacuaacacuaucaaaagcagauuacgaaaaacacaaaguauacgcaugcgaagucacacaucaaggccuaagcucaccaguaacaaaaucauucaacagaggagaaugu

SEQ ID NO: 46421 - RNA, 1341 nt, Artificial Sequence
  derived and/or modified sequence opt6 from Mirvetuximab_HeavyChain1
caaguacaacuaguacaaucuggagccgaaguaguuaaaccaggcgcaucaguuaaaauaucaugcaaagcuucuggauacacauucacaggauauuucaugaauuggguuaaacaaucaccaggacaaucacuagaauggaucggcagaauacacccauacgacggagacaccuucuacaaucaaaaauuccagggaaaagcuacacuaaccguugauaaaaguucaaacacagcacacauggaacuacuaagccuaacauccgaagacuucgcagucuacuauugcacaagauacgacggaucaagagcaauggacuacuggggucaaggaacaaccgucaccgucucauccgcuuccaccaaaggacccucaguuuucccauuagcaccaucaaguaaaucaacaagcgguggcacagcagcauuaggaugccuuguaaaagacuacuucccagaaccaguuacaguaucauggaacucaggagcacuaacaucuggaguccauacauucccagcaguacuacaaaguuccggauuauacucacuaucaucaguagucacaguaccaucauccucuuuaggaacacaaacauauauaugcaauguaaaccauaaaccaucaaacaccaaagucgacaaaaaaguagaacccaaaucaugugauaaaacacacacauguccaccaugcccagcaccagaauuacuaggaggcccaucaguauuucuauucccccccaaaccaaaagacacauuaaugaucucaagaaccccugaaguaacaugcguaguaguugacguaucacacgaagacccagaaguaaaauuuaacugguacguagauggaguagaaguucacaacgcaaaaacaaaaccuagagaagaacaauacaauuccacguaccgaguuguaucuguacucacaguauuacaucaagauuggcuaaauggaaaagaauauaaaugcaaaguaucaaauaaagcccuacccgcaccaauagaaaaaaccauaucuaaagcaaaaggacaaccacgagaaccacaaguauacacacuaccaccaucccgagaugaacuuacaaaaaaucaaguaucacuaaccugucuaguaaaaggauucuacccuucagacaucgccguugaaugggaaucaaauggccaaccagaaaacaacuacaaaacaacaccaccagucuuagacucagacggaucauucuuccuauacucaaaacucacaguagacaaauccagauggcaacaaggaaacguauuuucuugcucaguaaugcacgaagcucuucacaaccauuacacacaaaaaucauuaucacuaucaccagga

SEQ ID NO: 46422 - RNA, 654 nt, Artificial Sequence
  derived and/or modified sequence opt6 from Mirvetuximab_LightChain1
gacaucguacuaacacaaucaccauuaucacuagcaguaucacuaggacaaccagcaauaauaucaugcaaagcaucacaaucaguaagcuucgccggaacaucauuaaugcacugguaccaccaaaaaccaggacaacaaccaagacuauuaauauacagagcaucaaaccuagaagccggaguaccagacagauucucaggaucaggaucaaaaaccgacuucacauuaacaauaucaccaguagaagcagaagacgcagcaacauacuauugccaacaaucaagagaauauccauacacauucggaggcggaaccaaauuagaaauaaaacgcacaguagcagccccaucaguauucaucuucccaccaucagacgaacaauuaaaauccggcacagcaucagucgucugcuuauuaaacaacuucuacccaagagaagcaaaaguacaauggaaaguagauaacgcacuccaaucaggaaacucacaagaaucaguaacagaacaagacagcaaagacucaacauacucacuauccucaacacuaacauuaucaaaagcugacuaugaaaaacauaaaguauacgcaugcgaaguaacacaccaaggauuaucaucaccaguaaccaaaucauucaacagaggagaaugc

SEQ ID NO: 46423 - RNA, 1344 nt, Artificial Sequence
  derived and/or modified sequence opt6 from Modotuximab_HeavyChain1
caaguacaacuacaacaacccggcgccgaacuagucgaacccggaggcuccguaaaauuaagcugcaaagcaucaggcuacacauucaccucccacuggaugcauuggguaaaacaaagaccaggacaaggccucgaauggauaggagaaauaaauccaucaucaggacguaacaacuacaaugaaaaauucaaaucaaaagcaacacuaaccgucgacaaaucaucuucaacagcauauaugcaauucuccucccuaacaucagaagacucagcaguauauuauugcguacgcuacuauggauacgacgaagcaauggacuacuggggacaaggaacaucuguuacaguuagcagugcaucaaccaaaggaccaucaguauuuccacuagcaccaucaucaaaaucaacaucagguggaacagcagcacuaggaugccuaguaaaagacuacuucccagaaccaguaacaguaucauggaauucuggagcacucaccucuggcguacacacauucccagcaguauuacaaucauccggacuuuacucacuaucaucaguuguaacaguucccuccucuuccuuaggaacacaaacauauaucugcaacguaaaccacaaaccaucaaacacaaaagucgacaaaagaguagaaccaaaaucuugcgauaaaacacacacuuguccaccaugccccgccccugaauuacuaggcgguccaucaguauuuuuauucccaccaaaacccaaagacacauuaaugauuucucgaacacccgaaguaacaugcguagucguagacguaucccaugaagacccagaagucaaauuuaauugguauguagacggaguagaaguacacaaugcaaaaacaaaaccaagagaagaacaauauaacucaacauacagaguaguaaguguauuaacaguacuccaucaagacuggcuaaauggaaaagaauauaaaugcaaaguaucaaacaaagcuuuacccgcacccauagaaaaaacaauaucaaaagccaaaggacaaccacgagaaccccaaguauacacacuaccacccucaagagaagaaaugacaaaaaaucaaguaucucucacaugcuuaguaaaaggauuuuauccaucagauauagcugucgaaugggaaucaaauggacaaccugaaaauaacuauaaaacaacucccccaguacucgacucagaugguuccuucuucuuauacucaaaacuaacaguagacaaaucacgauggcaacaaggcaaugucuuuaguuguucaguaaugcaugaagcgcuucauaaccauuauacacaaaaaucauuaucacucucaccugga

SEQ ID NO: 46424 - RNA, 657 nt, Artificial Sequence
  derived and/or modified sequence opt6 from Modotuximab_LightChain1
gacauaguaaugacacaagcagcauucucaaacccaguaacacuaggaacaucagcaucaauaucaugcagaucaucaaaaucgcuauuacauucaaauggaauaacauacuuauacugguaccuacaaaaacccggacaaucaccacaacuauuaauauaccaaaugagcaauuuagcaucaggaguaccagauagauucucaucaucaggaucaggaacagacuucacccuacgaauaucaagaguagaagcagaagacguaggaguauacuacugcgcacaaaaccuagaauuaccauacaccuucggaggaggcacaaaacuagaaauaaaacgaacggucgcagcaccaagcguauucauauucccaccaucagacgaacaacuaaaauccggaacagcaucaguaguaugcuuacuaaacaauuucuauccaagagaagccaaaguacaauggaaaguagacaacgcacuacaaucaggaaacucacaagaaucaguaacagaacaagacucaaaagacucaacauacucccuaucaucuacacuaacauuaagcaaagcagacuacgaaaaacacaaaguauacgcaugcgaaguaacacaccaaggauuaucaucaccaguaacaaaaucauucaacagaggagaaugc

SEQ ID NO: 46425 - RNA, 1347 nt, Artificial Sequence
  derived and/or modified sequence opt6 from Mogamulizumab_HeavyChain1
gaaguacaauuaguagaaucaggcggagaucuaguccaacccgguagaucucuaagacuauccugcgcagcuucaggauucauauucucaaacuacggaaugucauggguaagacaagccccagguaaaggccuagaauggguagcaacaauauccucugcaucaaccuauuccuacuaccccgauucaguaaaaggacgauucacaauaucacgcgacaacgcaaaaaacuccuuauaucuacaaaugaacucccuccgaguagaagacacagcauuguacuacuguggacgucauuccgacggaaacuuugcauucggauacuggggacaaggaacauuaguaaccguuucuucagcaucuacaaaaggaccgucagucuuuccacuagcaccauccucaaaaucaacaucaggaggcacagcagcacuuggaugcuuaguaaaagauuauuuuccagaaccagucacaguaucauggaauucuggcgcacugaccucaggcguacauacauuccccgcaguacuacaaucuucagguuuauauagcuuaucuucaguaguaacaguaccaucaucaagucuaggcacacaaaccuauauauguaacguaaaccauaaaccaucaaacaccaaaguagauaaaaaaguagaaccaaaauccugcgacaaaacacauacauguccaccaugcccagcaccugaacuccuaggaggaccauccguauuccuauuuccacccaaaccuaaagauaccuuaaugauaucuagaacaccagaagucacaugcguaguaguagacgucucucacgaagacccagaaguaaaauucaacugguauguagacggaguagaaguacacaacgccaaaaccaaaccaagagaagaacaauauaacucaacauacagaguaguauccguucuaacaguucuacaucaagauuggcuaaacgguaaagaauauaaaugcaaaguuuccaauaaagcacuacccgccccaauagaaaaaacaauaucaaaagcaaaaggacaaccuagagaaccccaaguauauacauuaccccccucaagagaugaauuaacaaaaaaccaagucucccucaccugcuuaguaaaaggauuuuaccccuccgacauagcagucgaaugggaaucuaauggacaaccugaaaauaacuauaaaacaacaccacccgucuuagacagugauggaucauucuuuuuauacucaaaacuuacaguagauaaaucaagauggcaacaaggaaauguauucuccugcucuguuaugcacgaagcauuacacaaucacuacacccaaaaauccuuaucacuaaguccaggaaaa

SEQ ID NO: 46426 - RNA, 657 nt, Artificial Sequence
  derived and/or modified sequence opt6 from Mogamulizumab_LightChain1
gacguacuaaugacacaaucaccacucucacuaccaguaacaccaggagaaccagcaucaauaucaugcagaucaucaagaaacauaguacacauaaacggagacacauaccuagaaugguaccuacaaaaaccaggacaaucaccacaacuacuaaucuacaaaguaucaaacagauucucaggaguaccagacagauucucaggaucaggaucaggaacagacuuuacauuaaaaauaucaagaguagaagcagaagacguaggaguauacuacugcuuccaaggaagccuacuaccauggacauucggacaaggaacaaaaguagaaauaaaaagaacaguagcagcaccaucaguauucaucuuccccccaucagacgaacaacuaaaaucaggcacagcaucagucguaugccuauuaaacaacuucuacccaagagaagcaaaaguacaauggaaaguagacaacgcauuacaauccggaaauucacaagaaucaguaacagaacaagacagcaaagacucaacauacagccuuucaucuacacuaacauuaucaaaagcagacuacgaaaaacacaaagucuacgcaugcgaaguaacacaccaaggacuaucaucaccaguaacaaaaucauucaacagaggcgaaugc

SEQ ID NO: 46427 - RNA, 1356 nt, Artificial Sequence
  derived and/or modified sequence opt6 from Monalizumab_HeavyChain1
caaguacaacucguacaaucaggagcugaaguaaaaaaaccaggagccucaguaaaaguaucauguaaagcaucaggcuauacauucacaaguuauuggaugaauuggguaagacaagcaccaggacaaggacucgaauggauggguagaauugacccuuacgauucagaaacacacuaugcgcaaaaacuucaaggaagaguaacaaugaccacugacacaucaacaagcacagcauacauggaacuaagauccuuaagauccgacgacacagcaguauauuacugugccagaggcggauaugauuucgacguaggcaccuuauacugguucuucgauguauggggacaaggaacaacagucacugucucauccgcauccacaaaaggcccauccguauuuccacuagcaccauguucacgaucuacaucagaauccacugcagcacucggaugccucgucaaagacuacuucccagaaccaguaacaguaucauggaacucaggagcacucacuucuggaguacauacauuuccugcagugcuccaaucaucuggacuauacucacucucaagcguaguuacaguaccaucaucaucccuaggaacaaaaaccuauacauguaacguagaccauaaaccuucaaauacaaaaguagacaaaagaguagaauccaaauacggaccaccaugcccuccuugcccugcaccagaauuccuuggcggaccaucaguauuuuuauuucccccaaaaccuaaagauacauuaaugauaucaagaacaccagaaguaacaugcguagucgucgaugucucucaagaagacccagaaguacaauucaacugguauguagacggaguugaaguacacaaugcaaaaacuaaaccaagagaagaacaauuuaauaguacauaccgugucguaucaguccucacuguauuacaucaagauugguuaaacggaaaagaauauaaauguaaaguaaguaauaagggacuacccucaucaauagaaaaaacaauaaguaaagcuaaaggacaaccaagagaaccacaaguauacacauuaccaccaucacaagaagaaaugacaaaaaaucaaguaucauuaacaugucuuguaaaaggauuuuacccaucagauauagcaguagaaugggaaucuaacggacaaccagaaaauaacuauaaaacuacaccaccagucuuagauagcgauggcuccuuuuuucuauacucacgacuaacaguagauaaaucaagauggcaagaaggaaacguauuuucauguagcgucaugcacgaagcacuacauaaccauuacacacaaaaaucauuaucacuaucauuaggaaaa

SEQ ID NO: 46428 - RNA, 642 nt, Artificial Sequence
  derived and/or modified sequence opt6 from Monalizumab_LightChain1
gacauacaaaugacacaaucaccaucaucacuaucagcaucaguaggagaucgaguaacaaucacaugcagagcaucagaaaacauauacucauaccuagcaugguaccaacaaaaaccaggcaaagcacccaaacuccuaauauacaacgcaaaaacacuagcagaaggaguaccaucaagauucucaggaucaggaucaggaacagacuucacacuaacaauaucaucacuacaaccagaagacuucgcaacauacuacugccaacaccacuauggaacaccaagaacauucggaggaggaacaaaaguagaaauaaaaagaacaguagcagcaccaucaguauucauauucccaccaucagacgaacaacuaaaauccggaaccgcaucaguaguaugccuacucaacaacuucuacccaagagaagcaaaaguacaauggaaaguagacaacgcacuacaaagcggaaacucccaagaaagcguaacagaacaagacagcaaagacucaacauacucacuaucaucaacacuaacacuaucaaaagcagacuacgaaaaacacaaaguauaugcaugcgaaguaacacaccaaggccuaucaucaccaguaacaaaauccuuuaacagaggagaaugc

SEQ ID NO: 46429 - RNA, 1350 nt, Artificial Sequence
  derived and/or modified sequence opt6 from Motavizumab_HeavyChain
caagucacauuacgagaaucaggcccugcauuagucaaacccacacaaacauuaacacuaacaugcacauucagcggauucucucuaucaacagcaggaaugucaguaggauggauaagacaaccaccugguaaagcauuagaauggcuagcagacauauggugggacgacaaaaaacacuauaacccuucacuaaaagauagacuaacaauaucaaaagacacaucaaaaaaucaaguuguacuaaaaguaacaaacauggaccccgcagacacagcaacauacuacugugcacgagacaugauauucaacuucuacuucgauguauggggccaaggcacaacaguaacagucucaucagcauccaccaagggaccgagcguauucccacuugcaccaagcaguaaaucaacuucaggaggcacagcagcauuaggcugccuaguaaaagacuacuucccagaaccuguaacagucucauggaacucaggcgcccuaacaucaggaguacacacauuuccagccguacuacaaucaucaggauuauacucauuauccuccguaguaacaguaccauccuccucucuaggaacacaaaccuauauaugcaauguuaaucacaaaccaucaaauacaaaagucgauaaaagaguagaaccaaaaaguugugacaaaacacauacaugcccaccaugccccgcaccagaauuacuaggcggaccuucgguauuccucuucccaccaaaaccaaaagauacacuuaugauaagccguacaccagaagucacauguguaguaguagacgucucacacgaagaucccgaaguaaaauucaacugguacguagauggagucgaaguacauaaugcuaaaacuaaaccaagagaagaacaauacaacuccacauacagaguaguauccguacuaacaguacuccaucaagacuggcuaaacggaaaagaauauaaaugcaaaguaucaaacaaagcacuacccgcaccaauagaaaaaacuauaucuaaagcaaaaggacagccaagagaaccacaaguauacacacuacccccaucaagagaagaaaugacaaaaaaccaaguaucacucaccugccuaguaaaaggcuucuacccaucagauauugcagucgaaugggaaaguaacggacaaccagaaaacaacuacaaaaccacaccaccaguacuagacagcgacggaucauucuuccuauacucaaaacuaacuguagacaaaucuagauggcaacaaggcaaugucuucucauguucaguaaugcacgaagccuuacauaaucacuacacacaaaaauccuuaucacuaucaccaggaaaa

SEQ ID NO: 46430 - RNA, 1350 nt, Artificial Sequence
  derived and/or modified sequence opt6 from Motavizumab_HeavyChain_variant
caaguaacauuaagagaaagcggacccgcauuaguaaaaccaacacaaacucuaacacuaacaugcacauucucaggcuuuucauuauccacugcaggaaugucaguaggauggauccgacaaccaccagguaaagcacucgaaugguuagcagacauauggugggaugacaaaaaacauuauaacccaucacuaaaagaccgauuaacuauaagcaaagauacauccaaaaaccaaguagucuuaaaagucaccaacauggacccagccgacacagcaacauauuacugugcaagagauaugauauucaauuucuacuucgaugucuggggacaaggcacaacagucaccguaucauccgcaucaaccaaaggacccagugucuucccucuagcaccaucaucuaaaaguacaucaggagguacagccgcacuuggauguuuaguaaaagacuauuucccagaaccaguaacaguaucauggaacucaggagcacuaacaucaggaguucauacauuuccugcaguacuccaaagcucaggccuuuacucacuauccaguguaguaacaguaccaucaagcucacuaggaacccaaacauacaucuguaacgucaaccacaaaccaucaaauacaaaaguugacaaaagaguagaaccaaaaucaugcgacaaaacucacacaugcccuccaugcccugcuccugaacuauuaggcgguccauccguauuucucuucccacccaaaccaaaagauacacuaaugauaucaagaacaccagaaguaacaugcguaguaguagacguaucacacgaagauccggaaguaaaauucaacugguauguagauggaguugaaguccacaacgcaaaaacaaaaccacgcgaagaacaauacaacucaacauauagaguaguuucaguauuaacuguacuacaucaagauuggcuaaacggaaaagaauauaaaugcaaaguuucaaacaaagcacuaccagcaccaauagaaaaaacaauaucaaaagcaaaaggacaaccaagagaaccccaaguauacacucuaccaccaagucgagaagaaaugacuaaaaaccaaguuucauuaaccugccuaguaaaaggauucuaccccucugacauugcuguagaaugggaaagcaacggacaaccagaaaacaacuacaaaacaacacccccaguccucgacucagauggaucauucuucuuauacucaaaacuaacaguagauaaaucaagauggcaacaagguaacguauucucaugcucuguaaugcacgaagcauuacacaaucauuacacacaaaaaaguuuauccuuaagcccagguaaa

SEQ ID NO: 46431 - RNA, 639 nt, Artificial Sequence
  derived and/or modified sequence opt6 from Motavizumab_LightChain
gacauacaaaugacccaauccccaucaacauuaucagcaucaguaggagacagaguaacaauaacaugcuccgcaucaucaagagucggauacaugcacugguaccaacaaaaaccaggaaaagcaccaaaauuacuaaucuacgauacaucaaaauuagcauccggaguaccaucaagauucucaggaucaggaucaggaacagaauucacacuaacaauaagcucacuacaaccagacgauuucgcaacauacuacugcuuccaaggauccggauacccauucacauucggaggaggaacaaaaguagaaauaaaacgaacaguagcagcaccaucaguauucauauucccaccauccgacgaacaacuaaaaucaggaaccgccucaguaguaugccuacuaaauaacuucuacccaagagaagcaaaaguacaauggaaaguagacaacgcauuacaaucaggaaauucacaagaauccguaacagaacaagacucaaaagacucaacauacagcuuauccucaaccuuaacacuaucaaaagcagacuacgaaaaacacaaaguauacgcaugcgaaguaacacaccaaggcuuaucaucaccaguaacaaaaucauucaacagaggagaaugc

SEQ ID NO: 46432 - RNA, 639 nt, Artificial Sequence
  derived and/or modified sequence opt6 from Motavizumab_LightChain_variant
gacauacaaaugacacaaucaccauccacacuaucagcaucaguaggagacagaguaacaauaacaugcucagcaucaucaagaguaggauacaugcacugguaccaacaaaaaccaggaaaagcccccaaacuacuaauauacgacacaucaaaacuagcaucuggaguaccaucaagauucucaggaucaggaucaggaacagaauucacacuaacaauauccucauuacaaccagacgacuucgcaacauacuacugcuuccaaggauccggauacccauucacauucggaggaggaaccaaaguagaaauaaaaagaacaguagcagcuccaucuguauucauauucccaccaucagacgaacaacuaaaaucaggaacagcaucaguaguaugccuauuaaacaacuucuacccacgcgaagcaaaaguacaauggaaaguagauaacgccuuacaaucaggaaacucacaagaaucaguaaccgaacaagacuccaaagauucuacauacucauuaucaucaacacuaacacuaucaaaagcagacuacgaaaaacacaaaguauacgcaugugaaguaacacaccaaggccuaucaucaccuguaacaaaaucauucaaccgaggagaaugu

SEQ ID NO: 46433 - RNA, 1428 nt, Artificial Sequence
  derived and/or modified sequence opt6 from Moxetumomab_pasudotox_HeavyChain1
auggaaguucaguuaguagaaucaggaggaggauuaguaaaaccaggagguagucuaaaauuaagcugugccgcaucggguuuugcauuuucaauuuaugauaugucauggguaagacaaacacccgaaaaauguuuagaauggguagcauauauaaguucagguggaggaacgacuuacuacccagacacuguaaaagguagauuuacaauaucucgagauaaugcaaaaaauacauuauacuuacaaaugucaaguuuaaaauccgaagauacagcaauguacuauugcgcaagacauucaggauauggaacacauuggggaguuuuauuugcauauuggggacaaggaacgcuaguaacuguuagugcaaaagcaagugguggaccagaagguggaucauuagcagcauugacugcacaccaagcaugucacuuaccacuugaaacauuuacaagacaucgacaaccacgaggaugggaacaacuagagcaauguggauauccuguacaaagauuaguagcauuauacuuagcagcaagacuaaguuggaaucaagucgaucaaguaauuaggaaugcacuagcaaguccaggaucagguggcgaccuaggagaagcuauaagagaacaaccagaacaagcacgacuagcacuaacauuagcugcggcagaaucagaaagauuuguuagacaaggaacaggaaacgaugaagccggggcagcaaacggaccugcagacaguggagacgcauuacuagaaagaaauuauccaacaggagcagaauuuuuaggagauggaggagauguaaguuuuucaacaagaggaacucagaauuggacaguagaaagacuacuacaagcacauagacaauuagaagaaagagguuauguauucguaggauaucauggaacauuucucgaagcugcacaaaguauaguauuuggcggaguaagagcuagaagucaagauuuagaugcaauauggaggggauuuuauaucgcaggagauccagcauuagcauauggauaugcacaagaucaagaaccagacgcuagagguagaauaagaaauggagcacuuuuaagaguauauguaccaagaaguucacuuccagguuuuuauagaacaucguuaacuuuagcagcaccagaagcagcaggagaaguagaacgacuaauuggacauccacuaccucucagauuagaugcgauaacaggcccagaagaagaaggaggaagacuagaaacuaucuuaggauggccacuugcggaaagaacuguaguaauaccuucagcaauaccuacagauccaagaaauguaggaggugacuuagauccaagcucaauacccgauaaagagcaagcaauaucagcauuaccagauuaugcaagucaaccuggaaaaccuccaagagaagauuuaaaa

SEQ ID NO: 46434 - RNA, 324 nt, Artificial Sequence
  derived and/or modified sequence opt6 from Moxetumomab_pasudotox_LightChain1
auggacauacaaaugacacaaacaacaucaucacuaucagcaucacuaggagacagaguaacaauaucaugcagagcaucacaagacauaucaaacuaccuaaacugguaccaacaaaaaccagacggaacaguaaaacuacuaauauacuacacaucaauacuacacucaggaguaccaucaagauucucaggaucaggaucaggaacagacuacucacuaacaauaucaaaccuagaacaagaagacuucgcaacauacuucugccaacaaggaaacacacuaccauggacauucggaugcggaacaaaacuagaaauaaaa

SEQ ID NO: 46435 - RNA, 1350 nt, Artificial Sequence
  derived and/or modified sequence opt6 from Muromonab-CD3_HeavyChain
caaguacaacuacaacaaucaggugcugaacuagcaagaccaggagcaucaguaaaaaugucaugcaaagccagcggauacacauucacaagauauacaaugcacuggguaaaacaaagaccaggacaaggccuagaauggaucggauacauaaacccaucuagaggauacacaaauuacaaccaaaaauucaaagacaaagcaacacuuacuaccgacaaaucaucaaguaccgcauacaugcaacuauccucacuaacaucagaagacucagcuguauauuacugcgcaagauacuacgaugaucacuacugucuagacuacuggggacaaggaaccacccuaacaguauccucagcuaaaacaacugcaccaaguguauauccacuagcaccaguaugcggaggaacaacaggauccucuguaacucuaggcugccuaguaaaaggauauuucccugaaccaguaacacuaacuuggaacucaggaucacuauccucaggaguacacacauucccagcuguacuccaaucugacuuauacacacuaucaucaucaguaacaguaacuucaucaacauggccaucucaaucaaucaccugcaacguagcccauccugcaucaucaacaaaaguagacaaaaaaauagaaccaagaccaaaaucaugugacaaaacacacacaugucccccuugucccgcaccagaacuacuaggaggaccaucaguauucuuauuccccccaaaaccaaaggacacuuuaaugauaagccguaccccagaaguaacaugcguaguaguggacguaucccacgaagacccugaaguaaaauucaauugguacgucgauggaguagaaguucacaacgcaaaaacuaaaccaagagaagaacaauauaauuccacauaccgaguaguaucaguacuaacuguccuacaccaagacuggcuaaauggaaaagaauauaaaugcaaagucucaaacaaagcauuaccagccccaauagaaaaaacaauaagcaaagcaaaaggacaacccagagaaccccaaguauauacauuaccaccauccagagaugaacuaacaaaaaaccaaguaucacuaaccugccuaguaaaaggcuucuacccaagcgacauagcaguagaaugggaaucuaacggacaaccagaaaauaauuauaaaacaacacccccaguacuagacuccgacggaucuuucuuucuuuauucaaaacuaaccguugacaaaucaagauggcaacaagguaauguauucucaugcucuguaaugcaugaagcccuccacaaccacuacacccaaaaaucauuaucauuaucaccaggaaaa

SEQ ID NO: 46436 - RNA, 639 nt, Artificial Sequence
  derived and/or modified sequence opt6 from Muromonab-CD3_LightChain
caaauaguccucacacaaucaccagcaaucaugucagcaucaccaggagaaaaaguaacaaugacauguucagcaucaucaucaguaucauacaugaacugguaccaacaaaaaucaggaacuucaccaaaaagauggauauacgacacaucaaaauuagcaucaggaguaccagcacacuucagaggaucaggaucaggaacaucauauucccuaacaauaucaggaauggaagcagaagaugcagcaacauacuacugucaacaauggucaucaaacccauuuacauucggaucaggaacaaaacuagaaauaaacagagccgacacagcaccaacaguauccauauucccacccucaucagaacaauuaacaucaggaggagcaucuguaguaugcuuccuaaacaacuucuacccaaaagacauaaacguaaaauggaaaauagacggaucagaaagacaaaacggaguacuaaacucauggacagaccaagacucaaaagacucaacauacucaaugucaucaacacuaacacuaacaaaagacgaauacgaaagacauaacucauacacaugcgaagcaacucacaaaacaucaacaagcccaauaguaaaaucauucaacagaaaugaaugu

SEQ ID NO: 46437 - RNA, 1347 nt, Artificial Sequence
  derived and/or modified sequence opt6 from Namilumab_HeavyChain1
caaguccaacuaguacaaucaggagcugaaguuaaaaaacccggugcauccguaaaaguaucuugcaaagcauuuggcuacccauuuacagacuaucuacuucauuggguacgccaagcaccaggacaaggauuagaauggguaggauggcuaaacccuuauagcggagauaccaacuacgcucaaaaauuccaaggaagaguaacaaugacaagagauacaucaaucuccacagcauacauggaacuuucuagauuacgcucugacgacacagccgucuauuacuguacaagaacaacacuaauaucaguauacuucgauuacuggggacaaggaaccauggucacaguaucaucagcaucaaccaaagguccaucagucuucccacuugccccaucuucaaaaucaacuucuggaggaacagcagcccuaggaugcuuaguaaaagauuacuuccccgaaccagucaccguaucauggaacagcggugcacuaacuucaggaguacacacauucccagcagucuuacaaucuucaggauuauacucucuaucaucaguagucaccguaccaucauccucacuaggaacacaaaccuacauaugcaauguaaaccauaaaccauccaauacaaaaguagauaaaaaaguugaaccaaaaaguugcgacaaaacacauacuuguccaccuuguccagccccagaauuauuaggcggaccuucaguauuccuauuuccaccuaaaccaaaagacacccuuaugauaucaagaaccccugaaguaacaugcguuguagucgacguuucucacgaagacccagaagucaaauucaacugguacguagacggaguagaaguacacaacgcaaaaacaaaacccagagaagaacaauacaacucaacauauagaguagucucuguauuaaccguacuccaccaagacuggcuaaaugguaaagaauacaaaugcaaaguauccaauaaagcacuaccagcaccaaucgaaaaaacuauuucaaaagccaaaggucaaccuagagaaccucaaguauacacacuaccccccucacgugacgaauuaacaaaaaaccaaguaucucuaacgugucugguaaaaggauucuacccaucugauauugcaguagaaugggaaucaaacggccaaccagaaaauaacuauaaaacaacuccaccuguauuagacucugacggcucauucuucuuauauucaaaacuaacaguagacaaaucaagauggcaacaaggaaacguauucucuugcucaguaaugcacgaagcauuacacaaucauuacacacaaaaauccuuaucacucagcccaggaaaa

SEQ ID NO: 46438 - RNA, 642 nt, Artificial Sequence
  derived and/or modified sequence opt6 from Namilumab_LightChain1
gacauacaaaugacacaaucaccaucaucaguaucagcaucaguaggagacagaguaacaauagccugcagagccucacaaaacauaagaaauauauuaaacugguaccaacaaagaccaggaaaagcaccccaacuauuaauauaugccgcaucaaaccuacaaucaggaguaccauccagauucucaggaucaggaucaggaacagacuucacauuaacaauaaacucacuacaaccagaagacuucgccacauauuacugccaacaaucauacucaaugccaagaacauucgguggaggaacaaaacuagaaauaaaaagaacagucgcagcaccaucaguauucauauucccaccaucagacgaacaacuaaaaucaggaacagccucaguaguaugccuacuaaacaacuuuuacccaagagaagcaaaaguacaauggaaaguagacaacgcacuccaaucaggaaauucacaagaaucaguaacagaacaagacucaaaagacucaacauacucacuaucaucuacacuaacacuaucaaaagcagacuacgaaaaacacaaaguauacgcaugcgaaguaacacaccaaggauuaaguucaccaguaaccaaaucauuuaacagaggcgaaugu

SEQ ID NO: 46439 - RNA, 1374 nt, Artificial Sequence
  derived and/or modified sequence opt6 from Naptumomab_estafenatox_HeavyChain
gaaguccaacuacaacaaucaggaccagaucuuguaaaaccaggugcaucaguuaaaauaucauguaaagccuccggauacucauuuacuggauacuauaugcauugggucaaacaaucgcccggaaaaggacuagaauggauagguagaaucaaucccaauaacggagucacucuuuauaaccaaaaauuuaaagacaaagcaacacuaacaguagacaaaucaucaacaacagcauacauggaacuacguucucuaacaucagaagauagcgcagucuauuacugcgcaagaucaacaaugauaacuaacuacguaauggauuacuggggacaaggaacaagcguaacaguuucaucagcaaaaacaacacccccaucaguauacccacucgcaccuggaucagcagcccaaacaaacucaaugguaacacuagguugccuaguaaaaggauacuucccagaaccagucacugucaccuggaacaguggaucauuaucaucaggaguacacacauuuccagcaguacuacaaucagaccucuauacccuauccucuuccguaacaguaccaucauccacauggcccucagaaaccguaacaugcaacgucgcacacccagcuucaucaacaaaagucgacaaaaaaauaguaccuagagacucuggaggacccucugaaaaauccgaagaaauaaaugaaaaagacuuacgcaaaaaaucagaacuacaagguacugcacuagguaaccuaaaacaaauauacuacuauaauucaaaagcaauaaccucaucugaaaaaucagcugaccaauuucuaacuaacacauuauuauuuaaaggauucuucacaggacauccaugguacaaugaccuacuaguagaccuaggaucaacggcagccacaucagaauacgagggauccucaguagacuuauauggagccuauuauggauaccaaugcgcaggcggcacaccaaauaaaacagcaugcauguacggaggagucacacuucacgacaauaaccgauuaacagaagaaaaaaaaguacccauaaaccuauggauugauggaaaacaaacaacaguaccaauugacaaaguaaaaacauccaaaaaagaagucacaguacaagaacuagacuugcaagcacgacacuacuuacacggaaaauucggucuauauaauucagauucauuuggaggaaaaguccaaagaggauuaauaguauuucacucaucagaaggaucaacaguaucauaugaucuauuugacgcacaaggacaauauccagacacucuacucagaaucuaccgagauaacaccacaauaucauccacaucacuaucaauaagucuauaucucuacacaacu

SEQ ID NO: 46440 - RNA, 642 nt, Artificial Sequence
  derived and/or modified sequence opt6 from Naptumomab_estafenatox_LightChain
uccauaguaaugacacaaacaccaacaucacuauuaguaucagcaggagacagaguaacaauaacaugcaaagcaucacaauccguaucaaacgacguagccugguaccaacaaaaacccggacaaucacccaaauuacuaauauccuacacaagcucaagauacgcaggaguaccagacagauucucaggaucaggauauggaacagacuucacacuaacaauaucaucaguacaagcagaagacgcagccguauacuucugccaacaagauuauaacucaccaccaacauucggaggaggaacaaaacuagaaauaaaaagagcagacgcagcaccaacaguaagcauauucccaccaucaucagaacaauuaacaucaggaggagcaucaguaguaugcuuccuaaacaacuuuuacccaaaagacauaaacguaaaauggaaaaucgacggaucagaaagacaaaauggaguacuaaacucauggacagaucaagacucaaaagacucaacauacucaaugucaucaacacuaacccuaaccaaagacgaauacgaaagacacaacucauacacaugcgaagcaacacauaaaacaucaacaucaccuauaguaaaaucauuuaacagaaaugaaagc

SEQ ID NO: 46441 - RNA, 1356 nt, Artificial Sequence
  derived and/or modified sequence opt6 from Narnatumab_HeavyChain1
gaaguacaacuuguagaaucaggcggaggccuuguccaaccuggcggaucacuaagauuaucaugugcagcuucaggauucacuuuuucaucauaucuaaugacauggguacgacaagcaccuggaaaaggucuagaauggguugcuaacaucaaacaagauggcucagaaaaauacuauguagacucugucaaaggaagauucaccauaucccgcgauaacgcaaaaaacucuuuaaaccuucagaugaacucauuaagagcagaagacacagcaguauacuacugcacaagagaugguuacucaucaggaagacauuacggaauggaugucuggggacaagggacaacaguaauaguauccucagcaucaacaaaaggaccaucaguauuuccauuagcaccaucuucaaaaucgacaucuggagguacagcugcacuaggaugcuuaguaaaagacuauuucccagaaccaguaacuguaucauggaacucaggcgcucucacaucagguguacacaccuucccugcaguauuacaauccucaggacuauauucacucucaucaguaguaacagucccaucaucaucccuaggaacccaaacauauauauguaacguaaaccacaaaccaucaaacaccaaaguagacaaaagaguugaaccaaaauccugcgacaaaacucacacuuguccaccuuguccugccccagaauuacuaggaggaccauccguauuucuauucccaccaaaaccaaaagauacauuaaugauaucuagaacaccagaaguaaccugcguagucguagacguaucacacgaagacccagaaguaaaauucaauugguacguagacggcguagaaguccacaaugcaaaaacaaaaccacgagaagaacaauacaacaguacauacagaguaguaucaguccuaacaguacuacaccaagacugguuaaacggcaaagaauauaaaugcaaaguaucaaauaaagcacucccagcaccaauugaaaaaacuauaucaaaagcuaaaggccaaccucgagaaccacaaguauauacccuuccacccuccagagaagaaaugaccaaaaaucaaguaucauuaacauguuuaguuaaaggcuucuacccaucagauaucgcaguugaaugggaaucaaauggacaaccagaaaauaauuacaaaacuacaccaccaguacucgacucagauggaucauucuucuuauacucaaaauuaacaguagacaaaucaagauggcaacaaggcaacguuuucucauguagcguuaugcaugaagcauuacacaaccauuauacccaaaaaucacuaucucuauccccgggaaaa

SEQ ID NO: 46442 - RNA, 642 nt, Artificial Sequence
  derived and/or modified sequence opt6 from Narnatumab_LightChain1
gaaauaguacuaacacaaucacccgcaacauuaucauuaucaccaggagaaagagcaacauuaucaugcagagcaagccaaucaguaucaagauacuuagcaugguaccaacaaaaaccaggacaagcaccaagacuauuaauauacgacgcaucaaacagagcaacaggaauaccagcaagauucucaggaucaggaucaggcacagauuucacccuaacaauaucaucacuagaaccagaagacuucgcaguauacuacugccaacaaagaucaaacuggccaagaacauucggacaaggaacaaaaguagaaauaaaacgcacaguagcagcacccagcguauucauauuuccacccucagacgaacaauuaaaaucaggaacagcaucaguaguaugccuacuaaacaacuucuacccacgagaagcaaaaguccaauggaaaguagacaaugcacuacaaucagguaauucacaagaaucaguaacagaacaagacucaaaagacucaacauauucacuauccucaacauuaacauuaucaaaagcagacuacgaaaaacacaaaguauacgcaugcgaaguaacacaccaaggauuaucaucaccaguaacaaaaagcuucaacagaggagaaugc

SEQ ID NO: 46443 - RNA, 1350 nt, Artificial Sequence
  derived and/or modified sequence opt6 from Natalizumab_HeavyChain1
caaguccaauuaguacaaucaggagccgaagucaaaaaaccuggagcaucaguaaaaguuucaugcaaagcaucaggcuucaauauaaaagacacauacauacacuggguacgucaagcaccaggacaaagauuagaauggaugggccguauagauccagccaacggauacacaaaauaugauccaaaauuucaaggcagaguaacaauuacagcugauacuuccgcaucaacagcauacauggaauuauccucacuaagaucagaagacacagcagucuauuauugcgcaagagaaggauacuaugguaauuacggaguauacgcaauggauuacuggggccaaggaacacuaguaacaguuucauccgcaucaacaaaaggaccauccguauucccacuagccccaugcuccagaucaacaucagaaucaacagcagcacuugguugccuagucaaagacuacuuuccagaaccaguaaccgucagcuggaauucaggagcacuaacaucaggaguccacacauucccagcaguauuacaaucaucaggauuauacucacuaucaucaguaguaacaguaccuucaucaucucuaggcacaaaaaccuauacauguaacguagaccacaaaccaaguaauacaaaaguagauaaacgagucgaauccaaauacggccccccaugcccauccugcccagcuccagaauuuuuaggcggcccaucuguauuucuauuuccucccaaaccaaaagauacauuaaugauauccagaacaccagaaguaacaugcguagucguugacguaucacaagaagacccagaaguacaauuuaacugguacguugacggcguagaaguacacaaugcaaaaacaaaacccagagaagaacaauucaacucaacauacagaguaguuucaguacuaacagucuuacaucaagacugguuaaacggaaaagaauauaaaugcaaaguuaguaauaaaggacucccaucauccauagaaaaaacaauaucaaaagcuaaaggucaaccaagagaaccacaagucuacacacuccccccuucacaagaagaaaugaccaaaaaucaaguaucccuaacauguuuaguaaaaggauucuacccaucagauaucgcaguugaaugggaaagcaacggacaaccagaaaacaacuauaaaacaacacccccaguacuagacucagauggaucauuuuuucuauauucaagacuaacaguagacaaauccagauggcaagaaggaaacguauucucauguagcguaaugcacgaagcacuacauaaccacuauacacaaaaaagcuuaucacucucacuaggaaaa

SEQ ID NO: 46444 - RNA, 639 nt, Artificial Sequence
  derived and/or modified sequence opt6 from Natalizumab_LightChain1
gacauacaaaugacacaaucaccaucaucacucucagcaucaguaggagacagaguaacaauaacaugcaaaacaucccaagacauaaacaaauacauggcaugguaccaacaaacaccaggaaaagcaccaagacuacuaauacacuacacaucagcacuacaaccaggaauaccaucaagauucucaggauccggaagcggacgagacuacaccuucacaauaucaucacuacaaccagaagacauagcaaccuacuacugccuacaauaugacaaccuauggacauucggacaaggaacaaaaguagaaauaaaaagaacaguagcagccccaucaguauucauauucccaccauccgacgaacaauuaaaauccggcacagcauccguaguaugccuacucaauaacuucuacccaagagaagcaaaaguacaauggaaaguagacaacgcauuacaaucaggaaacucccaagaauccguaacagaacaagauucaaaagacucaacauacucacuaucaucuacacuaacacuaucaaaagcagacuacgaaaaacauaaaguauacgcaugcgaaguaacacaccaaggacuaucaucaccaguaacaaaaucauucaacagaggagaaugc

SEQ ID NO: 46445 - RNA, 1335 nt, Artificial Sequence
  derived and/or modified sequence opt6 from Navicixizumab_HeavyChain1
caaguacaauuaguacaauccggagcagaaguaaaaaaaccaggagcaucaguaaaaauaucauguaaagcaucaggauacuccuucacagcauacuacauacacuggguaaaacaagcaccaggacaaggacucgaauggauuggauacauaucaaauuacaaccgagcaaccaauuacaaucaaaaauuuaaaggaagaguaacuuuuaccacagacacaucaacuucaacagcauauauggaacuucgaucacuaagaagugaugauacagcaguauauuacugugcgagagacuaugacuaugauguaggaauggauuacuggggacaaggaacacuaguaacaguaucaagugccucaacuaaagguccuucuguauucccucuagcaccuuguuccagaucaacuucagaaucaacagccgcauuaggaugccuaguaaaagacuacuuuccagaaccaguaacaguuaguuggaacucaggagcccuaacaucaggaguacauacauuuccugccguucuacaaucaucaggauuauauucccucuccucuguaguaacuguaccauccucaaauuucggcacacaaaccuacacauguaacguagaccacaaaccuaguaauacaaaaguagacaaaaccguagaaagaaaaugcugcguagaaugcccaccauguccagcaccaccaguagcaggacccucaguauuccuuuucccaccaaaacccaaagacacacuaaugauaucaagaacaccagaaguaacaugcguagucguagacguaucucacgaagaccccgaaguacaauucaauugguacguugacggcguagaaguccauaaugcuaaaacaaaaccacgagaagaacaauucaacucaaccuuucgcguagucucaguacuaacugucguacaccaagauugguuaaacggaaaagaauauaaaugcaaaguauccaacaaaggacuacccgcaccaaucgaaaaaacaauaucaaaaacaaaaggacaaccacgagaaccacaaguauacacacuaccacccucaagagaagaaaugacaaaaaaccaagucucucuaacaugcuuaguagaaggcuuuuacccaucagacauagccguagaaugggaaucaaauggacaaccagaaaauaacuacaaaacaacaccaccgauguuagacuccgacgguucuuucuuccuauacucagaauuaacagucgacaaaagucguuggcaacaaggaaacguauuuucauguucaguaaugcaugaagcccuacacaaccacuauacacaaaaaucucuuucauuaucacccggaaaa

SEQ ID NO: 46446 - RNA, 1341 nt, Artificial Sequence
  derived and/or modified sequence opt6 from Navicixizumab_HeavyChain2
caaguacaacucguacagucaggagcagaagucaaaaaaccaggagcaucagucaaaguaucaugcaaagccuccggauacacauucacaaauuacuggaugcauuggguacgacaagcaccaggacaaggacuagaauggaugggagauaucaacccaucaaacgguagaacaucuuauaaagaaaaauucaaaagacgaguaacucuauccguagacaaaucaucuucaacagcauacauggaacuaucauccuuacgcucagaagauaccgcaguuuauuucuguacaauccacuacgacgauaaauauuauccauuaauggauuauuggggacaaggaacacuuguaacaguauccucagcuucaacaaaagguccaucuguauuuccacucgcaccaugcucaagaagcacaagugaaucuaccgccgcccucggaugccuuguaaaagauuacuucccagaaccaguaacaguaucuuggaacucaggcgcucuaacaucaggaguacacacauuccccgcaguauuacaaucaucaggacuauauucccuauccucaguaguaacaguaccaucauccaauuuuggaacucaaacauacaccugcaacguagaccauaaacccucaaacacaaaaguugauaaaacaguagaaagaaaaugcugcguagaaugcccaccauguccagcuccacccguagcaggcccaucagucuuucucuucccacccaaacccaaagacacacuuaugauaucuagaacacccgaaguaacaugcguaguaguagauguaucccacgaagacccagaaguacaauucaacugguacgucgauggaguagaaguacauaaugcaaaaaccaaacccagagaagaacaauucaacucaaccuuccgcguaguuagcguucuaacaguaguacaucaagacuggcuaaacggaaaagaauauaaauguaaaguauccaacaaaggcuuaccagcuccaauagaaaaaacaauaucuaaaacaaagggacaaccaagagagccccaaguauauacacuaccacccagccgcgaaaaaaugaccaaaaaccaaguaucauuaacauguuuaguaaaaggauucuauccaucagauauagcagucgaaugggaauccaauggacaaccagaaaacaacuacaaaacaacaccaccuauguuaaaaucugacggauccuucuuuuuauauucaaaauuaaccguagauaaaucccgauggcaacaaggaaauguauuuucauguucagucaugcaugaagcccuacauaaucacuauacacaaaaaucacuaucacuauccccuggaaaa

SEQ ID NO: 46447 - RNA, 654 nt, Artificial Sequence
  derived and/or modified sequence opt6 from Navicixizumab_LightChain1
gauaucguaaugacacaaucaccagacagcuuagcaguaucauuaggagaaagagcaacaauaucaugucgagcaagcgaaagcguagacaauuacggaauaucauucaugaaaugguuccaacaaaaaccaggacaaccaccaaaauuauuaauauaugcagcaagcaaucaaggaagcgguguaccugacagauucucaggaucaggaucaggaacagacuuuacauuaaccauaagcucacuacaagcagaagacguagccguauacuauugccaacaaucaaaagaaguaccauggacauucggaggaggaacaaaaguagaaauaaaacgaacaguagcagcaccaagcguauucauauucccaccuucagacgaacaauuaaaaucaggaacagcaucaguaguaugccuacuaaauaacuucuacccaagagaagcaaaaguacaauggaaagucgauaacgcacuacaaagcggaaacucacaagaaucaguaacagaacaagauagcaaagacucaaccuauagccuaaguucgacacuaacauuaagcaaagcagauuaugaaaaacauaaagucuacgcaugcgaaguaacacaccaaggcuuaagcucaccaguaacaaaaagcuuuaacagaggagaaugu

SEQ ID NO: 46448 - RNA, 1368 nt, Artificial Sequence
  derived and/or modified sequence opt6 from Navivumab_HeavyChain1
caaguccaacucguacaaucuggagcagaagucaaaaaaccaggagccucaguaaaaguuaguugcaaaacaucaggcuacucauuuucaacauacggaguuucauggguaagacaagcaccaggccaaggcccagaaugggucggauggauuucagcauacacaggaauuacagacuacgcacaaaaauuccaaggaagaguaacacuaacaacagaugcaaccacagcaacagccuuuuuagaucuaagaaguuuaagaccagacgauacagcaacauacuuuugugcaagagauaaaguccaaggucgaguagaaguaggaucaggaggacgccacgauuacuggggucaaggaacauuaguaauaguaucaucugcuucuacaaaaggccccucagucuuucccuuagcuccaucauccaaaucaacaucaggaggaacagccgcucuagguugccuaguaaaagacuacuucccagaaccaguaacaguaaguuggaacucaggagcauuaacaucagguguacacacuuuuccagcuguccuacaaucuucaggccuauauucucuaagcucgguuguaacuguacccucaucaucacucggcacacaaacauacauauguaacguuaaucauaaaccuucaaacacaaaaguagacaaaaaaguagaaccaaaaucaugcgacaaaacacauacuuguccaccaugcccagcuccugaauuacuaggcggacccuccgucuucuuauucccaccaaaacccaaagacacacuaaugauaucaagaacacccgaaguaacaugcguaguaguagacgucucacacgaagauccagaaguuaaauucaauugguauguugauggaguagaaguacauaaugcaaaaacaaaacccagagaagaacaauacaacucuacauaccgagucguaucaguacuuacaguacuacaucaagacugguuaaauggcaaagaauauaaaugcaaaguaucaaacaaagcucuaccagcuccaauagaaaaaacaauaucaaaagcaaaaggccaaccaagagaaccacaaguauacacuuuaccaccaucaagagacgaacuuaccaaaaaccaaguaagucuaacaugcuuagucaaaggauucuauccaucagauauagcaguagaaugggaaucaaauggacaaccagaaaacaauuacaaaacaacaccaccaguauuagauucagacgguucuuucuuccuauacucuaaauuaacaguagacaaaaguagauggcagcaggguaauguauucucaugcucuguaaugcaugaaggcuuacauaaucauuauacacaaaaaucacuaucacuaucaccagguaaa

SEQ ID NO: 46449 - RNA, 645 nt, Artificial Sequence
  derived and/or modified sequence opt6 from Navivumab_LightChain1
gaaguaguauuaacacaaagcccaggaacauuagcauuaccaccaggagaaagagcaacacuaucaugcagagcaucacaccgaguaggaucaacauacauagcaugguaccaacaaaaaagcggacaagcaccaagaagacuaauauacggcgcaucaaaccgagcaacagacauaccagacagauucucaggaucaggaucaggaacugacuucacauuaacaauaagaagacucgaaccugaagacucagcaguauacuacugccaacaauucagcguaagcccauggacauucggacaaggaacaagaguagaaauaaaaagaacaguagcagcaccauccguauucauauucccaccaucugacgagcaacuaaaaucaggaacagcaucagucguaugccuacuaaauaacuucuacccaagagaagcaaaaguacaauggaaaguagacaacgcauuacaaaguggaaacucacaagaaaguguaacagaacaagacucaaaagauucaacauacagccuaucaucaacauuaacauuaagcaaagcagacuacgaaaaacacaaaguauacgcaugcgaaguaacacaccaaggauuaaguucaccaguaacaaaaucauucaacagaggagaaugc

SEQ ID NO: 46450 - RNA, 2172 nt, Artificial Sequence
  derived and/or modified sequence opt6 from Ndimab-varB_HeavyChain
caaguacaacuaguagaaaguggaggaggcguuguucaacccggcagaagcuuacguuuaaguugugcugcuucugguuuuauauuuaguagcuaugccaugcauugggucagacaagcaccagguaauggcuuagaguggguagcuuuuaugucguacgacggauccaauaaaaaauacgcagauucaguaaaaggaagauucacuauaucuagagacaacagcaaaaacacacucuaccuacaaaugaacucacuucgagcagaggauacagcuguuuacuauugugcaagagauagaggcaucucagcaggagguaauuacuauuacuauggaauggauguauggggacaaggaacaacaguaacaguuucaucagcaucaacaaaaggcccaaguguauucccacuagccccaucaucaaaaaguacaaguggaggaacagcugcacuaggaugucugguuaaagauuauuuccccgaaccaguaacaguaaguuggaauucaggagcuuuaacaucaggcguacacacuuucccagcaguacuacaaaguucaggucuauacucccuaagcaguguaguaacuguaccuaguucaagucuaggaacacagacauauauaugcaacguaaaucauaaaccuaguaauacaaaaguagauaaaagaguugaaccaaaaagcugugacaaaacgcauacaugcccuccaugcccagcaccagaguuacuaggaggaccaucaguauucuuauuuccuccaaaaccuaaggacacauuaaugauaagcagaacaccggaagucacauguguaguaguagauguaucucaugaagauccggaagugaaauucaacugguacguagauggagucgaaguacauaaugcaaaaacuaaacccagagaagaacaauacaauucaacuuacagaguaguaucaguacuuacaguacuucaucaagauuggcucaaugguaaggaauauaaaugcaaagugaguaacaaagcucuaccugcaccaauagaaaaaacaauaaguaaagcaaaaggacaaccaagggaaccacaaguauauacacuaccaccaucucgagaagaaaugaccaaaaaucaagucucuuuaacuugucugguaaaaggauuuuauccaucagauauagcaguugaaugggaaagcaauggacaaccagaaaauaauuauaagaccacaccacccguacuugauagcgauggauccuuuuucuuauauucuaaacuaacuguagauaaaucaagauggcaacaaggaaauguguuuagcuguucugugaugcaugaagcauugcauaaccauuacacacaaaaaucauuaucacuaaguccagguaaaggcggaggaggaagcggaggaggcggcucucaaguacaauuaguacaaucaggagccgaagucaaaaaacccgguucaaguguuaaaguaucaugcaaagcaucaggcggaacuuuuucaacauaugguauaaguuggguaagacaagcaccaggacaaugucuagaauggaugggugguaucauaccaauauucgauacagguaacuccgcacagucauuucaaggaagagucacaauaacugcagaugaaucaacauccacagcauauauggaauugaguaguuuaagaagcgaagauaccgcuguauauuauugugcacgaagcaguagaauauaugaucuuaauccaaguuuaacggccuacuaugacauggauguuuggggucaaggcacaaugguaacaguuucaucaggagguggaggaucaggaggaggcggaucuggaggcggaggaagcggcggcggagguagucaaagcguauuaacacaaccuccaucgguaagcgcagcuccuggucagaaaguaacgauaucauguaguggcagcucgaguaauauuggaaauaauuacguaucaugguaccaacaacuaccaggaacagcacccaaacuauuaauauaugauaacaauaaaagaccaucaggaauaccagaucgauuuucuggcaguaaaagcggaacauccgcaacauuaggaauaaccggauuacaaacaggagaugaagcagauuauuauugcggaacaugggauucaucacuuagcgcauggguauuuggcuguggaacaaaacuaaccguauua

SEQ ID NO: 46451 - RNA, 645 nt, Artificial Sequence
  derived and/or modified sequence opt6 from Ndimab-varB_LightChain
gaaauaguacuuacacaaucaccagcaacacuaagccuaucaccaggagaaagagcaacacuaucaugcagagcaucccaaucaguauacucauaccuagcaugguaccaacaaaaaccaggacaagcaccaagacuauuaauauacgacgcaucuaacagagccauaggaauaccagcaagauuuucaggaucaggauccggaacagacuucacacucacaauaucaucacuagaaccagaagacuucgcaguauacuacugccaacaaagaucaaacuggccaccauucacauucggaccaggaacaaaaguagauauaaaaagaacagucgcagcaccaucaguauucauauuccccccaucagacgaacaacuaaaaucagguacugcaucaguaguaugccuauuaaacaacuucuacccaagagaagcaaaaguacaauggaaaguagacaacgcacuacaaucaggaaacucacaagaaucaguaacagaacaagauucaaaagacucaacauacucauuaucaucaacauuaacucuaucaaaagcagacuacgaaaaacacaaaguauacgcaugcgaagucacccaccaaggacuaucaucaccaguaaccaaaucauucaacagaggagaaugu

SEQ ID NO: 46452 - RNA, 1353 nt, Artificial Sequence
  derived and/or modified sequence opt6 from Necitumumab_HeavyChain1
caaguacaacuacaagaaucuggaccagguuuagucaaacccucucaaacauuaucauuaacaugcaccguaucaggcggcagcauaucaucaggugacuacuacuggaguuggauaagacaaccaccgggaaaaggacuagaauggauaggcuacauuuacuacucaggauccacagauuauaauccaaguuuaaaaucaagaguaacaauguccguagacacaucaaaaaaccaauucucauuaaaaguaaacucaguaacagcugcagauacagcgguauacuauugcgccagaguaucaauauucggaguaggaacauucgacuauuggggccaaggaacacuugucacuguaucuucugcauccacaaaaggaccaucuguccuaccacuagcaccauccucuaaaaguacaaguggaggaaccgcagcacucggcugcuuaguaaaagacuacuuuccugaaccaguaacaguuaguuggaacaguggcgcacuaacaucaggaguacacacauucccagccguacuacaauccuccggacuauacucauuaucaucaguaguaaccguaccaucauccucacucggcacacaaacauacauaugcaacgucaaccacaaaccaucuaacacaaaaguagacaaacgcguagaaccaaaaucaugugacaaaacacacaccugcccaccaugcccagcaccagaacuauuagguggaccaucagucuuuuuauucccuccaaaaccaaaagacacucuaaugauaucacgcaccccugaaguuacaugcguaguaguagacguaucacacgaagacccagaaguaaaauucaacugguacgucgacggcgucgaaguacauaaugcaaaaacaaaaccaagagaagaacaauauaacagcaccuaccgcguaguaucaguacuuacaguacuacaccaagacuggcuaaaugguaaagaauacaaauguaaaguaucuaacaaagcacuaccagcuccaauagaaaaaacaaucucaaaagcaaaaggacaaccaagagaaccacaagucuacacacuaccaccuucaagagaagaaaugacuaaaaaccaaguaucacuuacaugccuuguaaaaggauucuacccauccgauauagcaguagaaugggaaucaaacggacaacccgaaaacaauuacaaaaccacaccucccguauuagacucagauggaucauuuuuccuauacucuaaacuuacaguagauaaaucaagauggcaacaaggaaacguuuucuccugcuccguaaugcacgaagcacuacauaaccauuauacacaaaaaucacuuucacuaucuccaggaaaa

SEQ ID NO: 46453 - RNA, 642 nt, Artificial Sequence
  derived and/or modified sequence opt6 from Necitumumab_LightChain1
gaaauaguaaugacacaaucaccagcaacauuaucacuaucaccaggagaaagagcaacacuaucaugccgagcaucacaaucaguaucaucauaccuagcaugguaccaacaaaaaccaggacaagcacccagacuacuaauauacgacgcaucaaacagagcaacaggaauaccagccagauucucaggaucaggaucaggaacagacuucacacuaacaauaucaagccuagaaccagaagacuucgcaguauacuacugccaccaauacggaucaacaccauuaacauucggaggaggaacaaaagcagaaaucaaaagaacaguagcagcaccaucaguauucauauucccaccaucagacgaacaacuuaaaucaggaacagccuccguaguaugccuauuaaacaacuuuuacccaagagaagcaaaaguacaauggaaaguagauaacgcacuacaaaguggaaacucacaagaaagugucacagaacaagacucaaaagacucaacauacucacuaucaucaacacuaacauuauccaaagcagauuacgaaaaacacaaaguauacgcaugcgaaguaacacaccaaggacuaucaucaccaguaacaaaaucauuuaacagaggagaaugc

SEQ ID NO: 46454 - RNA, 396 nt, Artificial Sequence
  derived and/or modified sequence opt6 from Neliximab_HeavyChain_VH-Region
gaaguacaauuacaacaaagcggaccagaacuaguaaaaccaggagcaaguguaaaaaugagcuguaaagcaagcggauacacauucacaacauauguaaugcacuggguaaaacaaaaaccaggacaaggacuagaauggauaggauauauaaauccauauaacgauggaacaaacuauaacgaaaaauuuaaaggaaaagcaacauuaacaucagacaaaaguucaagcacagcauauauggaacuaucaacauuaacaucagaagauagcgcaguauauuacugugcagaauucauaacaaaaacaguaggaggaagcaauugguauuuagauguauggggagcaggaacaacaguaacaguaucaucagcaaaaacaacacccccaaaauua

SEQ ID NO: 46455 - RNA, 372 nt, Artificial Sequence
  derived and/or modified sequence opt6 from Neliximab_HeavyChain_VH-Region_variant1
caaguacaauuaaaacaaaguggaccagaacuaguaaaaccaggagcaaguguaaaaaugagcuguaaagcaagcggauacacauucacaacauauguaaugcacuggguaaaacaaaaaccaggacaaggacuagaauggauaggauauauaaauccauauaacgauggaacaaacuauaacgaaaaauuuaaaggaaaagcaacauuaacaucagacaaaagcucaagcacagcauauauggaacuaucaacauuaacaucagaagauagcgcaguauauuacugugcagaauucauaacaaaaacaguaggaggaagcaauugguaucuagauguauggggagcaggaacaacaguaacaguaagcuca

SEQ ID NO: 46456 - RNA, 318 nt, Artificial Sequence
  derived and/or modified sequence opt6 from Neliximab_LightChain_VL-Region
gauauaguacuaacacaaucaccagcaauaaugagcgcaagcccaggagaaaaaguaacaaugacauguagcgcaagcucaagcauaagcuauauacauugguuucaacaaaaaccaggaacaagcccaaaaagauggauauacgauacaucaaaauuaccaucaggaguaccagcaagauuuagcggaagcggaagcggaacaucauacucacuaacaauaucaagcauggaagcagaagaugcagcgacauauuacugucaccaaagaucaagcuauacauggacauuuggaggaggaacaaaauuagaaauaaaa

SEQ ID NO: 46457 - RNA, 354 nt, Artificial Sequence
  derived and/or modified sequence opt6 from Neliximab_LightChain_VL-Region_variant1
caaauaguacuaacacaaucaccagcaauaaugucagcaucaccaggagaaaaaguaacaaugacaugcucagcaucaucauccauaucauacauacacugguuccaacaaaaaccaggaacaucaccaaaaagauggauauacgacacaucaaaacuaccaucaggaguaccagcaagauucucaggaucaggaucaggaacaucauacucacuaacaauaucaucaauggaagcagaagacgcagcaacauacuacugccaccaaagaucaucauacacauggacauucggaggaggaacaaaacuagaaauaaaaagagcagacgcagcaccaacaguaucagcagcagca

SEQ ID NO: 46458 - RNA, 1335 nt, Artificial Sequence
  derived and/or modified sequence opt6 from Nemolizumab_HeavyChain1
caaguacaacuuguucaaucaggagcagaaguaaaaaaaccuggagcuucaguaaaaguuucaugcaaagccucagguuacacauucacaggauacaucaugaacuggguacgucaagcaccaggacaaggacuagaauggaugggauuaauaaacccauacaacggagguacagacuauaacccacaauuccaagacagaguaacuauaacagcugacaaaucuacauccacagcauauauggaacucucaucauuaagauccgaagauacugcaguauacuauugugcaagagauggauacgaugauggaccuuauacauuagaaacauggggacaaggcacccuaguaacaguaucaagugccucaacaaaaggaccuucaguauuccccuuagccccuaguucaaaaucaacaucaggaggaacagcagcucuaggaugcuuaguaaaagacuauuuuccagaaccaguuacaguuucauggaauuccggcgcacucacaucaggaguacauacuuucccugcaguccuacaaucaucaggacucuauucacuaucaucagucguaacaguuccaucaucuaauuuuggaacacaaacauacacuugcaauguagaccauaaaccaucaaacacaaaagucgauaaaacaguagaacgcaaaagcuguguagaaugccccccaugcccagcaccaccaguagccgguccauccguauuccuauuccccccaaaaccaaaagacacauuaaugaucucaagaacuccagaaguaacaugcguaguagucgacguaucucaagaagacccagaaguacaauuuaacugguacgucgacggaguagaaguacacaacgcaaaaaccaaacccagagaagaacaauucaacucaaccuucagaguagucucaguccucacaguagugcaccaagauugguuaaauggcaaagaauacaaauguaaaguaagcaacaaaggauuacccgcuccaaucgaaaaaacaauaucaaaaacuaaaggacaaccaagagaaccacaaguauacacccuaccaccuucacaagaagaaaugacaaaaaaccaaguaucuuuaacuugucuuguaaaaggauuuuauccaucagacauagcaguagaaugggaaagcaacggucaaccagaaaacaacuacaaaacaacacccccuauguuagacucagaugguuccuucuuccuuuacucaaaauuaacaguagacaaaucacgcuggcaagaaggaaaugucuuuucuuguucuguaaugcacgaagcacuacacaaccacuacacacaaaaaucacuaucacuaucacca

SEQ ID NO: 46459 - RNA, 642 nt, Artificial Sequence
  derived and/or modified sequence opt6 from Nemolizumab_LightChain1
gacauacaaaugacacaaucaccaucaucacuaucagcaucaguaggagaccgaguaacaauaacaugucaagcaucagaagacauauauucauucguagcaugguaccaacaaaaaccaggaaaagcaccaaaacuacuaauauacaacgcacaaacagaagcacaaggaguaccaucaagauucucaggaucaggaucaggaacagacuucacauuaacaauaucaucauuacaacccgaagacuucgcaacauacuacugccaacaccacuacgacucaccauuaacauucggaggaggaaccaaaguagaaauaaaaagaacaguagcagccccaagcguauucauauucccaccaucagacgaacaacuaaaaucaggcacagcauccgucguaugcuuacuaaacaacuucuacccaagagaagcaaaaguacaauggaaagucgacaacgcauuacaaucaggaaacucacaagaaucaguaacagaacaagauucaaaagacucaacauacucacuaucaucaacauuaacacuaucaaaagcagauuacgaaaaacacaaaguauacgcaugcgaaguaacacaccaaggccuaagcucacccguaacaaaaucauucaacagaggagaaugc

SEQ ID NO: 46460 - RNA, 1356 nt, Artificial Sequence
  derived and/or modified sequence opt6 from Nesvacumab_HeavyChain1
gaaguacaauuaguagaaaguggaggaggacuuguccaaccuggaggaucucugcgauuaucaugcgcagcgucaggauucacuuucucuucauacgacauccauuggguuagacaagcuacaggaaaaggauuagaauggguaagugcaaucggaccagcaggugauacauauuacccaggaucaguuaaaggcagauuuacaauaagcagagaaaacgcaaaaaauagucuguauuuacaaaugaauucucucagagcuggagacacagcaguauacuauugcgcccgcggacucauuaccuuuggaggauuaauagcaccauuugacuacuggggacaaggaacacuagucacaguaaguucagcaucaacaaaaggaccaagcguauuuccacuugcaccaucaaguaaaucaacaagcggaggaacagcagcauuaggauguuuaguuaaagacuacuuuccagaaccugucacugucucauggaacucaggagccuuaacaucuggcguacauacauuccccgcuguccuacaaagcagcggucuauauucacuaucaagcguaguaacagucccauccuccucauuaggaacacaaacauacauaugcaauguaaaucacaaaccaucuaacacaaaaguagacaaaaaagucgaaccaaaaucaugcgauaaaacacauacauguccaccuuguccagcaccagaacucuuaggagggccaucaguauuucucuuucccccuaaacccaaagauacauuaaugauaagcagaacuccagaagucacauguguaguaguagauguaagucacgaagacccagaaguaaaauuuaauugguacguagacgguguagaaguucauaacgcaaaaaccaaaccccgagaagaacaguauaauagcacauauagaguaguuucaguauuaacagucuuacaucaagauugguuaaauggaaaagaauauaaauguaaaguaucuaauaaagcacuaccagcacccauagaaaaaacaauaucaaaagcaaaaggacaaccaagagaaccacaaguauauacauuaccaccauccagagaugaauuaacgaaaaaucaagucucacuaaccugucuaguaaaaggauuuuauccaucagauauagcaguagaaugggaaucuaacggacaaccagaaaauaauuauaaaacaacaccaccuguuuuagauucagauggcucuuucuuucuauauucaaaacuaacaguagacaaaucaagauggcaacaaggaaauguauucucaugcagcguaaugcaugaagcguuacacaaccauuauacacaaaaaucauuaaguuuaucaccaggaaaa

SEQ ID NO: 46461 - RNA, 642 nt, Artificial Sequence
  derived and/or modified sequence opt6 from Nesvacumab_LightChain1
gaaauaguacuaacacaaucaccaggaacccuaucacuauccccaggagaacgagcaacauuaucaugcagagcaucacaaucaguaucaucaacauacuuagcaugguaccaacaaaaaccaggacaagccccaagacuauuaauauacggagccucaucaagagcaacaggaauaccagacagauucucaggcuccggaucaggaacagacuucacacuaacaauaucacgccuagaaccagaagacuucgcagucuacuacugccaacacuacgacaacucacaaacauucggacaaggaacaaaaguagaaauaaaacgaacaguagcagcaccauccguauucauauucccaccaucagacgaacaauuaaaaucaggaacagcuucaguaguaugcuuacuaaacaacuucuacccaagagaagcaaaaguccaauggaaaguagacaacgcauuacaaucaggaaacucacaagaaucaguaacagaacaagauucaaaagacucaaccuacucacuaucaucaacauuaacacucucaaaagcagacuacgaaaaacacaaaguauacgcaugugaaguaacacaccaaggacuauccucaccaguaaccaaauccuucaacagaggcgaaugc

SEQ ID NO: 46462 - RNA, 1362 nt, Artificial Sequence
  derived and/or modified sequence opt6 from Neuradiab_HeavyChain1
gaaguacaacuacaacaaucaggaccagaacuaguaaaaccaggugccucuguaaaaaugucauguaaagcaucagguuacacauucacaucauauguaguucacuggguaaaacaaaacccaggccaaggacuagaauggaucggauacaucaacccauucaacgacggaacuaaauacaacgaaaacuuuaaaugcaaagcaacacuaacuucagaccgaucuuccucaacagccuacauggaauuauccucacuaacaucugaagaaucagcaguauacuucugugcacgcgacaugggaagagaaggauucgcauauuggggacaaggaacauuaguuacaguaucagcagcaaaaacaaccccaccuucaguauacccacuugcacccggaugcggugacacaacaggaucaucaguaacauuaggaugucuaguaaaaggauauuuuccagaaucaguaacuguaacuuggaacuccggaaguuuaucaucaucaguucacacauuuccugccuuacuccaaucaggucuauauacaauguccucaucaguuacaguaccaucaucaacuuggccaucacaaauaguaauauguagcgucgcccauccagcauccucaacaacaguagacaaaaaacuagaaccaucaggcccaauaucaacaauaaacccauguccaccaugcaaagaaugccauaaaugcccagcacccaaccuagaaggcggacccagcguauuuauauuuccaccaaauauaaaagacguacuaaugauaucauuaaccccaaaagucaccuguguaguagucgacgucuccgaagacgauccagacguucaaauuucaugguucguaaacaacguagaaguacauacagcacaaacacaaacccaccgcgaagacuacaauucaacaauaagaguaguaucaacauuaccaauacaacaccaagacuggaugucaggaaaagaauucaaauguaaaguaaacaauaaagaucuacccucaccuauagaaagaacaauaucaaaaaucaaaggauuaguaagagccccacaaguauacauacuaccacccccagcagaacaacuaucaagaaaagacguaucauuaacaugcuuaguaguaggauucaacccaggagacauaucaguagaauggacaucuaacggccacacagaagaaaacuacaaagacacagcgcccguacuagauucagauggaucauacuucauuuauagcaaauuaaauaugaaaacaucaaaaugggagaaaacagacagcuucucauguaauguaagacacgaaggucuaaaaaacuauuaccuuaaaaaaacaauaucaagauccccaggcaaa

SEQ ID NO: 46463 - RNA, 657 nt, Artificial Sequence
  derived and/or modified sequence opt6 from Neuradiab_LightChain1
gacauaguaaugacacaagcagcauucucaaacccaguaacacuaggaacauccgcaucaauaucaugccgaagcuccaaaucacuacuacacucaaacggaauaacauaccuauacugguacuuacaaaaaccaggacaaucaccacaacuauuaaucuaccaaaugucaaaucuagcaucaggaguaccagacagauucucaagcucaggaucaggcacagacuucacacuaagaauaucaagagucgaagcagaagacguaggaguauacuauugcgcacaaaaccuagaauuaccaagaacauucggaggaggaaccaaacuagaaauaaaaagagcagacgcagcaccaacaguaucaauauucccaccaucaagcgaacaacuaacaucaggaggagcaucagucguaugcuuccuaaacaacuuuuacccaaaagacauaaacguaaaauggaaaauagacggaucagaaagacaaaacggaguacuaaacucuuggacagaccaagacagcaaagacucaacauacucaaugucaucaacacuaacacuaaccaaagacgaauacgaaagacacaacucauacacaugcgaagcaacacacaaaacaucaacaucaccaauaguaaaaagcuucaauagaaacgaaugc

SEQ ID NO: 46464 - RNA, 369 nt, Artificial Sequence
  derived and/or modified sequence opt6 from Nimotuzumab_HeavyChain1
caaguacaauuacaacaaagcggagcagaaguaaaaaaaccaggaucaagcguaaaaguaagcuguaaagcaagcggauacacauucacaaacuauuacauauacuggguaagacaagcaccaggacaaggacuagaauggauaggaggaauaaauccaacaagcggaggaucaaacuuuaacgaaaaauuuaaaacaagaguaacaauaacaguagacgaaagcacaaacacagcauauauggaacuaucaagccuaagaucagaagauacagcauucuauuucugugcaagacaaggacuaugguucgauagcgauggaagaggauuugacuuuuggggacaaggaagcacaguaacaguaucaagc

SEQ ID NO: 46465 - RNA, 342 nt, Artificial Sequence
  derived and/or modified sequence opt6 from Nimotuzumab_LightChain1
gacauacaaaugacacaaucaccaucaucacuaucagcaucaguaggagacagaguaacaauaacaugcagaucaucacaaaacauaguacacucaaacggaaacacauaccuagacugguaccaacaaacaccaggaaaagcaccaaaacuacuaauauacaaaguaucaaacagauucucaggaguaccaucaagauucucaggaucaggaucaggaacagacuucacauucacaauaucaucacuacaaccagaagacauagcaacauacuacugcuuccaauacucacacguaccauggacauucggacaaggaacaaaacuacaaauaacaagagaa

SEQ ID NO: 46466 - RNA, 1320 nt, Artificial Sequence
  derived and/or modified sequence opt6 from Nivolumab_HeavyChain1
caaguacaacuaguagaaucaggaggaggaguaguacaaccaggaagaucacucagauuagauuguaaagcaaguggcaucacuuucucaaauucaggaaugcacuggguacgacaagcuccagguaaaggacuagaauggguagcagucauaugguaugauggcucaaaaagauacuaugcagauuccguaaaagguagauuuacaauuucuagagacaacucaaaaaacacauuauuccuacaaaugaauucccuuagagcugaagauacagcaguauauuauugugcaacaaaugaugauuauuggggacaagguacacuuguaacaguuucaucagcaucaacaaaagguccaucaguauuuccuuuagcacccugcucaagaucuaccucagaaucaacagcugcacuaggcugucuaguaaaagauuacuuuccagaaccaguaaccguaagcuggaacucaggcgcacuaacuucaggaguacauacauuuccagcuguacuucaaucuuccggucucuacucacuaucaucagucguaaccguaccaucaucuucacucggaacaaaaaccuauacauguaauguagaccauaaaccaagcaauacaaaaguagacaaaagaguagaaucaaaauacggcccaccauguccuccuuguccagccccagaauuccucggaggcccaucaguauuucuauuuccaccaaaaccuaaagauacacuaaugauuuccagaacaccagaagucacaugcguaguuguagauguaucacaagaagaccccgaaguacaauuuaacugguauguagauggaguagaaguucauaacgcaaaaacaaaaccaagagaagaacaauuuaauucaacauacagaguaguuucaguacuaacaguguuacaucaagacuggcuaaauggcaaagaauauaaauguaaaguaucaaacaaaggacuaccaucaucuauagaaaaaacaauauccaaagcaaaaggacaaccaagagaaccacaaguauauaccuuaccaccaucccaagaagaaaugacaaaaaaccaaguaucacucacaugucuaguuaaagguuucuauccaagugacauagcagucgaaugggaaucuaacggacaaccagaaaacaacuauaaaacaacuccaccaguucuagauucagacggaucuuuuuuucuauauucaagacuaacagucgauaaaucacgauggcaagaaggcaauguauuuucauguucaguaaugcacgaagcccuacacaaccauuacacacaaaaaucauuaucacuaagccuaggaaaa

SEQ ID NO: 46467 - RNA, 642 nt, Artificial Sequence
  derived and/or modified sequence opt6 from Nivolumab_LightChain1
gaaauaguacuaacacaaucaccagcaacauuaagccuaagcccaggagaaagagcaacauuaagcugcagagcaagccaaaguguaucaucauaccuagcaugguaccaacaaaaacccggacaagcaccaagauuauuaauauaugacgcaagcaaucgagcaaccggaauaccagcaagauucucaggaucaggaucagguacagacuuuacauuaacaauaagcucacuagaaccagaagacuuugcaguauacuauugucaacaaucaagcaauuggccaagaacauucggacaagggacaaaaguagaaauaaaacgaacaguagcagcaccaagcguauuuauauucccaccaucagacgaacaauuaaaaucaggaacagcaucuguaguaugccuacuaaauaacuuuuacccaagagaagcaaaaguacaauggaaaguagauaacgcacuacaaucaggaaacucacaagaaagcguaacagaacaagauagcaaagacucaacauauagcuuaagcucaacauuaacacuaagcaaagcagauuacgaaaaacauaaaguauacgcaugcgaaguaacacaccaaggcuuaaguucaccaguaacaaaaagcuuuaacagaggagaaugc

SEQ ID NO: 46468 - RNA, 1347 nt, Artificial Sequence
  derived and/or modified sequence opt6 from Obiltoxaximab_HeavyChain1
caaguacaacuucaacaaucagguccagaauuaaaaaaaccaggcgcauccgucaaaguaucuuguaaagacuccggauacgccuucaguuccuccuggaugaauuggguacgacaagcaccaggacaaggccucgaauggauaggacgaauauauccaggagacggagauacaaacuacaacggaaaauuucaagguagaguaacaauaaccgcagacaaaucauccucaaccgcauacauggaauuaucaucacuaagaucagaagacacagcaguauacuucugugcacgaucaggacuauuacgauaugccauggauuauuggggacaaggaacgcuaguaacaguaucaucagcaucaacaaaaggaccaucaguauuuccccuagcaccuucaucuaaaucaacaucagguggaacagccgcauuaggaugccuagucaaagacuauuucccagaaccuguaacaguauccuggaacucaggagcacuaacuucaggaguccacacauuuccagcaguacuccaauccuccggacuauacucucuuucaucaguagugacaguucccucauccucucucggaacccaaacauauauauguaacguaaaucacaaaccaucaaauacaaaaguagacaaaaaaguagaaccuaaaagcugugacaaaacacauaccugcccaccaugcccugcucccgaacuauuaggcggacccucaguuuuucuuuucccaccaaaaccaaaagacacacuaaugauaucaagaacaccagaaguaacaugcguagucguagauguaucccaugaagacccagaaguaaaauuuaacugguauguagauggaguagaaguacacaaugcaaaaacaaaaccaagagaagaacaauacaauuccaccuaucgagucguaucaguacuuacgguacuacaccaagauuggcuaaacggaaaagaauacaaaugcaaaguaucaaacaaagccuuaccugcaccaauagaaaaaaccaucuccaaagcaaaaggucaaccacgugaaccacaaguauacacacuuccucccucaagagacgaauuaaccaaaaaccaaguaucacuaaccugccuaguaaaagguuucuauccaagcgacauagcuguagaaugggaaucaaacggacaaccagaaaacaacuauaaaacaacaccaccaguauuagacuccgauggcuccuucuucuuauacucaaaauuaacugucgacaaaucaagauggcaacaagguaauguauucucaugcucaguuaugcacgaagcauugcauaaccacuacacacaaaaaucacucucacuaucaccaggaaaa

SEQ ID NO: 46469 - RNA, 642 nt, Artificial Sequence
  derived and/or modified sequence opt6 from Obiltoxaximab_LightChain1
gacauacaaaugacacaaucaccaucaagucuaucagcaagcguaggcgaccgaguaacaauaacaugcagagcaagccaagacauaagaaacuacuuaaacugguaccaacaaaaaccaggaaaagcaguaaaacuauuaauauacuacacaucaagacuacuaccaggaguaccaagcagauucucaggaucaggcucagguacagacuacucacuaacaauaagcucacaagaacaagaagacauaggaacauacuucugccaacaaggaaacacacuaccauggacauucggacaaggaacaaaaguagaaaucagacgaacagucgcagccccauccguauucauauucccaccaucagaugaacaacuaaaaucaggaacagcaucaguaguaugccuauuaaacaacuucuacccaagagaagcaaaaguacaauggaaaguagauaacgcacuacaaucaggaaacucacaagaaagcguaaccgaacaagacagcaaagacucaacauacucacuaagcuccacuuuaaccuuaagcaaagcagacuacgaaaaacacaaaguauacgcaugcgaaguaacacaccaaggacuaucaucaccaguaacaaaaucauuuaacagaggagaaugc

SEQ ID NO: 46470 - RNA, 1347 nt, Artificial Sequence
  derived and/or modified sequence opt6 from Obinutuzumab_HeavyChain1
caaguucaacuaguccagucaggagcagaaguuaaaaaaccaggauccucaguaaaaguaucaugcaaagccucaggauaugcauucucauacucauggauaaauuggguaagacaagcacccggacaaggacuagaauggaugggaagaauauucccaggagacggagacacagacuauaauggaaaauucaaaggaagaguaacaauaacagcagauaaauccacaucaacagcauauauggaauuauccucuuuaagaucagaagauacagcaguauacuauugugcucgaaacguauucgacggauacuggcuaguuuacuggggucaaggaacacuaguuacaguaucauccgcaucaacaaaagguccaucaguauuuccacuagcaccaucaucaaaaagcacaagcgguggcacagcagcacuuggaugcuuaguaaaagauuacuucccagaaccaguaaccguaucauggaauucaggagcacuaacaucaggaguucacacauucccagcagucuuacaauccucaggucuauacucuuuaucaucaguagucacaguacccucaaguuccuuaggaacacaaacuuauauaugcaacguaaaccauaaaccaucaaacacaaaaguugacaaaaaagucgaaccaaaaucaugcgacaaaacacacacaugucccccaugucccgcaccagaacuauuaggcgguccaucaguauucuuauucccaccaaaaccaaaagauacucucaugauaucacgaacacccgaaguaaccugcguaguaguagauguaucccacgaagacccagaaguaaaauucaacugguauguagacggaguagaaguacacaacgccaaaaccaaaccaagagaagaacaauacaacucaacauauagaguaguaucuguacuuaccguacuacaucaagauugguuaaacggaaaagaauacaaaugcaaaguuucaaacaaagcacuaccugcaccaauagaaaaaacaauaucuaaagcuaaaggacaaccaagagaaccgcaaguauacacauuaccacccucuagagacgaacuaacaaaaaaccaaguaagccuaacaugccucguaaaaggauucuauccaucagacauagccguagaaugggaaucaaauggacaaccagaaaauaauuauaaaacgacaccuccaguccuagacucagaugguucuuucuuccuauacucaaaacuaacaguugauaaaucaagauggcaacaaggaaauguuuuuucauguucaguaaugcacgaagcacuacauaaccauuacacucaaaaaucacucucccucucuccaggaaaa

SEQ ID NO: 46471 - RNA, 657 nt, Artificial Sequence
  derived and/or modified sequence opt6 from Obinutuzumab_LightChain1
gacauaguaaugacacaaacaccacuaucacuaccagucacaccaggagaaccagccucaauaucaugcaggucaucaaaaucuuuacuacauucaaacggaauaaccuaccuauacugguacuuacaaaaaccuggacaaucaccacaacuacuaauauaccaaaugucaaacuuaguaucaggaguaccagacagauucucaggcucaggaucaggcacagacuucacacuaaaaauaucaagaguagaagcagaggacguagguguauacuacugcgcacaaaacuuagaauuaccauacacauucggaggaggaaccaaaguugaaauaaaacgaacaguagcagcaccaucaguauucauauucccaccaucagacgaacaacuaaaaucaggaacagcaucagucguaugcuuacuaaacaacuucuacccaagagaagcaaaaguacaauggaaaguagacaacgcauuacaaucaggaaacucacaagaaucaguaacagaacaagacuccaaagacucaacuuacagccuauccucaacucuaacacuaucaaaagcagacuacgaaaaacauaaaguauacgcaugcgaaguaacacaucaaggauuaucaucaccaguaacuaaaucuuucaacagaggugaaugc

SEQ ID NO: 46472 - RNA, 1350 nt, Artificial Sequence
  derived and/or modified sequence opt6 from Ocaratuzumab_HeavyChain1
gaaguacaacuaguacaaucaggagcugaaguaaaaaaaccaggagaaucauuaaaaauaucuugcaaaggcucuggaagaaccuucacaucauauaauaugcauuggguaagacaaaugccaggcaaaggauuagaauggaugggagcaauauacccuuuaacaggagauacaucauacaaucaaaaaaguaaacuacaaguuaccauaucugcagacaaaucaauauccacagcauacuuacaauggucaucacuaaaagcaucagacacagcaauguacuacugugcacguucaacauauguaggaggugacuggcaauuugauguauggggaaaaggaacaacaguaaccguaucaucagcaucuacaaaaggaccaucaguauucccacuagcaccuucauccaaaucaacaucaggaggcaccgcagcauuaggaugccuaguaaaagacuacuuuccugaaccagucacaguuucauggaacagcggagcacugacaucaggaguccacacuuuucccgcaguacuacaaagcucaggauuauacucauuaaguucaguuguaacaguaccaaguagcaguuuaggaacacaaacauauauaugcaauguuaaucauaaacccuccaauacaaaaguagacaagaaaguugaaccaaaaucaugcgauaaaacacacacaugccccccguguccagcaccugaacuauuaggagguccgucgguauuucucuucccaccuaaaauaaaagacacacuaaugauaagcagaacacccgaaguaaccugcguaguaguagauguaagccacgaagacccagaaguaaaauuuaacugguauguugacggaguagaaguacacaaugcaaaaacaaaacccagagaagaacaauacaacucuacauaccgaguaguaucagucuuaacaguacuacaucaagacugguuaaauggaaaggaauauaaaugcaaaguaaguaacaaagcauuaccagccccuauagaaaaaacuaucucaaaacaaaaaggucaaccaagagaaccacaaguauacacauuaccaccaucaagagaugaacuaacaaaaaaccaagucagccuaacaugccuaguaaaaggauucuacccaucagacaucgccguagaaugggaaucaaauggacaaccagaaaauaacuacaaaacaacacccccagucuuagauagcgacgguucauuuuuccucuacucaaaacuuacaguagacaaaucuagauggcaacaaggaaacguauuuaguugcagcguuaugcacgaagcacuacacaaucacuauacacaaaaaagcuuaucauuaagcccagga

SEQ ID NO: 46473 - RNA, 639 nt, Artificial Sequence
  derived and/or modified sequence opt6 from Ocaratuzumab_LightChain1
gaaauaguacuaacacaaucaccaggaacacuaucacuaucacccggagaaagagcaacacuaucaugcagagcaucaucauccguaccauauauacacugguaucaacaaaaaccaggacaagcacccagacuacuaauauacgcaacauccgcacuagcuucaggaauaccagacagauuuucaggauccggcucaggaacagacuucacacuaacaauauccagacuagaaccagaagacuucgcaguauauuacugccaacaauggcucucaaacccaccaacauucggacaaggaacaaaauuagaaauaaaaagaacaguagcagcaccaucaguauucauauucccaccaucugacgaacaauuaaaaucaggaacagcaucaguaguaugccuacuaaacaacuucuacccaagagaagcaaaaguacaauggaaagucgacaacgcucuacaaagcggaaacucacaagaaucaguaaccgaacaagacucaaaagacucaacauacucacuaucaucaacacuaacacuauccaaagcagacuacgaaaaacacaaaguauaugcaugcgaaguaacacaccaaggacuaucuucacccguaacaaaaucauucaacagaggugaaugc

SEQ ID NO: 46474 - RNA, 1356 nt, Artificial Sequence
  derived and/or modified sequence opt6 from Ocrelizumab_HeavyChain1
gaaguacaacuaguagaaucaggaggaggauuaguacaacccggcggaucacuacgacuaucaugugcagcaaguggauacaccuucacuucauacaauaugcauuggguaagacaagccccagguaaaggcuuagaaugggucggagcaauauauccaggaaauggcgacacaucuuacaaucaaaaauucaaaggaagauucacaauaucagucgacaaaucaaaaaacacucucuaccuacaaaugaacaguuuaagagcugaagacacagcgguguacuauugugcacgagucguauauuacucaaacagcuauugguacuucgacgucuggggacaaggaacucucguaacaguaucuucagcaagcacuaaaggaccaucagucuuuccacuagcaccaucaucaaaaucuacauccggaggaacugccgcauuaggaugucuuguaaaagacuacuuuccagaacccguaacaguaucauggaacaguggagcauuaacauccggaguacauacuuuuccagccguacuacaaucaucaggccuauacagccuaucaucaguuguaacaguaccaucaucaucauuaggaacccagacauacauaugcaacguuaaccauaaaccuucaaauacaaaaguugacaaaaaagucgaacccaaaagcugcgauaaaacacacaccuguccuccaugcccagccccagaauuacuaggcggaccaucagucuuccuauucccaccaaaacccaaagacacauuaaugauaucaagaacaccagaaguaaccugugucguagucgacguaucacacgaagaccccgaagucaaauucaacugguauguagacggaguagaaguacacaaugcaaaaacaaaaccaagagaagaacaauacaacucaacauauagaguaguaucaguacuaacuguacuucaccaagauuggcuuaacggaaaagaauauaaauguaaaguaucuaacaaagcccuaccagccccaauagaaaaaacuauaucaaaagcaaaaggucaacccagagaaccacaaguauauacauuaccaccaucacgagaagaaaugacaaaaaaucaaguuucccuaacaugcuuaguaaaaggauucuauccaagugacauagcaguagaaugggaauccaacggacaaccagaaaacaacuacaaaacaacaccaccaguccuagacagcgacggauccuuuuuuuuauauucaaaacucacaguugauaaaucuagauggcaacaaggaaauguauucucaugcucagucaugcacgaagccuuacauaaucauuacacacaaaaaucauuaucccuuucaccagguaaa

SEQ ID NO: 46475 - RNA, 639 nt, Artificial Sequence
  derived and/or modified sequence opt6 from Ocrelizumab_LightChain1
gacauacaaaugacacaauccccaucauccuuaucagcaucaguaggagacagaguaacaauaacaugcagagcaucauccucaguauccuacaugcacugguaccaacaaaaaccaggcaaagcaccaaaaccacuaauauacgcaccaucaaaccuagcaucuggaguaccauccagauucucaggaucaggauccggaacagacuucacacuaacaauaucaucauuacaaccagaagacuucgcuacauacuacugccaacaauggucauucaacccaccaacauucggacaaggcacaaaaguagaaauaaaacgaacagucgcagcaccaucagucuucauauuuccaccaucagacgaacaacuaaaauccggcaccgcaucaguaguaugccuacuaaacaacuucuacccacgagaagccaaaguacaauggaaaguagacaacgccuuacaaucaggaaacucacaagaaucaguaacugaacaagacucaaaagauucaacauacucacuaucaucaacacuaacacuaucaaaagcagacuacgaaaaacacaaaguauacgcaugcgaaguaacacaccaaggacuauccucaccaguaaccaaaucauucaacagaggagaaugc

SEQ ID NO: 46476 - RNA, 1356 nt, Artificial Sequence
  derived and/or modified sequence opt6 from Ofatumumab_HeavyChain1
gaaguucaauuagucgaaaguggaggaggacuaguacaaccaggacguucauuacgacuaucaugcgcagcaucaggauuuacauucaacgacuaugcaaugcacuggguuagacaagcaccuggaaaaggacucgaauggguaagcacuauuucauggaacagcggaucaaucggcuacgcagacuccgucaaaggacgcuucacaauaucacgagacaacgccaaaaaaucucuauacuuacaaaugaauucccuaagagcugaagacaccgcacucuacuacugcgcaaaagacauucaauaugguaauuauuauuacggaauggacguauggggacaaggaacaacaguaacagucuccucagcaucaacaaaaggaccuuccguauuuccccuagcaccaucaucaaaaucaacaucaggaggaacagcagcauuaggaugccuaguaaaagacuacuucccagaaccaguaacaguuucauggaacucuggcgcauuaacaucuggcguccacacauucccagcaguauuacaaucaucaggccucuacuccuuaucaucaguaguaacaguacccucaucaucauuaggaacccaaaccuacaucuguaauguaaaucauaaaccaucuaacacuaaaguagacaaacgaguagaaccaaaaucaugcgacaaaacacacaccuguccuccuugcccagcaccagaauuacuagguggacccucaguauucuuauucccaccuaaaccuaaagauacacuaaugaucucaagaacaccagaaguaaccuguguaguuguagacgucucccacgaagaccccgaaguaaaauuuaauugguacguagaugguguagaaguacacaacgcaaaaacuaaaccaagagaagaacaauacaauucaacauaccgaguagucucaguauuaacaguccuacaccaagacugguuaaacggaaaagaauacaaaugcaaaguuucaaacaaagccuuaccagcaccaauugaaaaaaccauauccaaagcaaaaggacaaccaagagaaccacaaguauacacccuaccacccucaagagaagaaaugacaaaaaaccaaguaucauuaacaugcuuaguaaaaggauuuuauccaucagacauagcaguagaaugggaaucuaacggacaaccagaaaacaauuacaaaacaaccccaccagucuuagacucagacggcuccuuuuuccuauacuccaaacuaacaguagauaaaaguagauggcaacaagguaacguauuuaguugcaguguaaugcacgaagcucuacauaaucacuauacacaaaaaucacuaucacuaucaccaggaaaa

SEQ ID NO: 46477 - RNA, 642 nt, Artificial Sequence
  derived and/or modified sequence opt6 from Ofatumumab_LightChain1
gaaauagucuuaacacaaucuccagcaacacuaagccuaucaccaggcgaaagagcaacacuauccugccgagcaucacaaagcguaucaucauacuuagcaugguaccaacaaaaaccaggacaagcacccagacuacuaaucuacgacgcaucaaacagagcaacaggaauaccagcaagauuuuccggaucaggaucaggaacagacuucacacuaacaauaucaucacuagaaccagaagacuucgcaguauauuacugccaacaaagaucaaacuggccaauaacauucggacaaggaacaagacuagaaauaaaaagaacaguagcagcaccaucaguauucauauucccaccaucagacgaacaacuaaaaucaggaacagcaucaguaguaugcuuacuaaacaacuucuacccacgagaagcuaaaguacaauggaaaguagacaacgcauuacaaucaggaaacucacaagaaaguguaacagaacaagacucaaaagacucaacauacagccuaucauccacacuaacauuaucaaaagcagacuacgaaaaacacaaaguauacgcaugcgaagucacacaccaaggacuauccucaccaguaacaaaaagcuucaacagaggagaaugc

SEQ ID NO: 46478 - RNA, 1371 nt, Artificial Sequence
  derived and/or modified sequence opt6 from Olaratumab_HeavyChain1
caacuacaauuacaagaaucaggaccaggucuagucaaaccuuccgaaacauuaucacuaacauguacaguaucaggaggaucuauaaacuccuccucauauuacuggggauggcuaagacaaucaccagguaaagguuuagaauggauuggcucauuuuucuacacaggaucaacauauuacaauccaucacuaagaucacgcuuaacgauuucaguagacacaucaaaaaaucaauucucacuaaugcuaucuucaguaaccgcugccgacaccgcaguauacuacugugcaagacaaucaacauacuacuacggaucaggaaauuacuauggaugguucgacagaugggaccaaggaacccucguaacaguuucaucagcaucaacaaaaggcccaucaguauucccacuagcaccuucuucaaaauccacauccggaggcaccgcugcccuaggaugccuagucaaagacuauuucccugaaccaguaacaguaucauggaauucaggcgcucuaacaucaggaguacacacuuucccagcagucuuacaaagcucagguuuauacucacuaucaucaguaguaacaguacccucuucauccuuaggaacacaaacauacauauguaaugucaaccauaaaccaucaaauacaaaaguagauaaacgagucgaaccaaaaucaugcgauaaaacacacacauguccaccaugcccagccccugaacuacuuggaggaccaucagucuuccuauucccaccaaaaccaaaagauacccuaaugauaucccgcacaccagaagugacaugcguaguaguagauguaucucaugaagacccagaaguaaaauuuaauugguacgucgacggaguagaaguacacaaugcuaaaacaaaacccagagaagaacaauauaacucuacauaucguguagucucaguacuaacagucuuacaccaagacuggcuaaacggaaaagaauauaaaugcaaaguauccaacaaagcauuacccgcuccaauagaaaaaacuauaucuaaagccaaaggacaaccaagagaaccucaagucuacacauuacccccuucucgagaagaaaugacuaaaaaccaaguaucccuaacauguuuaguuaaaggcuucuauccuucagacauagcaguagaaugggaaucaaacggacaaccagaaaauaacuacaaaacaacaccccccguacucgauucagacggaucauucuuuuuauacucaaaacucacaguagacaaaucaagauggcaacaaggcaauguuuuuucauguucaguaaugcacgaagcauuacacaaccacuauacacaaaaaucauuaucacuauccccaggaaaa

SEQ ID NO: 46479 - RNA, 642 nt, Artificial Sequence
  derived and/or modified sequence opt6 from Olaratumab_LightChain1
gaaauaguauuaacacaaucaccagccacacuaagcuuaagcccaggagaaagagccacauuauccugucgagcaucacaaucaguaucaucauaccuagccugguaccaacaaaaaccaggacaagcaccaagacuacucauauacgacgcauccaauagagcaaccggaauaccagcaagauucucaggcucaggaucaggaacagacuuuacucuaacaauaagcucacuagaaccagaagacuuugcaguauacuauugccaacaaagaucaaacuggccacccgcauucggccaaggaacaaaaguagaaauaaaacgaacaguagcagcaccaucaguauucauauucccaccaucagacgaacaauuaaaaucagguaccgcaucagucguaugccuacuaaauaacuuuuacccaagagaagcaaaaguacaauggaaaguagacaacgcccuacaaucaggaaacucacaagaauccguaacagaacaagacucaaaagacucaacauacagccuaucauccacccuaacacuaucaaaagcagacuacgaaaaacauaaaguuuacgcaugcgaaguaacacaccaaggacuaagcucaccaguaacaaaaucauuuaacagaggcgaaugc

SEQ ID NO: 46480 - RNA, 1341 nt, Artificial Sequence
  derived and/or modified sequence opt6 from Olizuab_HeavyChain1
gaaguccaacuaguagaaucaggaggaggccuaguucaaccaggaggaucauuaagauuaucaugcgcaguauccggauauucuauaaccucuggauacucauggaauuggauaagacaagcacccggaaaaggauuagaaugggucgcaucaaucacuuaugacggaucaacaaacuacaacccauccguaaaaggaagaauaacaauaagccgcgaugacucaaaaaacacauuuuacuuacaaaauucacuaagagcagaagacacagcaguauauuauugcgcacgaggcucucacuauuucggacauuggcauuuugcaguauggggacaaggaaccuuaguaacaguaucaucagcuucaaccaaaggaccgucaguauucccacuagcaccaucuucaaaaucaacaucaggaggaaccgcagcacucggcugccuaguaaaagacuacuuccccgaaccaguaacaguuucauggaacucaggcgcccuaaccucaggcguacacacauuccccgcuguacuucaaagcucaggacuauauucacuaucaucugucguaacaguuccaaguagcucuuuaggaacacaaaccuacauuugcaacguuaaucacaaaccaucaaauacaaaaguagauaaaaaaguagaaccuaaaaguugugacaaaacacacacaugcccaccauguccugcaccagaacuucucggaggaccaucaguauuccucuucccaccaaaaccaaaagauacacuaauaucuagaacacccgaaguaacaugcgucgucguagacgucucccacgaagaccccgaaguaaaauuuaauugguaugucgauggaguagaaguccacaacgcaaaaacaaaaccacgcgaagaacaauacaacucaacauacagaguaguauccguacuaacaguacuacaucaagacuggcuaaacggaaaagaauacaaaugcaaaguaucaaauaaagcucuaccugcaccaauagaaaaaacaauaucuaaagcaaaaggucagccacgagaaccacaaguauauaccuuaccacccucaagagaagaaacaaaaaaucaaguauccuuaacaugccuagucaaaggauuuuauccaucagauauagcaguagaaugggaaucuaacggacaaccagaaaauaacuacaaaacaacaccaccagucuuagacucagacggaucauucuuucucuauucaaaacuaacagucgacaaaucaagauggcaacaaggcaaugucuucucaugcucaguacacgaagcacuacauaaccauuacacccaaaaaucacuaucacuuucaccuggaaaa

SEQ ID NO: 46481 - RNA, 651 nt, Artificial Sequence
  derived and/or modified sequence opt6 from Olizuab_LightChain1
gacauacaauuaacacaaucaccaucaucauuaucagcaucaguaggagacagagucacaaucacaugcagagcaucacaaucagucgacuacgacggagacuccuacaauugguaccaacaaaaaccaggaaaagcaccaaaauuauuaauauacgcagcaagcuacuuagaaucaggaguaccaucaagauucucuggaucuggaucaggaacagacuucacccuaaccauaucaucauuacaaccagaagacuucgcaacauauuacugccaacaaucacacgaagacccauacacauucggacaaggaacaaaaguagaaauaaaaagaacaguagcagcaccaucaguauucauauucccaccaucagacgaacaacuaaaaucaggaacagccucaguaguaugccuauuaaacaacuucuacccaagagaagccaaaguacaauggaaaguagacaacgcacuacaaucaggaaacucacaagaaucaguaacagaacaagacucaaaagacucaacauacucauuaucaucaacauuaaccuuaucaaaagcagacuacgaaaaacacaaaguauacgcaugcgaaguaacacaccaaggacuaucaucaccaguaacaaaaucauucaacagaggagaaugc

SEQ ID NO: 46482 - RNA, 1341 nt, Artificial Sequence
  derived and/or modified sequence opt6 from Olokizumab_HeavyChain1
gaaguacaacuaguagaaucuggaggaggacuaguccaaccaggcggaucuuuaagauuaucuugcgccgccaguggauucaacuuuaacgauuauuuuaugaauuggguaagacaagcaccaggaaaaggauuagaauggguagcacaaaugagaaauaaaaauuaccaauaugguaccuauuacgcagaaucacuagaaggacguuucacaauuucuagagaugauucaaaaaacucacuuuacuuacaaaugaacucauuaaaaacagaagauacugcaguuuauuacugcgcaagagaaucguacuacggauucacaucauauuggggacaaggaacacuaguaacuguaucaucagccucuaccaaaggacccucaguauuuccauuagcaccauguagcagaucuacaucugaaaguacagcagcccuaggauguuuaguuaaagauuacuuuccugaaccaguaacaguaucauggaacucaggagcauuaacaucaggaguacacacauuuccagcaguauuacaauccuccgguuuauauucacuaucaucaguagucacaguaccgucuucuucacuaggaacaaaaacuuacacuuguaacguugaucauaaaccaucaaauacaaaagucgauaaaagagucgaaucaaaauacggaccaccaugcccuccaugcccagcuccugaauucuuaggaggaccaucaguauuccuauuuccuccaaaaccuaaagauacacucaugaucagucgaacaccagaaguaacauguguaguuguagaugucucccaagaagauccugaaguccaauuuaacugguacguagauggaguagaaguacacaaugcaaaaacuaaaccacgagaagaacaauucaacucuacauaccguguaguauccguauuaacaguacuucaucaagauuggcuaaauggaaaagaauauaaaugcaaaguuucaaauaaaggacuacccucuucuauagaaaaaacaauaagcaaagcaaaaggccaaccuagagaaccacaaguauacacauuacccccuucccaagaagaaaugaccaaaaaucaaguaagcuuaacaugccuaguaaaaggauuuuacccaucagauauagcaguagaaugggaauccaacggacaaccagaaaauaacuauaaaacaacaccaccaguacuagacucagacggaucauucuuucucuacucacguuuaacaguagacaaaucaagauggcaagaagguaacgucuucucauguucuguaaugcaugaagcacuacauaaccacuauacacaaaaaucauuaucacuaucucucggaaaa

SEQ ID NO: 46483 - RNA, 642 nt, Artificial Sequence
  derived and/or modified sequence opt6 from Olokizumab_LightChain1
gauauacaaaugacacaaucaccaucaagccuaucagcaucaguaggagaucgaguaacaauaacaugucaagcaagucaagacauaggaauaucccuaucuugguaccaacaaaaaccaggaaaagcaccaaaacuacuaauauacaacgcaaacaaccuagcagacggcguaccaucaagauuuucaggaucaggcucaggaacagacuucacccuaacaauaagcucacuacaaccagaagacuucgcaacauacuacugcuuacaacacaacuccgcaccauacacauucggacaaggaaccaaacuagaaaucaaaagaacaguagcagcaccaucaguauucauauucccaccaucagacgaacaacuaaaaucaggaacagcaucaguaguaugccuacuaaacaacuucuacccaagagaagcaaaaguacaauggaaaguagacaacgcauuacaaucaggaaacucacaagaaucaguaacagaacaagacucaaaagacucaacauacagcuuaucaucaacccuaaccuuaucaaaagccgacuaugaaaaacacaaaguauacgcaugcgaaguaacacaccaaggacuaucaucaccaguaaccaaaucauucaacagaggagaaugu

SEQ ID NO: 46484 - RNA, 1341 nt, Artificial Sequence
  derived and/or modified sequence opt6 from Omalizumab_HeavyChain
gaaguacaauuaguagaaucaggugguggccucguacaacccggaggaucacuaagacuaucaugcgcaguaucuggauacucuauaacaucagguuacucauggaauuggauaagacaagcaccuggaaaaggccuagaauggguagccucaauaacauaugacggaucuacaaauuaugcagacucuguaaaaggaagauucacaauuucaagagacgacuccaaaaacacuuucuaccuccaaaugaauucauuaagagcagaagauaccgcaguauacuacugcgcaagaggaucacacuacuucggucauuggcauuucgccguauggggacaaggaacauuaguaacagucucuuccggcccaucaguauucccacuagcaccaucaucaaaaucaacauccgguggaacagcagcacuuggaugucuaguaaaagacuacuucccagaacccguaacagucucauggaacucaggagcucuaacuucaggaguucauacauuuccagcaguccuacaaucaucuggacuauacucauuaucaucuguaguaacaguaccaucauccucguuagguacucaaacuuacauaugcaacguuaaccacaaaccaaguaacaccaaaguagacaaaaaagcagaaccaaaaucuugugauaaaacccacacaugcccuccauguccugcaccagaacuacuugguggaccaucaguuuucuuauuuccaccaaaaccaaaagauacacuaaugauaucaagaacacccgaaguaacauguguaguagucgauguaucucaugaagauccagaaguaaaauuuaacugguauguagacggcguagaaguacacaaugccaaaaccaaacccagagaagaacaauacaauucaacauaccgaguaguaucaguacuaaccguacuacaccaagauuggcuaaacggcaaagaauauaaaugcaaaguaucaaauaaagcacuaccagcacccaucgaaaaaacaauaucuaaagcaaaaggccaaccaagagaaccccaagucuacacacuuccaccaucacgagacgaauuaacuaaaaaccaaguaaguuuaacuugcuuagucaaaggauucuauccaucagacauagcagucgaaugggaauccaacggacagccagaaaacaauuacaaaacaacccccccaguacuagacucagacggcucuuuuuuuuuauacucuaaacucacaguagauaaauccagauggcaacaaggcaauguauuuucuugcucaguaaugcacgaagcacuacacaaccacuauacacaaaaaucucuaagcuuaucacccgguaaa

SEQ ID NO: 46485 - RNA, 645 nt, Artificial Sequence
  derived and/or modified sequence opt6 from Omalizumab_LightChain
gacauacaacuaacacaaucaccaucaucacuaucagcaagcguaggagacagaguaacaauaacaugcagagcaucacaaucaguagacuacgacggagacucauacaugaauugguaccaacaaaaaccaggaaaagcaccaaaacuacuaauauacgcagcaucauaccuagaaagcggaguaccaucacgauucucaggaucaggaucaggaacagacuucacacuaacaauaucaucacuacaaccagaagacuucgcaacauacuacugccaacaaucacacgaagacccauacacauucggacaaggcacaaaaguagaaauaaaacgaacaguagccgcaccaagcguauucauauucccaccaucagacgaacaauuaaaaucaggaacagcaucagucguaugccuacuaaacaacuucuacccaagagaagccaaaguacaauggaaagucgacaacgcacuacaaucaggaaacucacaagaaucaguaaccgaacaagacagcaaagacucaaccuacagccuaucaucaaccuuaacacuaucaaaagccgacuacgaaaaacacaaaguauaugcaugcgaaguaacacaccaaggauuaucaucaccagucacaaaaucauucaacaga

SEQ ID NO: 46486 - RNA, 1347 nt, Artificial Sequence
  derived and/or modified sequence opt6 from Onartuzumab_HeavyChain1
gaaguacaauuaguagaaucaggaggcggucuaguacaaccuggaggaucauuacgacuaaguugcgcagccucuggauauacauucacaagcuauuggcuacacuggguuagacaagccccaggaaaaggauuagaauggguaggaaugauagacccaucaaacucagacacaagauucaacccuaauuucaaagauagauucacaauaucagccgacacaucaaaaaacacagcauacuuacagaugaauucauuacgagcagaagacacugcaguauacuauugugcaaccuacaggucauauguaacaccauuagacuacuggggacaaggaacucuaguaacaguaucaucugccuccacaaaagguccaucuguauuuccacuagcaccaucauccaaaucuacaucaggaggcacagcagcauuaggauguuuaguaaaagacuacuucccagaaccaguaacaguaucauggaacucaggugcacuaacaucaggaguacacacuuuucccgcagucuuacaaucaaguggacucuauucacucuccucaguagucacaguaccaucaucaucacuagguacccaaaccuauauauguaacguaaaccauaaaccaucaaauacaaaaguagacaaaaaaguagaaccaaaaagcugcgauaaaacacauacaugcccaccaugcccagcaccugaauuacucggaggaccaucaguauuccuauuuccaccaaaaccaaaagauacacuaaugauaucacgaacucccgaaguaacauguguuguuguagacguuucacaugaagauccagaaguaaaauuuaacugguacguagauggcguagaaguacauaaugcaaaaaccaaaccaagagaagaacaauauaauucaacauacagaguaguaucaguacuaacaguauuacaccaagacugguuaaacggcaaagaauacaaaugcaaaguaucaaacaaagcauuaccagcaccaaucgaaaaaaccauaaguaaagcaaaaggccaaccaagagaaccacaaguuuacacuuuaccaccuuccagagaagaaaugacuaaaaaucaagucucacuauccugcgcaguaaaaggauuuuauccauccgacaucgcuguagaaugggaaucaaauggccaaccagaaaacaauuauaaaaccacaccaccaguucuagauucagauggaucauuuuuccuaguauccaaauuaaccguagacaaaucaagauggcaacaaggaaacguauucucaugcucuguaaugcacgaagcauuacacaaccacuacacccaaaaaucacuaucacuaaguccaggaaaa

SEQ ID NO: 46487 - RNA, 681 nt, Artificial Sequence
  derived and/or modified sequence opt6 from Onartuzumab_HeavyChain2
gacaaaacccacacaugcccaccaugcccagcaccagaacuauuaggaggaccaucaguauuucuauucccaccaaaacccaaagacacucuaaugauaucaagaacaccagaagucacaugcguaguaguagacguaucacacgaagacccagaagucaaauucaacugguacguagacggaguagaaguacacaacgcaaaaacaaaacccagagaagaacaauacaacucaacauaccgcguaguaucaguauuaacaguacuccaccaagauugguuaaacggaaaagaauacaaaugcaaaguaucaaacaaagcacuaccagcaccaauagaaaaaacaauaucaaaagccaaaggacaaccaagagaaccacaaguauacacacuaccaccuucaagagaagaaaugacaaaaaaccaagucucacuauggugccuaguaaaaggcuucuauccaucagacauagcaguugaaugggaaucaaacggacaaccagaaaacaacuacaaaacaacaccaccaguacuagacucagacggauccuucuuccuauacucaaaacuaacaguagacaaaucaagauggcaacaaggaaacguuuucucaugcucaguaaugcaugaagcacuacacaaccacuacacacaaaaaucauuaucacuaucaccaggaaaa

SEQ ID NO: 46488 - RNA, 660 nt, Artificial Sequence
  derived and/or modified sequence opt6 from Onartuzumab_LightChain1
gacauacaaaugacacaaucaccaucaucccuauccgcaucaguaggagacagaguaaccauaaccugcaaaucaucacaaucacuacuauacaccucaucccaaaaaaacuaccuagcaugguaccaacaaaaaccaggaaaagcaccaaaauuacuaaucuacugggcaucuacaagagaaucaggaguaccaucaagauucucaggaucaggaucaggaaccgauuucacacuaacaauaucaucauuacaaccagaagacuucgcuacauacuacugccaacaauacuacgcauacccauggacauucggacaaggaacaaaaguagaaaucaaacgaacaguagcagccccaucaguauucaucuucccaccaucagacgaacaacuaaaaucaggaacagcaucaguaguaugcuuacuaaauaacuucuacccaagagaagcaaaaguacaauggaaaguagacaacgcacuacaaucuggaaacucacaagaaucaguaacagaacaagacucaaaagacucaacauacucauuaucaucaacacuaacauuaucaaaagcagacuacgaaaaacacaaaguauacgcaugcgaaguaacacaucaaggacuaucaucaccaguaacaaaaucauucaacagaggcgaaugc

SEQ ID NO: 46489 - RNA, 1362 nt, Artificial Sequence
  derived and/or modified sequence opt6 from Ontuxizumab_HeavyChain1
caaguacaauuacaagaaucaggacccggauuaguaagaccaucacaaacucuaucacuaaccugcaccgcauccggcuacacauucacagacuacguaauacacuggguaaaacaaccaccuggaagaggacuagaauggauaggauauauaaacccuuaugaugacgacacaacauacaaccaaaaauuuaaaggaagagucaccaugcuaguagauacuuccucaaacacagccuaucuaagauuaucuucaguaacagcugaagacacagcaguauacuacugcgcaagaagaggaaauucuuacgacggauauuuugauuacucaauggacuacugggguucaggaacaccaguaacuguuucuucagcaucaaccaaagguccauccguuuuuccauuagcaccuucaucaaaaagcacaucugguggaaccgccgcacuaggcuguuuaguaaaagacuacuuccccgaaccagucacaguaucauggaauucaggagccuuaaccucaggaguucacacauuuccagcaguacuacaaucaagcgguuuauauucauuaucuucaguaguaaccguaccaucuuccucacucggaacacaaaccuacauaugcaacguuaaccauaaaccaucaaacacaaaaguagauaaaaaaguagaaccaaaauccugcgacaaaacacauacauguccaccuuguccagcaccagaacuacuuggaggccccucuguauucuuauuuccuccuaaaccuaaagauacacuuaugauaaguagaacuccagaagucacaugcguaguaguagacguuucacacgaagauccagaagucaaauucaauugguacguagacggaguugaaguacacaacgccaaaacaaaacccagagaagaacaauacaacucaacuuaucgcguaguuucaguucuaacaguauuacaucaagacuggcuuaacggaaaagaauauaaaugcaaaguauccaacaaagccuuaccagcuccaauagaaaaaacuauauccaaagccaaaggacaaccaagagaaccacaaguauauaccuuaccacccucaagagacgaacugacaaaaaaucaaguaucuuuaacaugucuaguaaaaggauucuauccaucagauauugcaguagaaugggaaucaaauggacaaccagaaaauaauuacaaaacaacaccaccaguauuagacuccgacggauuuuucuuccuauacuccaaacuaacagucgauaaaucaagauggcaacaaggcaauguauucagcugcucuguaaugcaugaagcacuacauaaccacuacacacaaaaaucacuaucauuaucacccggaaaa

SEQ ID NO: 46490 - RNA, 645 nt, Artificial Sequence
  derived and/or modified sequence opt6 from Ontuxizumab_LightChain1
gacauacaaaugacacaaucuccaucaucacuaucagcaucaguaggcgacagaguaacaauaacaugcagagcaucacaaaacguaggaacagcaguagcauggcuacaacaaacaccaggcaaagcaccaaaacuacuaauauauucagcaucaaacagauacacaggaguaccaucacgauuuucaggauccggaucaggaaccgacuacacauuuacaauaucaucauuacaaccagaagacauagcaacauacuacugccaacaauacacaaacuacccaauguacacauuuggacaaggaacaaaaguacaaauaaaaagaacaguagcagcuccaucuguauucauauucccacccucagacgaacaacuaaaaucaggaacagcaucaguaguaugcuuacuaaacaacuucuacccaagagaagcaaaaguacaauggaaaguagacaaugcacuacaaucaggaaacagccaagaauccguaacagaacaagacucaaaagacucaacauacuccuuaucaucaacacuaacacucucaaaagcugauuacgaaaaacacaaaguauacgcaugcgaaguaacacaccaaggacuaucauccccaguaacaaaaucauucaacagaggagaaugc

SEQ ID NO: 46491 - RNA, 1341 nt, Artificial Sequence
  derived and/or modified sequence opt6 from Opicinumab_HeavyChain1
gaaguucaauuacuagaaucuggcggaggcuuaguucaaccuggcgguucacuaagacucuccugcgcggccucaggcuucacauucucagcauaugaaaugaaauggguacgccaagccccaggaaaaggacuagaauggguaucaguaauaggaccaucaggaggcuucacuuuuuacgcagacucaguaaaagguagauuuacaauaucaagagauaauaguaaaaacacauuauauuuacaaaugaauucauuaagagccgaagacacagcaguauauuacugcgcaacagaaggugacaacgaugcauuugauauauggggacaaggaaccacaguaacaguauccucagcauccacuaaaggaccuucaguauuuccuuuagcaccaucaucaaaauccacaucaggaggaacugcagcauuagguugccuuguaaaagacuacuuuccagaaccuguaacuguaagcuggaauucuggagcccuaacaucgggaguacacaccuuuccugcaguacuucaaucaucaggauuauacucauuaaguucaguuguaaccguuccaagcucaucacuaggaacacaaacuuacauauguaacguaaaccacaaacccucaaacacaaaaguagacaaaaaaguagaaccaaaaucuugcgauaaaacacauacauguccaccaugcccagcaccagaacuauuaggaggaccaucuguauucuuauucccacccaaaccuaaagacacacuaaugauuuccagaacccccgaaguuaccuguguuguaguugauguaagucaugaagacccagaaguaaaauuuaacugguauguagaugguguagaaguucacaacgcaaaaacaaaaccaagagaagaacaauacaauucagcuuaccgaguaguaucuguuuuaaccguacuucaccaagacugguuaaauggaaaagaauauaaauguaaaguuaguaauaaagcauuaccagcaccaauagaaaaaaccauaagcaaagcaaaaggucaaccaagagaaccacaaguuuauacauuaccacccucaagagaugaauuaacaaaaaaucaaguauccuuaacaugucuaguuaaagguuuuuacccaucugauauugcaguagaaugggaaucaaauggccaaccagaaaauaacuauaaaacaacaccaccaguacuagacucagauggcucauucuucuuauauuccaaauuaacagucgauaaaucaagauggcaacaaggcaacguuuuuuccuguucaguaaugcacgaagcauuacauaaccauuacacucaaaagucuuuaucccuaucaccugga

SEQ ID NO: 46492 - RNA, 645 nt, Artificial Sequence
  derived and/or modified sequence opt6 from Opicinumab_LightChain1
gacauacaaaugacccaaucaccagcaacacucucacuaucaccaggagaacgagccacacuaucaugcagagcaucacaaucaguaucaucauaccuagcaugguaccaacaaaaacccggccaagcaccaagauuacuaauauacgacgcaucaaacagagccacaggaauaccagcacgauucucaggaucaggaucaggaacagacuucacucuaacaauaucaucacuagaaccagaagauuucgcaguauauuacugccaacaaagauccaacuggcccauguacacauucggacaaggaacaaaacuagaaauaaaaagaacaguagcagcaccaucaguauucauauucccaccaucagaugaacaacuaaaaucaggaacagcaucaguaguaugccuacuaaacaauuuuuacccccgagaagcaaaaguacaauggaaaguagacaacgcacuacaaucaggaaacucacaagaaucaguaacagaacaagacucaaaagacucaacauacucacuaucaucaacacuaacacuaucaaaagccgacuacgaaaaacacaaaguauaugcaugcgaaguaacacaucaaggacuaucaucaccaguaacaaaaucauucaacagaggagaaugc

SEQ ID NO: 46493 - RNA, 1941 nt, Artificial Sequence
  derived and/or modified sequence opt6 from Oportuzumab_monatox_HeavyChain1
caucaucaucaucaccaugauauacaaaugacucaaucaccaucaagucuaagugccuccguaggggauagaguuacaauaacuuguagaucaacuaaaucauuacuacauucuaaugguaucacauacuuauacugguaucagcaaaaaccuggaaaagcuccaaaauuacuaauauaccaaaugucuaauuuagcaagcggaguaccaucacgauuuucaaguagugggucaggaacugauuuuacacuuacaauauccucucuacaacccgaagauuuugcaacauauuauugugcacaaaaucuagagauaccaagaacauuugggcaaggcacaaaaguugaacuaaaacgagccacuccaucacacaauucacaccaaguaccaagugcugguggaccaacugcaaauaguggcacaagcgggagcgaaguacaacuaguccaaucaggaccaggauuaguucaaccuggaggcuccguaagaauaucaugugcagccaguggauacaccuuuacaaauuauggaaugaauuggguuaaacaagcucccggaaaaggauuagaauggauggguuggauaaauacuuauacgggugaaaguacauaugcagauucguuuaaaggaagguuuacuuuuucuuuagauacaucugcaagugcagcuuaucuacaaauaaacagcuuacgagcagaagauacugcaguauacuauugcgcuagauuugcuauaaaaggagauuacuggggacaaggaacauuacuuacuguaagcagugaauuugguggagcuccagaauuuccaaaaccuagcacaccgcccggaaguucaggauuagaagguggaucauuagcagcucucacagcacaucaagcuugucauuuaccacuagaaacauuuacaagacauagacaaccgagagguugggaacaauuagagcaaugcggauauccugugcaaagacuaguagcucuauauuuagcagcacggcuaucauggaaccagguagaucaaguaauccgcaaugcacuagcaagcccaggaucaggcggugauuuaggggaagcaauaagagaacaaccagaacaagcaagauuagcguuaacacuugcagccgcagaaucggaaagauuuguaagacaagguacaggaaaugaugaagcaggagcagcauccgccgacguaguaucgcuaaccugcccuguugccgccggagaaugcgcaggaccagcagauucaggagaugcccuauuagaaagaaauuacccgacaggagcagaauuucuaggugacggaggagacguauccuuuagcacaaggggaacccaaaacuggacuguagaaagacuauuacaagcucaucgucaauuagaagaaagagguuauguuuuugucggauaucacggaacauuucuugaagccgcucaaaguauaguauuuggaggaguaagagcuagaucacaagaucuugaugccauauggagaggauuuuauauagcaggagauccagcacuagcauaugguuaugcacaagaccaagaaccugaugcaagaggaagaaucagaaauggagcacuacugagaguuuauguacccagaaguucauuaccagguuuuuaccgaacaggacuaacauuagcagcuccagaagcagcuggugaaguugaaagacuaauaggucacccauugccucucagauuagaugcaauuacagguccagaagaagaagguggaagacuagaaacaauacuaggauggccauuagccgagagaacaguuguaauaccaucagcuauaccaacagauccaagaaacguuggcggagaucuagauccuuccucaauaccagauaaagaacaagcuauaagcgcacuaccagauuaugcuucucaaccugggaaaccaccgcaucaucaucaccaccauaaagaugaauua

SEQ ID NO: 46494 - RNA, 1941 nt, Artificial Sequence
  derived and/or modified sequence opt6 from Oportuzumab_monatox_SingleChain_variable_fragment
caucaucaccaucaucacgauauccaaaugacacaaagcccaucaucuuuaucagcuuccgucggagauagaguaacuaucacuugcagaaguacaaaaucuuuauuacauucaaauggaauaacauaccuuuacugguaucaacaaaaaccagguaaagcuccaaaacuacuuauauaucaaaugucaaaucuggcaucaggaguaccuucaagauuuucaucaucaggaucagggacagauuuuacccucaccaucuccagccuccaaccugaagauuucgcaacuuacuauugugcacaaaauuuagaaaucccaagaacauucgggcaaggcacaaaaguagaacuaaaaagagcaacaccuucacauaauucacaucaagucccaagcgcuggaggaccaacagcaaacucaggaacuucugguagugaaguucaauuaguacaaagcggaccuggacuuguacaaccaggaggaucagucagaauaucaugugcagcuucaggauauacauucacaaacuauggcaugaacugggugaaacaagcaccaggaaaaggacuagaauggaugggauggaucaauacauauacuggugaaucgacauaugcagauuccuucaaagguagauucacuuuuucacuugacacuucagcuucagcugcuuaccuacaaauaaauaguuuacgagcugaagauacagcaguauauuauugcgcuagauuugcaauaaaaggagauuauuggggacaaggaacuuuacucacaguaucaucagaauucggaggcgcaccugaguuuccaaaaccaucaacuccuccaggaaguagcggauuagaaggagguucacuagcagcauuaacagcacaucaagcaugucauuuaccacuagaaacauuuacaagacaccgacaaccaagaggaugggaacaacuagaacaauguggauauccaguacaaagauuaguagcuuuauacuuagcagcaagauuauccuggaaucaagucgaucaaguaauccgaaaugcauuagcaucaccaggcaguggaggcgauuuaggcgaagccauacgugaacaaccagagcaagcuagacuagcacuaacauuagcugcugccgaaagcgaaagauuuguaagacaaggaacaggaaaugacgaagcaggggcggcgagugcagacguuguaaguuuaacuuguccaguugcugcuggugaaugugcuggaccugcagauucaggcgacgcacuucuagagcggaacuacccuacaggcgccgaauuucuaggugauggaggagauguaagcuuuaguacaagaggcacucaaaauuggacuguagaaagacuucuacaagcacauagacaauuagaggaaagaggauacgucuuuguuggauaucacggaacauuuuuagaagcugcacaaucuauaguauucggaggaguuagggcacgcucacaagaccuagaugcuauauggagaggauuuuacauagcaggagaucccgcauuagccuauggauaugcucaagaucaagaaccagaugccagagguagaaucagaaauggagcuuuacuaagggucuauguuccacgaucuagucuaccaggcuucuaccgaacaggauuaacauuagcagcuccagaagcagcgggagaaguugaaagauuaauaggucauccacugccguuaagauuagaugcuauuacagguccagaagaagaaggcggaagauuagaaacuauccuaggauggccauuagcagaaagaacagucgucauaccaucagcaauaccaacagauccaagaaacgucgguggagauuuagauccaagcaguauaccagauaaagaacaagcaauauccgcucuaccugauuacgcaucucaaccaggaaaacccccucaucaucaucaucaucauaaagaugaauua

SEQ ID NO: 46495 - RNA, 762 nt, Artificial Sequence
  derived and/or modified sequence opt6 from Oreptacog_alfa_HeavyChain1
auaguaggaggaaaaguaugcccaaaaggagaauguccauggcaaguauuacuauuaguaaauggagcacaauuauguggaggaacauuaauaaacacaauauggguaguaucagcagcacauuguuuugauaaaauaaaaaauuggagaaacuuaauagcaguauuaggagaacacgaucuaucagaacaugauggagacgagcaaucaagaagaguagcacaaguaauaauaccaagcacauauguaccuggaacaacaaaucaugauauagcauuacuaagacuacaucaacccguuaauuuaacagaucauguuguaccauuaugucuaccagaaagaacauucucagaaagaacauuagcauucguuagauuuagucuaguuucagguuggggacaauuauuagacagaggugcaacagcacuagaauuaaugguacuaaauguaccaaggcuaaugacacaagacugucuacaacaaucaagaaaaguaggagauucaccaaauauaacagaauauauguuuugugcaggauauagcgauggaucaaaagauaguuguaaaggagacucaggagguccacacgcaacacauuauagaggaacaugguacuuaacuggaauaguaucauggggacaaggaugugcaacaguaggacauuucggaguauacacaagaguaagucaauacauugaaugguuacaaaaauuaaugagaagcgaacccagaccaggaguauuauuaagagcaccauuucca

SEQ ID NO: 46496 - RNA, 456 nt, Artificial Sequence
  derived and/or modified sequence opt6 from Oreptacog_alfa_LightChain1
gcaaaugcauuucuagaagaauuaagacaaggaucacuagaaagagaaugcaaagaagaacaauguagcuuugaagaagcaagagaaauauucgaagacgaagaagaaacaaaacuauuuuggauaaguuauagcgauggagaucaaugugcaucaagcccaugccaaaacggaggaucaugcaaagaccaacuacaaaguuauauauguuucugucuaccagcauuugaaggaagaaauugcgaaacacauaaagaugaccaacuaauaugcguaaacgaaaacggaggaugugaacaauacuguagcgaucacaauggaacaaaaagaagcuguagaugucacgaaggauauagcuuacuagcagacggaguaucaugcacaccaacaguagaauacccaugcggaaaaauaccaauacuagaaaaaagaaacgcaagcaaaccacaaggaaga

SEQ ID NO: 46497 - RNA, 1353 nt, Artificial Sequence
  derived and/or modified sequence opt6 from Orticumab_HeavyChain1
gaaguacaacuccuagaaucagguggaggacuuguacaaccaggcgguucacucagauuauccugcgccgcaucaggcuucacauucuccaaugcuuggauguccuggguuagacaagcaccaggaaaaggccuagaauggguaucaucuauaucaguaggcgggcauagaacuuacuaugcagacucaguaaaaggaagaucaacaauaucacgugacaauuccaaaaauacacuauacuuacaaaugaauucauuaagagcugaagacacagcaguauauuauugugcaagaauuagaguaggaccauccggaggagcauucgauuauuggggacaaggcacauuaguaacaguaucaucagcauccacaaaaggaccuucaguauuuccauuagcaccaucaucaaaaucaacaucuggcggaacagcagcacuaggaugucuaguaaaagauuauuuccccgaaccaguaaccgucuccuggaauucaggagcacugacuuccggaguccacacauuucccgcaguauuacaaucaucuggacuauauucauuaucaaguguagucaccguaccuucaucuucauuaggaacacaaacauacauaugcaacgucaaucacaaaccaucaaacacaaaagucgauaagaaagucgaaccaaaaucaugcgauaaaacucacacuuguccaccauguccagcaccagaacuccuaggaggcccaucaguuuuuuuauucccuccuaaacccaaagacacucuaaugauaucaagaacaccagaaguaaccugcguugucgucgacgucagccacgaagauccagaaguaaaauucaauugguauguagacggcguagaaguacauaacgcaaaaacaaaaccaagagaagaacaauauaacucaacauacagaguaguaucaguauuaaccguacuacaucaagacuggcuaaacgguaaagaauacaaauguaaagucaguaacaaagcauuaccagcucccauagagaaaacaauaucaaaagccaaaggacaaccacgagaaccccaaguauacacauuacccccaucaagagacgaauuaacaaaaaaccaaguaucacuaacaugucuaguaaaaggauucuacccaucagacauagccgucgaaugggaauccaacggacaaccagaaaacaacuacaaaacuacaccccccguuuuagacucagauggaucuuucuuuuuauacucaaaacuaacugucgacaaaucaagauggcaacaaggaaauguauuuucaugcucaguaaugcacgaagccuuacacaaucacuacacacaaaaaucacuaucacuuuccccaggaaaa

SEQ ID NO: 46498 - RNA, 648 nt, Artificial Sequence
  derived and/or modified sequence opt6 from Orticumab_LightChain1
caaucaguacuaacacaaccaccaucagcaucuggaacaccaggacaaagaguaacaauaucaugcucaggaucaaauacaaacauaggaaaaaacuacguaucaugguaccaacaacuaccaggcaccgcaccaaaacuauuaauauacgccaauucaaacagaccauccggaguaccagacagauucucaggaucaaaaucaggaacaucagcaucacuagcaauaucaggacuaagaucugaagacgaagcagacuacuacugcgcaucaugggacgcaucacuaaacggauggguauucggaggaggaacaaaauuaacaguacuaggacaaccaaaagccgcaccaucaguaacacuauucccaccaucuucagaagaacuacaagcaaauaaagcaacccuaguaugcuuaauaucagacuucuauccaggagcaguaaccguagcauggaaagcagacucaucaccaguaaaagccggaguagaaacaacaacaccaucaaaacaaucaaacaacaaauacgcagcaucaucauaccuaucauuaacaccagaacaauggaaaucacacagaucauacucaugccaaguaacacacgaaggaucaacaguagaaaaaacaguagcaccaacagaaugcuca

SEQ ID NO: 46499 - RNA, 1347 nt, Artificial Sequence
  derived and/or modified sequence opt6 from Otelixizumab_HeavyChain1
gaaguacaauuacucgaaucaggaggaggccuaguacaacccggaggaaguuuaagacucucaugcgccgcuucaggauucacuuucucaucauuuccuauggccuggguaagacaagcaccaggaaaaggacuagaauggguaaguacaaucucaacaucaggaggucgaacuuauuacagagacucaguuaaagguagauuuaccauuucaagagacaauagcaaaaacacacuauaucuacaaaugaauucacuacgagcagaagacacugcaguuuauuauugugccaaauucagacaauacucaggaggcuuugauuacuggggacaagguacuuuaguaacaguaucauccgcuucaacaaaagguccaucagucuuuccccuagcaccuucaucaaaaucaacuucaggaggaaccgcagcccuuggaugucuaguaaaagacuacuuccccgaaccuguaacaguuucauggaacagcggugcacucacaucaggcguacauacauucccagcaguauuacaaucaucaggucuauauucauuaucaucaguagucacaguaccauccucaagucuaggaacacaaaccuauaucugcaacgucaaccauaaaccuucaaauacaaaaguagacaaaaaaguagaaccaaaaucaugugacaaaacucacacauguccaccauguccugcuccugaacuauuagguggcccaucaguuuuccuauucccuccaaaaccaaaagauacauugaugauaucaagaaccccagaaguaacuugcguuguagucgacgucucacaugaagauccagaaguaaaauucaauugguaugucgacggaguagaaguacauaacgcaaaaacaaaacccagagaagaacaauaugcuucaacauauagaguaguaucuguacuaacaguacuacaucaagacugguuaaacggaaaagaauauaaauguaaagucucaaacaaagcauuaccagccccuauagaaaaaaccauuucaaaagccaaaggacaaccccgcgaaccacaaguauauacacuaccaccaucaagagaugaauuaacaaaaaaccaagucucacucacuugcuuaguaaagggauuuuacccaucagauaucgcuguggaaugggaaaguaauggacaaccagaaaauaauuacaaaacaacaccaccaguauuagacucagauggaucuuucuuuuuauacucaaaacuaacagucgacaaaucacgauggcaacaaggcaacguauucucuuguuccguaaugcaugaagcccuucacaaccauuauacacaaaaaucuuuaagucuaucccccggcaaa

SEQ ID NO: 46500 - RNA, 648 nt, Artificial Sequence
  derived and/or modified sequence opt6 from Otelixizumab_LightChain1
gacauacaacuaacacaaccaaacucaguauccaccucccuaggaucaacaguaaaauuaucaugcacauuaucaucaggaaacaucgaaaacaauuacguacacugguaccaacuauacgaaggaagaucaccaacaacaaugauauacgacgacgacaaaagaccagacggaguaccagacagauucucaggcucaauagacagaucaucaaacucagcauuccuaacaauacacaauguagcaauagaagacgaagcaauauacuucugccacucauacguaucaucauucaacguauucggaggaggaacaaaacuaacaguacuacgacaacccaaagcagcaccaucaguaacacuauucccacccucaagugaagaacuacaagcaaacaaagcaacauuaguaugccuaauaucagacuucuacccaggagcaguaacaguagcauggaaagcagacucauccccaguaaaagcaggaguagaaacaacaacaccaucaaaacaaucaaacaacaaauacgccgcaucaucauacuuaucacuaacccccgaacaauggaaaucacaccgaucauacucaugccaagucacacacgaaggaucaacaguagaaaaaacaguagcaccaacagaaugcuca

SEQ ID NO: 46501 - RNA, 1449 nt, Artificial Sequence
  derived and/or modified sequence opt6 from Otlertuzumab_HeavyChain1
gaaguacaauuaguccaaucaggagcagaagucaaaaaaccaggugaaaguuuaaaaauuucuuguaaaggauccggauacucauuuacuggauauaauaugaacuggguuagacaaaugccagguaaaggauuagaguggaugggaaauauagauccuuauuacgguggaacaacuuauaauagaaaauucaaaggacaaguaaccauaucagcagacaaaagcauuucaacugcauaucuacaaugguccucacuaaaagcaagcgauaccgccauguauuacugcgcaagauccguaggaccauucgacaguuggggacagggaacauuagugacaguaucaucaggcggaggaggaucuggaggcggaggaucaggaggaggaggaaguggaggaggagguucaggaggaggagguucagaaaucguacuaacacaaucaccagcaacucuaucacuaucaccaggggaaagagcaacccuaucauguagagcuucagaaaauguauauuccuaccuugcaugguaccaacaaaaaccuggacaagcgccgagacuauuaauauauuucgcaaaaacacuagcugaaggaauacccgccagauucucugggucugguucaggaacugacuuuacauuaacaauaagcucacucgaaccagaggauuuugcaguguacuacugccaacaccacagcgauaacccauggacauucggacaagggacaaaaguagaaauaaaaggcgaucaagaaccaaaaaguucagauaaaacacacacaucaccaccaugcccagcaccagaacuacuaggaggaccaagcguuuucuuauuuccuccaaaacccaaagauacccucaugaucucgagaacccccgaaguaacauguguaguaguagacguuucucaugaagaucccgaagucaaauucaauugguauguagauggaguagaaguacacaaugccaaaacuaaaccacgagaagagcaauacaauucaacauauagaguaguaucuguacucacugucuuacaucaagauugguugaaugguaaagaauacaaaugcaaaguaucaaacaaagcacucccagcgccaauagaaaaaacaauaucaaaagcaaaaggacaaccaagagaaccacaaguauacacauuaccaccaaguagagaugaauuaacaaaaaaccaagucucucucacuugcuuaguaaaaggcuuuuauccaagcgauauagcaguagaaugggaaagcaauggacaaccugaaaauaauuacaaaacaacaccaccaguauuagauucagaugguucauuuuucuuauacucaaaacuaaccguagacaaaagcagauggcaacaagguaacguauucucaugcucaguaaugcacgaagcauuacauaaucauuauacacaaaaaaguuuaucucuauccccaggaaaa

SEQ ID NO: 46502 - RNA, 1347 nt, Artificial Sequence
  derived and/or modified sequence opt6 from Oxelumab_HeavyChain1
gaaguacaacuacuagaauccgggggaggccuaguccaaccaggugguuccuuaagauuauccugugcugcaucaggauuuacauuuaacuccuaugcuaugagcuggguaagacaagcacccgguaaaggucuagaauggguuuccauaauaucaggaucuggaggauucacauacuaugccgauucaguuaaaggaagauuuacaaucuccagagacaacucacgaacaacacucuaucuacaaaugaauucauuaagagcugaagauacugcuguauacuacugugcuaaagaucgauuaguagcaccagguacauucgauuacuggggacaaggagcacucguaacaguaucuuccgccucaacuaaaggaccaucaguauuuccccuagcaccaucuucaaaauccacuaguggaggaacugcagcauuaggcugcuuaguaaaagacuacuucccagaaccugucacaguaucauggaauuccggagcuuuaacaucaggaguucacacuuucccagcaguauuacaaucaucaggacuauacucauuaucaucuguaguuacaguaccaaguucaucauuagguacacaaacuuacauaugcaacguaaaucacaaaccaucaaauacaaaaguugacaaaaaaguugaaccaaaauccugugacaaaacacauacaugcccaccauguccagcuccagaacuacucggaggcccaucaguauuuuuauuuccaccaaaaccaaaagacacauuaaugauaucacgaacaccugaaguuacauguguagucguagauguaucacacgaagacccagaaguaaaauuuaacugguacgucgacggagucgaaguacacaacgcaaaaacuaaaccaagagaagaacaauauaacaguacauaccguguaguaucuguccuaacaguacuucaccaagacuggcucaauggaaaagaauauaaauguaaagucucaaacaaagcacuaccagccccuauagaaaaaacaauaucaaaagccaaaggacaaccccgagaaccacaaguauacacauuaccuccaucaagagacgaauuaacaaaaaaucaaguaucauuaacauguuuaguaaaaggguucuauccaucugacauugcaguagaaugggaaucaaacggacaaccagaaaacaacuacaaaacuacaccaccaguacuagacucugacggauccuuuuuucuuuacucaaaacuaacagucgacaaaucacgauggcaacaaggaaacguauuuucauguucaguaaugcaugaagcacuacacaaccauuacacgcaaaaaucauuaagucuaucaccaggu

SEQ ID NO: 46503 - RNA, 642 nt, Artificial Sequence
  derived and/or modified sequence opt6 from Oxelumab_LightChain1
gacauacaaaugacacaaucaccaucaucacuaucagcauccguaggagacagaguaacaauaacaugcagagcaucacaaggaauaucaucaugguuagccugguaccaacaaaaaccagaaaaagcaccaaaaucccuaauauacgcagcauccucauuacaaucaggaguaccauccagauucucaggaucaggaucuggcacagacuuuacacuaacaauauccucacuacaaccagaagacuucgcaacauacuacugccaacaauacaacucauacccauacacauucggacaaggaacaaaacuagaaaucaaacgaacaguagcagccccaucaguauucauauucccaccaucagacgaacaacuaaaaucaggcacagcaucagucguaugccuacucaacaacuucuacccaagagaagcaaaaguacaauggaaaguagacaacgcacuccaauccggaaacucacaagaaucaguaacagaacaagauucaaaagacucuacauacucauuaucaucaacacuaacauuaucaaaagccgauuacgaaaaacacaaaguauacgcaugcgaaguuacacaccaaggacuauccucaccaguaacaaaaucauucaacagaggagaaugc

SEQ ID NO: 46504 - RNA, 1329 nt, Artificial Sequence
  derived and/or modified sequence opt6 from Ozanezumab_HeavyChain1
caaguacaacuuguccaaucaggagcagagguaaaaaaacccggagcaucagucaaaguaucaugcaaagccucagguuacacauuuacaucauauuggaugcauuggguaagacaagcaccaggacaaggacuagaauggauaggaaacaucaaucccucuaauggaggaacaaacuacaacgaaaaauuuaaaucaaaagcaacaaugacaagagacacaucaaccucaacagcuuacauggaacuaucaucacuaagauccgaagacaccgcaguauauuacugugaacuaaugcaagguuauuggggucaaggaacacuaguaacagucucaucugccucaacaaaaggaccuucaguauucccacuagcaccaucaucaaaaucaaccucuggaggaacugcagcauuaggaugucuaguaaaagauuacuucccagaaccaguaaccguauccuggaacagcggugcauuaacaucaggaguacauaccuucccagcuguacuacaaucaucaggacuauacuccuuaucauccguaguuaccguaccauccagcucacuuggaacacaaacauacauauguaacguaaaucacaaaccaucuaacacuaaaguagacaaaaaaguagaaccaaaaucaugugacaaaacacauacuuguccacccugucccgcccccgaacuagcaggcgccccaucaguauuccuuuuuccacccaaaccaaaagacacucuaaugaucucaagaacacccgagguaacaugcguagucguagauguaagucacgaagacccagaaguaaaauucaacugguacguagacggaguggaaguacacaaugcaaaaacaaaaccacgagaagaacaauacaauucaaccuacagaguaguaucaguauuaacaguguuacaccaagacugguuaaauggaaaagaauacaaaugcaaaguuucaaacaaagcauuacccgcucccauugaaaaaacaauaucaaaagccaaaggacaacccagagaaccccaaguauacacccuaccaccaucaagagacgaacuaacaaaaaaccaaguaucauuaacaugccuuguaaaaggcuucuauccaucagacauagcaguagaaugggaaucaaacggccaaccagaaaauaauuacaaaacaacaccaccaguacuugacucugacggaucauucuuccuauauucaaaacuaacuguagauaaaucaagauggcaacaaggaaacgucuuuuccugcucagucaugcaugaagcacuacacaaucacuauacacaaaagucacuaucacuaucucccggaaaa

SEQ ID NO: 46505 - RNA, 657 nt, Artificial Sequence
  derived and/or modified sequence opt6 from Ozanezumab_LightChain1
gacauaguaaugacacaaucaccacucucaaacccaguaacacuaggacaacccguaucaauaucaugcagaucaucaaaaucacuacuauacaaagauggaaaaaccuacuuaaacugguucuuacaaagaccaggacaaucaccacaauuacuaauauacuuaaugagcacacgagcaucaggaguaccagaccgauucucaggaggaggaucaggaacagacuucacucuaaaaauaucaagaguagaagcagaagacguaggcguauacuauugccaacaacuaguagaauacccacuaacauucggacaaggaacaaaacuagaaauaaaaagaacaguagcagcaccaucagucuuuauauucccaccaucagacgaacaacuaaaaucaggaacagcaucaguaguaugccuacuaaacaauuucuacccacgagaagcaaaaguacaauggaaaguagauaacgcacuccaaucuggaaacucacaagaaucaguaacagaacaagacucaaaagacucaacauacucacuauccucaacauuaacauuaagcaaagcagacuacgaaaaacacaaaguauacgcaugcgaaguaacacaccaaggacuaucaucaccaguaacaaaaucauucaaccgaggcgaaugc

SEQ ID NO: 46506 - RNA, 1089 nt, Artificial Sequence
  derived and/or modified sequence opt6 from Ozoralizumab_HeavyChain1
gaaguacaauuaguagaaagcggaggaggacuagugcaaccaggugggagccuaagauuaagcugugcagcaucgggauuuacuuuuucagauuauuggauguacuggguaagacaagcaccgggaaaaggguuagaauggguaagcgaaauaaacacgaauggauuaauaacgaaauauccagauagugugaaaggaagguuuacaauaaguagagauaaugcaaaaaacacauuauaucuccaaaugaauaguuuaagaccagaagauacagcaguauauuacugugcaagaaguccgaguggauuuaauagaggacaagggacauuaguaacaguaaguaguggaggaggaggaucgggaggaggaucagaaguacaauuaguagaaucaggaggaggauuaguacaaccgggaaauucauuaagacuaaguugugcggcuucaggguuuacuuuuucaaguuucggaaugaguuggguaagacaagcaccgggaaaaggauuagaauggguaaguaguauaaguggaucaggaucagauacguuauaugcagauagugugaaagguagauuuacgauaagucgagauaacgccaaaacaacacuauaucuacaaaugaauaguuuaagaccugaagacacagcuguguauuacuguacgauaggaggaagcuuaagucgcucaucacaaggaacauuaguaacaguaaguaguggagguggaggaagcggaggaggaucagaaguacaauuaguagaaucaggaggaggguugguacaaccuggaggaaguuuaagacuaagcugugcagcaaguggauuuacauuuagugacuauuggauguauuggguacgacaagcgccaggaaaaggauuagaauggguaagugaaauaaauacaaaugguuuaauaacaaaauauccagauagcguaaagggaagauuuacaauaaguagagauaaugcaaaaaauacuuuauauuuacaaaugaacagcuuaagaccagaagauacagcaguauauuauugugcaagaaguccaucaggauuuaauagaggacaagggacauuaguaacaguuaguuca

SEQ ID NO: 46507 - RNA, 1350 nt, Artificial Sequence
  derived and/or modified sequence opt6 from Palivizumab_HeavyChain
caaguaacccuaagagaaucaggaccagcauuaguaaaaccuacccaaacauuaacacuaacaugcacuuuuucaggcuucucacucucaacaucaggaaugucaguaggauggauaagacaaccaccaggaaaagcuuuagaauggcuagcagacauauggugggacgauaaaaaagacuauaauccaucuuuaaaaucacgucuaacaauaagcaaagauacaucaaaaaaucaaguaguauuaaaagucacaaacauggauccagcagacacagcaacuuacuacugcgcacgaucaaugauaacaaauugguauuuugacguuuggggcgcaggaacaacaguaaccguaucaucugcaucaaccaaagguccuucaguauucccauuagcaccaucauccaaaaguacaucaggcggcacagccgcacuaggcugcuuaguaaaagacuacuuuccagaaccaguaacagucucuuggaacucuggagcauuaacaucaggcguacacacauucccugcaguacuccaaucaucaggacuauacucccuaagcucaguaguaacagucccaucaucaucacucggaacacaaaccuacauauguaacgucaaccauaaaccaucaaacacuaaaguugauaaaagaguugaaccaaaaucuugcgacaaaacacauacaugcccaccaugcccagcucccgaguuauuagguggacccucaguauuccucuucccaccaaaacccaaagauacacuaaugauaucaagaacaccagaaguaacaugcguaguugucgacgucucacacgaagauccagaaguaaaauuuaacugguacguagacggaguagaaguacauaacgcaaaaacuaaaccaagagaagaacaauacaacagcacauauagaguaguaucaguacuaacaguacuacaccaagacuggcuaaacggaaaagaauauaaauguaaaguaucaaacaaagcccuaccugcaccaauugaaaaaacaauauccaaagcaaaaggacaaccaagagaaccacaaguauacacacuaccaccaucuagagaagaaaugacaaaaaaucaaguaucacucacuugccuaguaaaagguuucuacccaucagacauagcaguagaaugggaauccaacggccaacccgaaaacaauuauaaaacaacuccacccguacuagacucagauggaucuuuuuuccuuuacucaaaacuaacaguagauaaaucacgauggcaacaaggaaauguauuuucaugcucaguaaugcacgaagcacuccauaaucacuacacacaaaaaucacuaucauuaucuccaggaaaa

SEQ ID NO: 46508 - RNA, 639 nt, Artificial Sequence
  derived and/or modified sequence opt6 from Palivizumab_LightChain
gacauacaaaugacacaaucaccaucaacacuaucagcaucaguaggagacagaguaacaauaacaugcaaaugccaauuaucagucggauauaugcacugguaccaacaaaaaccuggaaaagcaccaaaauuacuaauauacgacaccaguaaacuagcaagcggaguaccaagcagauucucaggaucaggaucaggaacagaauucacacuaacaauaucaucacuacaaccagacgacuucgcaacauauuacugcuuccaaggaucaggauacccauucacauucggagguggaacaaaacucgaaauaaaaagaacaguagcagcaccaagcguauucauauuuccaccaucagacgaacaauuaaaaucaggaacagcaucaguaguaugccuauuaaacaacuucuacccaagagaagcaaaaguacaauggaaaguagacaacgcacuacaauccggaaacucacaagaaucaguaacagaacaagacucaaaagacucaacauacucacuaucaucaacacuaacauuaagcaaagcagacuacgaaaaacauaaaguauacgcaugcgaaguaacacaccaaggauuaucaucaccaguaacaaaaagcuucaacagaggagaaugu

SEQ ID NO: 46509 - RNA, 360 nt, Artificial Sequence
  derived and/or modified sequence opt6 from Palivizumab_VH-Region
caaguaacauuaagagaaaguggaccagcacuaguaaaaccaacacaaacauuaacauuaacauguacauuuagcggauucucacuaucaacaucaggaaugagcguaggauggauaagacaaccaccaggaaaagcacuagaaugguuagcagauauauggugggaugacaaaaaagauuacaauccaucacuaaaaaguagauuaacaauaucaaaagauacaucaaaaaaucaaguaguauuaaaaguaacaaauauggauccagcagacacagcaacauacuauugcgcaagaucaaugauaacaaauugguauuucgauguauggggagcaggaacaacaguaacaguaagcuca

SEQ ID NO: 46510 - RNA, 1347 nt, Artificial Sequence
  derived and/or modified sequence opt6 from Pamrevlumab_HeavyChain1
gaaggacaacuaguacaaagcggaggaggacuaguacauccagguggaagcuuaagauuaucuugugcaggaagcggauuuacuuuuuccaguuauggaaugcauuggguaagacaagcaccaggaaaaggccuagaauggguaaguggaauagguaccggaggaggaacauauucaacagauuccguaaaaggacgguuuacaauaaguagagauaaugcaaaaaauaguuuauacuuacaaaugaacucuuuaagagccgaagauauggcuguauauuacugcgcaagaggugacuauuauggaucaggaucauucuucgauuguuggggacaaggaacauuaguaacagucucauccgcaucuacuaaaggaccaucaguauucccauuagcaccuucaucuaaaucaacaaguggaggaacagcagcccuaggaugccuaguaaaagauuacuuuccagaaccagucacaguaucauggaacucuggagcccuaacaucaggaguacauacauucccagcaguacuacaaagcucaggucuauauucauuaucaucaguaguaacagucccuucaucaagcuuagguacacaaacauauauuugcaauguuaaucauaaaccaagcaacacaaaagucgacaaaagaguagaaccaaaaucuugugauaaaacacacacauguccucccuguccagcuccagaacuauuaggaggaccaucaguauuuuuauuuccaccaaaaccuaaagacacacuaaugauauccagaacuccagaaguaacauguguaguaguagauguuucacacgaagauccagaaguaaaauuuaacugguacguagauggaguagaaguccauaaugcaaaaacaaaaccaagagaggaacaauauaacucaacuuauagaguaguaucaguacuuacuguauuacaccaagacugguuaaauggaaaagaauauaaauguaaaguaucaaacaaagcauuaccagcaccuaucgaaaaaacaaucucaaaagcaaaaggacaaccaagagaaccccaaguauauacauuaccaccaucuagagaagaaaugacaaaaaaucaaguaucacuaacauguuuagucaaagguuucuacccaucagacauagcuguagaaugggaaagcaacggucaaccagaaaacaacuacaaaacuacaccuccaguacuagauagcgauggaucuuuuuuuuuauacagcaaauuaacuguagacaaaucaagauggcaacaaggaaauguauuuucauguaguguaaugcaugaagcacuacacaaccauuauacacaaaaaagcuuaucucuuucaccagga

SEQ ID NO: 46511 - RNA, 642 nt, Artificial Sequence
  derived and/or modified sequence opt6 from Pamrevlumab_LightChain1
gacauacaaaugacacaaucacccucaucccucucagcaucaguaggagacagaguaacaauaaccugccgagcaucacaaggaauaucaucauggcuagcaugguaccaacaaaaaccagaaaaagcaccaaaaucauuaauauacgccgcaucaucacuacaauccggaguaccauccagauucucaggaucaggaucaggaacagacuucacauuaacaauaucaucacuacaaccagaagacuucgccacauacuacugccaacaauacaacucauaccccccaacauucggacaaggaacaaaauuagaaauaaaaagaacaguagccgcaccaucaguauucauauucccaccaucagacgaacaauuaaaaucaggaaccgcaucuguaguaugccuacuaaacaacuucuauccaagagaagcuaaaguacaauggaaaguagacaacgcacuacaaucaggaaacucacaagaaucaguaacagaacaagacuccaaagacucaacauacucauuaucaucaacacuaacccuaucaaaagcagacuacgaaaaacacaaaguauacgcaugcgaaguaacacaccaaggacuaagcucaccaguaacaaaaucauuuaacagaggagaaugu

SEQ ID NO: 46512 - RNA, 1305 nt, Artificial Sequence
  derived and/or modified sequence opt6 from Panitumumab_HeavyChain1
caaguacaacuacaagaaucaggaccuggacuaguuaaaccaucagaaacucuaucacuaacuugcacaguauccggaggaucaguaagcucaggagacuauuacuggacauggauaagacaauccccaggaaaaggauuagaauggauaggccacauauauuacuccggaaauacaaauuacaacccaucacuuaaaucaagacucacaauaucaaucgauacaucaaaaacccaauucucuuuaaaacuaucauccguaacagcagcagauaccgcaauauacuacugcguaagagacagagucacaggagcauucgacaucuggggacaaggaacaaugguaacagucucauccgcgucaacaaaaggcccaucaguauuuccauuagcaccaugcucuagaagcacaucagaaaguacagcagcacuagguugcuuaguaaaagauuacuuuccagaaccagucacaguaucauggaacucaggagcccuaacaucaggaguacauaccuucccagcuguauuacaaucauccggauuauacucccuaucaucaguaguuacaguuccaucaucaaacuucggaacccaaacguauacaugcaauguagaccacaaaccuucaaacacaaaaguagacgaaagaaaaugcuguguagaaugcccagcagguccaucaguauuccuauucccaccuaaaccuaaagauacacuaaugauauccagaaccccagaagucacaugcguaguaguagacguaucucacgaagaucccgaaguccaauuuaacugguacguagauggcguagaaguacacaaugcaaaaacaaaacccagagaagaacaauucaauucaacauucagaguaguaucuguacuuacaguaguacaucaagacuggcuaaaugguaaagaauauaaauguaaaguaucaaauaaaggauuacccgcaccaauugaaaaaacaauaagcaaaacaaaaggacagccaagagaaccucaaguauauacauuaccuccauccagagaagaaaugacaaaaaaucaaguuuccuuaacaugccuaguaaaaggauucuauccaucagacauagcaguugaaugggaaucaaauggacaaccagaaaauaauuacaaaacaacaccacccaugcuagauucagauggcucauucuuccucuauucaaaacucacaguagacaaaucacgauggcaacaaggaaacgucuuuucuuguaguguaaugcaugaagcauuacacaaccacuauacccaaaaaaguuuaucauuaucuccaggaaaa

SEQ ID NO: 46513 - RNA, 642 nt, Artificial Sequence
  derived and/or modified sequence opt6 from Panitumumab_LightChain1
gacauacaaaugacacaaucaccaucaucacuaucagcaucaguaggagaccgaguaacaauaaccugccaagcaucacaagacauaagcaauuaccuaaacugguaccaacaaaaaccaggaaaagcaccaaaacuacuaauauacgacgcaucaaaccuagaaacaggaguaccaucaagauucucaggaucaggaucaggaacagacuucacauuuacaauaucaucauuacaaccagaagacauagcaacauacuucugccaacacuucgaccaucuaccacuagcauucggaggaggaacaaaaguagaaauaaaacgaacagucgcagcaccaagcguauucauauucccaccaucagacgaacaacuaaaaucaggcacagcaucaguaguaugcuuauuaaacaacuucuauccacgagaagcaaaaguccaauggaaaguagacaaugcacuacaaucaggaaacucacaagaaagcguaacagaacaagacagcaaagacucaacauauagccuaucaucaacccuaacauuauccaaagcagacuacgaaaaacacaaaguauacgcaugcgaaguaacacaccaaggacuaucuucaccaguaacaaaaucauucaacagaggagaaugc

SEQ ID NO: 46514 - RNA, 1326 nt, Artificial Sequence
  derived and/or modified sequence opt6 from Pankoab_HeavyChain1
gaaguacaacucgucgaaucagguggaggcuuaguacaaccaggaggaucaagauuaucauguguagcauccggauuuccauuuucaaacuacuggaauuggguaagacaagcaccaggaaaaggauuagaauggguaggagaaauaagacuaaaaucaaacaacuacacaacacacuacgcagaauccguaaaagguagauucacaauaagccgagacgacucaaaaaacucuuuauaccuucaaaacucauuaaaaacagaagauacagcaguauauuauuguacaagacauuacuacuuugauuauuggggacaaggcacauuaguaacaguaucaucggcaucaacaaaagguccuucaguauuucccuuagcaccaucauccaaaagcacaucagguggaacugcagccuuaggcugccuaguaaaagauuacuucccagaacccguaacaguauccuggaauucuggugcccuaacauccggaguacacacuuuuccagcaguauuacaguccucaggacuuuacucacuaagcucaguaguaacagucccaucauccucauuaggcacacaaacauacauaugcaauguaaaccacaaaccaucuaacaccaaagucgauaaaaaaguagaaccgaaauccugcgacaaaacacauacaugcccaccaugcccagcaccagaacuacuaggaggaccaucaguauuucuauucccaccaaaaccaaaagacaccuuaauaucacgaacuccagaagucacauguguuguaguagacguaucacaugaagacccugaagucaaauucaacugguacgucgacggaguagaaguccacaaugcaaaaacaaaaccaagagaagaacaauacaacucuacauaccgaguaguaucaguucuaacaguauuacaccaagacuggcuuaauggaaaagaauauaaauguaaaguaucaaacaaagcauuaccagcaccaauagaaaaaacaauaucaaaagccaaaggacaaccaagagaaccccaaguuuacacacuaccaccaucacgagaugaacuaacaaaaaaccaaguaucacuaacaugucuaguaaaaggcuucuauccauccgacauagcuguagaaugggaaucaaacggacaaccagaaaacaacuacaaaacgacacccccgguacuugacucagacgguucauucuuucuauacucuaaauuaacaguagacaaaucaagauggcaacaaggaaauguauucuccugcucuguacacgaaggacuacauaaccacuacacacaaaaaagcuuaucacuaucaccaggaaag

SEQ ID NO: 46515 - RNA, 651 nt, Artificial Sequence
  derived and/or modified sequence opt6 from Pankoab_LightChain1
gauauaguaacacaaucaccacuaucaaaccccguaacaccaggagaaccagcaucaauauccugccgaucaucaaaaucccuacuucacuccaacggaauaaccuacuucuucugguaccuacaaaaaccaggacaaucaccacaauuauuaauauaccaauccaaccucgcaucaggaguaccagacagauucucaggaucaggaucaggaacagacuucacccuacgaauuucaagaguagaagcagaagacguaggaguauacuacugcgcacaaaaccuagaauuaccaccaacauucggacaaggaacaaaaguagaaauaaaacgcacaguagcagcaccaucuguauucauauucccaccaucagacgaacaacuaaaaucaggaacagcaucagucguaugccuacuaaacaacuucuacccaagagaagccaaaguucaauggaaagucgacaacgcacuacaauccggaaacucacaagaauccguaaccgaacaagacuccaaagacucaacauacucauuaucaucaacacuaacacuaucaaaagccgacuacgaaaaacacaaaguauacgcaugcgaaguaacacaccaaggauuauccucaccaguaacaaaaucauuuaacagaggagaaugc

SEQ ID NO: 46516 - RNA, 651 nt, Artificial Sequence
  derived and/or modified sequence opt6 from Pankoab_LightChain2
gacauaguaacacaaucaccauuaucaaacccaguaacacccggagaaccagcaucaauaagcugccgaucaucaaaaucacuacuacacucaaacggcauaacauacuucuucugguaccuacaaaaaccaggacaauccccacaacuacuaauauaccaaucaaacuuagcaucaggaguaccagacagauucucaggaucaggaucaggaaccgacuucacauuacggauaagcagaguagaagcagaagauguaggaguauacuacugcgcaggaaaccuagaacuaccaccaaccuucggacaaggaacaaaaguagaaauaaaaagaacaguagcagcaccaucaguauucauauuuccgccaucagaugaacaacuaaaaucaggaacagcauccguaguaugcuuacuaaacaacuuuuacccaagagaagcaaaaguacaauggaaaguagacaacgccuuacaaagcggcaacucacaagaaucaguaacagaacaagacucaaaagacucaacauacucacuaucaucaacacuaacacuaucaaaagcagacuacgaaaaacacaaaguauacgcaugcgaaguaacacaccaaggccuaucaucaccaguaacaaaaucauucaacagaggagaaugu

SEQ ID NO: 46517 - RNA, 351 nt, Artificial Sequence
  derived and/or modified sequence opt6 from PankoMab_HeavyChain_VDJ-Region
gaaguaaaacuaguagaaucaggaggaggauuaguacaaccaggaggaucaaugaaacuaucaugcguagcaucaggauuuacauucagcaauuacuggaugaacuggguaagacaaagcccagaaaaaggauuagaauggguagcagaaauaagacuaaaaucaaacaauuacacaacacauuacgcagaaucaguaaaaggaagauucacaauaucaagagacgacucaaaaucaagcguaagccuacaaaugaacaaucuaagaguagaagacacaggaauauacuacugcacaagacauuacuauuucgacuacuggggacaaggaacaacauuaacaguaagcuca

SEQ ID NO: 46518 - RNA, 339 nt, Artificial Sequence
  derived and/or modified sequence opt6 from PankoMab_LightChain_VJ-Region
gacauaguaaugacacaagcagcauucucaaacccaguaacacuaggaacaucagcaucaauaucaugcagaucaucaaaaucacuacuacacucaaacggaauaacauacuucuucugguaccuacaaaaaccaggacuaucaccacaacuacuaauauaccaaaugucaaaccuagcaucaggaguaccagaccgauucucaagcucaggaucaggaacagacuucacacuaagaauaucaagaguagaagcagaagacguaggaguauacuacugcgcacaaaaccuagaacuaccaccaacauucggaggaggaacaaaacuagaaauaaaaaga

SEQ ID NO: 46519 - RNA, 1707 nt, Artificial Sequence
  derived and/or modified sequence opt6 from Panobacumab_HeavyChain1
gaagaacaaguaguugaaucugguggaggcuuuguacaaccuggaggaagucuucguuuaucaugcgcagcaucaggcuuuacuuuuaguccauacuggaugcauuggguaagacaagcaccaggaaaaggacucguuuggguaucucgaauuaauucagauggaucgacuuauuaugcagauucaguaaaaggaagauuuacaauaucacgggauaaugcacgaaacacccuauaucuacagaugaauucauuacgcgcugaagauaccgcaguuuauuauugugcuagagauagauauuacgguccagaaauguggggccaaggaacaaugguaacagucucuucaggaagugcaucugcaccaacacuauuuccauuaguauccugugaaaauucaccaucagacacauccaguguugcaguaggcugcuuagcacaagacuuucuaccagauucaauaaccuucucauggaaauacaaaaacaacucagauauaucauccacaagaggcuuccccagcguacuaagaggcggaaaauacgcagcaaccucacaaguucuauuaccaucaaaagacguaaugcaagguacagacgaacauguaguaugcaaaguacaacauccaaauggaaacaaagaaaaaaacguaccauuaccuguaauagcagaacucccaccaaaaguaagcguauuuguuccaccuagagauggauuuuuuggaaauccaagaaaauccaaacuaauaugccaagcaacaggauucucacccagacaaauccaaguaucuugguuaagagaaggaaaacaaguaggaucaggaguuacaacagaucaaguacaagccgaagcaaaagaaucagguccuacaaccuacaaaguaacaucaaccuuaacaauaaaagaaagugauuggcuuucacaaucaauguucacauguagaguagaucaucgaggucuaacauuccaacaaaaugcaucuagcaugugcguaccugaucaagauacagcuauaagaguauuugcuauaccaccaucauuugcaagcauuuuccucacaaagucuacaaaacugacuugucuuguaaccgaucucacuacuuaugauuccguaacuaucucauggacaagacaaaauggagaagcaguaaaaacacauacuaauauauccgaaucacauccaaaugcaacauucagugcaguuggugaagcaagcaucugcgaagaugacuggaauucaggagaaagauuuacauguacaguuacacauaccgaucuaccauccccacuuaaacaaaccauaucaagaccaaaaggagucgcccuacaucgaccagauguguauuuauuaccuccagcaagagaacaauuaaacuuaagagaauccgcaacaaucacaugucuaguaacagguuuuuccccagcugauguuuuuguacaauggaugcaacgaggucaaccacuaucaccagaaaaauauguuacaagcgcaccaaugccagaaccucaagcaccaggcagauacuucgcucauucaauacuaacgguuucugaagaagaauggaauacaggagaaacuuacacauguguaguagcacacgaagcacuaccaaacagaguaacugaaagaacaguagauaaaagcacaggcaaaccaacauuauauaacguaucauuaguuaugucugauacagcaggcacuuguuau

SEQ ID NO: 46520 - RNA, 657 nt, Artificial Sequence
  derived and/or modified sequence opt6 from Panobacumab_LightChain1
gacguaguaaugacacaaucaccacuaucacuaccagucacauuaggacaaccagcaucaauaucaugcagaucaucacaaucacuagucuacucagauggaaacacauaccuaaacugguuccaacaaagaccaggacaaucaccaagaagacuaauauacaaaguaucaaacagagacucaggaguaccagacagauuuucuggaucaggaucaggaacagacuucacacuaaaaauaagccgagucgaagcagaagacguaggcguauacuacugcaugcaaggaacccacuggccacuaacauucggaggaggaaccaaaguagaaauaaaaagaacaguagcagcaccaucaguauucauauuccccccaucagacgaacaacuaaaaucaggcacagccucagucguaugccuacuaaacaacuuuuacccaagagaagcaaaaguacaauggaaaguagacaacgcauuacaaagcggaaacucacaagaaucaguaacagaacaagacucaaaagacagcacauacucacuaucaucaacauuaacuuuaagcaaagcagacuaugaaaaacauaaaguauacgcaugcgaaguaacccaccaaggacucucaucaccaguaacaaaaucauucaacagaggagaaugu

SEQ ID NO: 46521 - RNA, 414 nt, Artificial Sequence
  derived and/or modified sequence opt6 from Panobacumab_LightChain2
ggagaugacgaagcaacaauauuagcagauaacaaaugcaugugcacaagaguaacaucaagaauaauaccaagcacagaagauccaaaugaagauauaguagaaagaaacauaagaauaguaguaccauuaaacaauagagaaaacauaagcgauccaacaagcccacuaagaagaaauuucguauaccaucuaucagacguaugcaaaaaaugugacccaguagaaguagaacuagaagaccaaguaguaacagcaacacaaagcaauauauguaacgaagacgauggaguaccagaaacauguuacauguacgacagaaauaaauguuacacaacaaugguaccacuaagauaccauggagaaacaaaaaugguacaagcagcauuaacaccagacucaugcuauccagau

SEQ ID NO: 46522 - RNA, 1359 nt, Artificial Sequence
  derived and/or modified sequence opt6 from Parsatuzumab_HeavyChain1
gaaguacaacuagucgaaucuggaggcggucuaguacaaccaggaggcucccuacguuuauccugcgcagcaagugguuacacauuuauagacuacuauaugaauuggguaagacaagcucccggcaaaggacuagaauggguaggcgacauaaaccuagauaacaguggaacacacuacaaccaaaaguucaaaggacgcuucacaauauccagagauaaaucaaaaaacacagccuaucuacaaaugaacucacuacgagcagaagacacagcaguauacuacugcgcaagagaaggaguauaccaugacuacgacgacuacgcaauggacuacuggggacaaggaacauuaguuacagucucuagcgcaagcacaaaagguccaucaguauucccacucgcuccauccucaaaaucaacaucaggaggcaccgcagcacuaggaugccuaguaaaagacuacuucccagaaccaguaacaguuucauggaacucaggagcacuaacaucuggaguacauacauuuccagccguauuacaaucaagugguuuauacucacuaucaucaguaguaacaguaccuagcucaucacucggaacucaaacuuauauauguaacguaaaccacaaaccaucaaauacaaaaguagacaaaaaaguagaaccaaaaucaugcgacaaaacacauacaugcccuccauguccagcacccgaacucuuaggaggaccuucagucuuccuauucccacccaaaccaaaagauaccuuaaugauaucacgaaccccugaaguaacaugcguuguuguagauguaucacacgaagacccagaaguuaaauucaauugguauguugacggaguagaaguccacaacgcuaaaacuaaaccaagagaagaacaauacaauucaacauacagaguuguaucaguacuaaccguauuacaccaagauuggcuaaauggaaaagaauauaaauguaaaguuagcaauaaagccuuaccagcaccaauagaaaaaacaauaucaaaagccaaaggucaaccucgcgaaccacaaguauacacauuaccacccagccgugaagaaaugacaaaaaaucaagucuccuuaaccugccucguaaaaggauuuuacccaucagauauagcaguagaaugggaaucuaacggucaaccagaaaauaacuacaaaacaacaccaccaguauuagacucugauggaucuuucuucuuauacucaaaauugacaguagacaaaucaagauggcaacaaggaaacgucuuuucaugcaguguaaugcacgaagcauuacauaaucauuacacacaaaaaucacuaucacuuucaccugguaaa

SEQ ID NO: 46523 - RNA, 657 nt, Artificial Sequence
  derived and/or modified sequence opt6 from Parsatuzumab_LightChain1
gauauacaaaugacacaaucaccaucaucacuaucagcaucaguaggagacagaguaacaauaacaugcagaaccucacaaucccuaguacacaucaacgcaauaacauaccuacacugguaccaacaaaaaccaggaaaagcaccaaaacuauuaauauauagaguaucaaacagauucucaggaguaccaucacgauucucuggaucaggaucaggaacagacuucacacuaacaauauccucacuacaacccgaagacuucgcaacauacuacugcggacaaucaacacacguaccacuaacauucggacaaggaacaaaaguugaaauaaaacgaacaguagcagcaccaucaguauucauauucccaccaucagacgaacaacuaaaaucaggaacagcaucaguaguaugucuacuaaacaacuucuaccccagagaagccaaaguccaauggaaaguagacaacgcacuacaaucaggaaacucacaagaaucaguaacagaacaagacucaaaagacucuacauauagcuuaucaucaacccuaacacuaucaaaagcagauuacgaaaaacacaaaguauacgcaugugaaguaacacaccaaggauuaucaucaccaguaacaaaaucauucaauagaggcgaaugc

SEQ ID NO: 46524 - RNA, 1353 nt, Artificial Sequence
  derived and/or modified sequence opt6 from Pascolizumab_HeavyChain1
cagguaacauuaagagaaucaggaccagcuuuaguuaaaccaacccaaacacuaacauuaaccuguacauuuucuggauuuucacuaucaacaucaggaaugggaguaucauggauuagacaaccaccaggcaaaggacuagaauggcuagcacacauauacugggaugacgacaaacgauauaacccaucauuaaaaucacgacuaacaaucucaaaagacacaucacgcaaccaagucguccuaacaaugacaaacauggacccaguagacacagcuacuuacuacugcgccagacgagaaacaguauucuauugguacuuugacguauggggaagaggaacuccuguaacaguaucaucagccucaacaaaaggcccaaguguauuuccucuagccccaucaucaaaaucaacaucuggaggcacugcagcacuaggaugccucgucaaagauuacuucccagaaccagucacaguaucuuggaauagcggagcacucacaucaggcguacacacuuucccagcaguacuccaaucaucagguuuguacucauuauccagcguaguaacaguacccuccucaucacuuggaacacaaaccuacauauguaacguaaaccacaaaccauccaacaccaaaguagauaaaagaguagaaccuaaaucaugcgauaaaacacacacaugcccaccauguccagccccagaacucuuaggaggacccucaguauucuuauuuccaccaaaaccaaaagauacacuuaugaucucacgaaccccugaagucaccuguguagucgucgacguaucacaugaagauccagaaguaaaauucaacugguacguagacggaguagaaguacauaacgcaaaaacaaaaccaagagaagaacaauacaacucaacauacagaguaguaucaguacuaacaguacuccaccaagacugguuaaacgguaaagaauacaaauguaaaguaucaaacaaagcccuaccagcuccaauagaaaaaaccaucucaaaagcuaaaggacaacccagagaaccacaaguauacacacuaccaccauccagagaagaaaugacaaaaaaucaaguaucauuaacaugucuaguuaaagguuucuacccaucagauauagccguagaaugggaaucaaacggacaaccagaaaacaauuauaaaacaacaccaccuguauuagacucagacggaaguuucuuccuauacucaaaacucaccguagacaaaucaagauggcaacaaggaaacgucuuuucuuguucaguaaugcacgaagcacuacacaaccacuacacucaaaaaucauuaucacuuucaccuggaaaa

SEQ ID NO: 46525 - RNA, 654 nt, Artificial Sequence
  derived and/or modified sequence opt6 from Pascolizumab_LightChain1
gacauagucuuaacacaaucaccauccagccuauccgcaucaguaggagacagaguaacaauaacauguaaagcaucacaaucaguagacuacgacggagacucauacaugaacugguaccaacaaaaacccggaaaagcaccaaaauuacuaauauacgccgcaucaaauuuagaaucaggaauaccauccagauucucaggaucaggaucaggaacagauuucacauucacaauaucaucacuacaacccgaagacauagcaacauacuacugccaacaaucaaacgaagacccaccaacauucggacaaggaacaaaaguagaaauaaaaagaacagucgcagcaccaucaguauucauauucccaccaucagacgaacaacuaaaaucaggcacagcaucagucguaugcuuacuaaacaacuucuacccaagagaagcaaaaguccaauggaaaguagacaacgcacuacaaucaggaaacucacaagaaucaguaacagaacaagacagcaaagacucaacauacucacuaucaucaacacuaacacucuccaaagccgacuacgaaaaacacaaaguauacgcaugcgaaguaacacaccaaggacuaagcucacccguaacaaaaucauuuaaucgaggagaaugc

SEQ ID NO: 46526 - RNA, 1512 nt, Artificial Sequence
  derived and/or modified sequence opt6 from Pasotuxizumab_HeavyChain1
caaguacaauuaguagaaaguggcgggggauuaguaaaacccggagaaucauuaagauuaucaugugcagcuucaggauucacauuuagugauuauuauauguacuggguacgacaagcaccgggaaaaggacuagaauggguagcaauuauaucugauggaggauauuauacauacuauagugauauaauuaaaggaagauuuacuauaucgagggacaaugcaaaaaacucauuauaccuacaaaugaacucacuuaaagcagaagacacagcaguauauuauugugcaagaggauuuccuuuauuacgacauggcgcaauggacuauuggggacaaggaacauuaguaacgguaaguucaggaggagguggaucaggagggggcggaucaggaggaggaggaucagauauacaaaugacacaaucaccaucaaguuuaucagcaucaguaggagacagaguaacuauaacauguaaagcaucacaaaauguagacacaaauguagcaugguaccagcaaaaaccaggucaagcaccaaaaucauuaauauauucagcaaguuauagauacagcgauguaccaagcagauucucaggaucagcaucaggaacugacuucacccuaacaauaucaucaguacaaagugaagauuuugccacuuauuauugucaacaauaugauucauauccauauacauuuggaggaggaacaaaauuagaaauuaaaucaggagggggagggucggaaguucaauuaguagaaaguggcggggguuuagugcaaccaggcggaaguuugaaacuuagcugcgcagcaaguggauuuacauuuaauaaauacgcaaugaauuggguaagacaagcaccaggaaaaggauuagaaugggucgcgagaauaagaaguaaauauaacaauuaugccacauauuaugcggacucaguaaaggauagauuuacaauaucaagggaugacucaaaaaacacagcuuauuuacagaugaauaauuuaaaaacagaagacacagcuguauacuauugcguaagacacggaaacuuuggaaauucauacauaaguuauugggcauacuggggacaagggacucuaguuacaguuagcaguggagggggagguaguggaggaggagguagcggaggggguggaucacaaacaguaguaacucaagaaccaaguuuaacaguaaguccaggcggaacagugacauuaacauguggaucaaguacaggagcuguaacgucaggaaauuauccuaauuggguacaacaaaaaccaggucaagcaccaagaggccuuauaggaggaacaaaauuuuuagcaccaggaacaccagcuagauuuucaggaagcuuacuaggaggaaaagcagcacuuacacuaucaggaguacaaccagaagaugaagcagaauauuauuguguacucugguauaguaacagauggguauuuggagguggaacaaaauuaacaguguuacaccaucaucaucaucau

SEQ ID NO: 46527 - RNA, 1512 nt, Artificial Sequence
  derived and/or modified sequence opt6 from Pasotuxizumab_SingleChain
caaguacaacuagugcaaucaggaggagguuugguaaaaccaggagaaagucuacgguuaucaugugcggcuucaggauuuacauuuagcgauuacuauauguacuggguaagacaagcaccaggaaaaggguuagaauggguagcaaucauaagugauggaggauauuauacuuauuacucagauauaauuaaagguagauuuacaauaucaagggauaaugcuaaaaauaguuuauaucuucaaaugaauaguuuaaaagcagaagauacagcaguauacuauugugcaagaggauuuccauuacuaagacauggagcaauggauuauuggggacaaggaacauuaguuacuguaaguucaggaggaggugguagcggaggaggagguucaggcgggggagguagugacauacaaaugacacagucaccauccaguuuaucagcuuccguaggagauagaguaacaauaacauguaaagcuucucaaaaugucgauacaaauguagcuugguaucaacaaaaaccagggcaagcaccaaaaaguuuaauauacagugcuaguuacagauauagugauguaccaucaagauuuucugggagugcaucagggacagauuuuacucuaacaauaucuucaguacaaagugaagacuuugcaacauacuauugucaacaauaugauaguuauccauauacauuugggggaggaacgaaauuagaaauaaaaaguggaggagggggcucagaaguacaauuaguagaaagcggagguggacuaguacaaccagguggaagcuuaaaguuaagcugcgcagcaaguggauuuaccuuuaauaaauaugcuaugaacuggguaagacaagcaccaggaaaaggauuagaauggguagcaagaauaagaaguaaauauaauaacuaugcuacauauuaugcagacaguguaaaagaucgauuuacaauuuccagagaugauaguaaaaauacagcauauuuacaaaugaauaauuuaaaaacagaggauacagcaguauacuacugcguuagacauggaaauuuuggaaacagcuauauauccuauugggcauauugggggcaagggacauuaguaacaguaucaagugguggaggaggaaguggagguggaggaaguggaggagguggaucacaaacagugguuacacaagaaccaagcuuaacaguaaguccaggaggaacaguaacuuuaacauguggaaguagcacuggagcaguaacuaguggaaauuauccaaauuggguacaacagaaaccaggacaagcaccaagaggacuaauaggaggaacaaaguuuuuagcuccaggaacgccggcaagauucucaggaucauuacuaggaggaaaagcagcacuaacuuuaaguggaguacaaccagaagaugaagcugaauauuauuguguauuaugguauagcaaucgauggguauuuggaggaggaacaaaauuaacaguauuacaucaucaucaucaucau

SEQ ID NO: 46528 - RNA, 1341 nt, Artificial Sequence
  derived and/or modified sequence opt6 from Pateclizumab_HeavyChain1
gaaguacaacuaguagaaucaggcggcggucucguacaacccggagguucccuaagacuaucaugcgcagcaucuggauacacuuucacaucauacguuauacacuggguaagacaagcaccaggaaaaggacuagaauggguaggauacaauaacccauauaacgcaggaaccaacuacaacgaaaaauucaaaggaagauucacaauauccagugacaaauccaaaaauacagcauacuuacaaaugaacucccuacgagcagaagauacagccguauacuacuguucaagaccaacaaugcuaccgugguucgcauacuggggacaaggaaccuuaguaacaguuucaucugcaucaacaaaagguccaucaguauuuccacucgcgccaucaucuaaaucaacaucaggaggaacagcagcucuaggcugucuagucaaagacuacuucccagaaccaguuaccguaaguuggaacucaggagccuuaacuucaggaguacacacauucccugcaguacuacaaucauccggacucuauucccuaucauccgucguaacaguccccucauccucacuaggaacacaaacuuacauaugcaacguuaaccauaaaccauccaauacaaaaguagauaaaaaaguagaaccaaaauccugcgacaaaacacacaccugcccaccauguccagccccagaauuauuaggagggccaucaguauuccuauucccaccaaaaccaaaagacaccuuaaugauaucuagaacaccagaaguaacauguguaguaguagacguaucacaugaagauccagaaguuaaauuuaacugguauguagaugggguagaaguacacaacgcaaaaacaaaaccaagagaagaacaauauaacucaacauacagaguugucucaguccuaacaguucuacaccaagauuggcuaaacgguaaagaguauaaaugcaaaguaucaaacaaagcauuaccugcacccauagaaaaaacaauaucaaaagcaaaaggacaaccccgagaaccucaaguauacacacuaccaccauccagagaagaaaugacaaaaaaccaaguuucacucacaugcuuagucaaaggcuuuuacccaucagacauagcaguagaaugggaaucaaacggacaaccagaaaacaauuacaaaacaacaccaccagucuuagacagugacggauccuuuuuucuauauucaaaacuaaccgucgauaaauccagauggcaacaagggaacguauuuucaugcuccguaaugcacgaagcacuacacaaccacuauacacaaaaaucucuaucacuaucaccagga

SEQ ID NO: 46529 - RNA, 642 nt, Artificial Sequence
  derived and/or modified sequence opt6 from Pateclizumab_LightChain1
gacauacaaaugacacaaucaccaucaucacuaucagcaucaguaggagacagaguaacaauaacaugcagagcaagccaagcaguaucaucagcaguagcaugguaccaacaaaaacccggaaaagcaccaaaauuacuaauauacagcgcaucacacagauauacaggaguaccaucaagauucucaggaucaggcucaggaacagacuuuacacuaacaauaucaucacuacaaccagaagacuucgcaacauacuacugccaagaaucauacucaacacccuggacauucggacaaggaaccaaaguagaaauaaaaagaacaguagcugcaccaucagucuuuauauucccaccaucagacgaacaauuaaaaucaggaacagcaucaguaguaugcuuacuaaacaacuuuuacccaagagaagccaaaguacaauggaaaguagauaacgcacuacaaucaggaaauucacaagaaucaguaacagaacaagacucaaaagauucaacauacucauuaucaucaacacuaacccuaagcaaagcagauuacgaaaaacacaaaguauacgcaugcgaaguaacacaccaaggacuaucaucaccaguaacuaaaucauucaacagaggagaaugc

SEQ ID NO: 46530 - RNA, 1341 nt, Artificial Sequence
  derived and/or modified sequence opt6 from Patritumab_HeavyChain1
caaguacaacuacaacaauggggcgcaggauuauuaaaaccaucggaaacacuuucuuugacuugugcaguauauggaggcucauucucuggauacuauuggucuuggauacgacaaccaccaggaaaagguuuagaauggauaggagaaauaaaccauucaggaucaacaaauuauaacccaucccucaaaucaagaguaacaauaucagucgaaaccucaaaaaaccaauuuagcuuaaaauugucaucaguuacagcagcagacacagcaguauacuacugcgccagagacaaauggacaugguauuuugauuuauggggaagaggaacacucguaacaguaucaucagccucaacaaaaggaccaucuguauucccucuagcaccaucaagcaaauccacaucuggaggaacagcagcauuagggugucucguaaaagacuauuuuccagaaccaguaacaguaucuuggaacucaggagcacuaaccucaggaguccacacauucccagcaguccuacaaucauccggacuuuacucacuauccucaguaguaacaguaccauccucaaguuuaggcacacaaacauauauaugcaacgucaaucauaaaccaucaaauaccaaaguagauaaacguguagaaccaaaaucaugugauaaaacccacacauguccuccaugccccgcaccagaacuauuaggagguccaucaguauuccuguuuccacccaaaccaaaagacacauuaaugauaucgagaacacccgaaguuacaugcguuguaguagacguaucacacgaagacccagaaguaaaauuuaauugguacguagacggaguagaaguccacaacgccaaaacaaaaccaagagaagaacaauacaacuccacauaccgaguaguaucaguauuaacaguauuacaucaagacuggcuaaacggaaaagaauacaaaugcaaaguuucuaacaaagcacucccagccccaauagaaaaaaccaucucaaaagcaaaaggacaaccuagagaaccgcaagucuacacauuaccaccaucaagagaagagaugaccaaaaaccaaguaucauuaacaugccucguaaaaggauuuuacccauccgacauagcaguagaaugggaaucaaauggacaaccugaaaauaacuacaaaaccacaccaccaguccuagauagcgacggaucauucuuccuauacucaaaauuaacaguugacaaaucaagauggcaacaaggcaauguauucucaugcuccguaaugcaugaagcacuacacaaccacuacacacaaaaaucccuuuccuuaucaccaggaaaa

SEQ ID NO: 46531 - RNA, 681 nt, Artificial Sequence
  derived and/or modified sequence opt6 from Patritumab_hinge-CH2-CH3
gacaaaacacacacaugcccaccaugcccagcaccagaauuauuaggcggaccaucuguauuuuuauucccaccaaaaccaaaagacacauuaaugauaucaagaacaccagaaguaacaugcgucguaguagacguaucacacgaagauccagaaguaaaauucaacugguacguagacggcguagaaguacacaacgcaaaaacaaaaccaagagaagaacaauacaacucaacauacagaguaguaucaguacuaacaguacuacaccaagacugguuaaacggaaaagaauacaaaugcaaaguauccaauaaagcauuaccagcaccaauagaaaaaacaauaucaaaagcaaaaggacaacccagagaaccacaaguauacacacuaccaccaucaagagaagaaaugacaaaaaaccaaguaucauuauggugccuaguaaaaggauucuacccaucagacauagcaguagaaugggaaucaaacggacaaccagaaaacaacuacaaaaccaccccaccaguacuagacucagacggaucauuuuuccuauacuccaaacuaacaguagacaaauccagauggcaacaaggcaacguauucagcugcucaguaaugcacgaagcauuacacaaccacuacacacaaaaaucacuaucauuaucaccaggaaaa

SEQ ID NO: 46532 - RNA, 660 nt, Artificial Sequence
  derived and/or modified sequence opt6 from Patritumab_LightChain1
gauauagaaaugacacaaucaccagacucacuagcaguaucacuaggagaaagagcaacaauaaacugcagaucaucccaaucaguacuauacagcucaagcaacagaaacuacuuagcaugguaccaacaaaacccaggacaaccaccaaaacuacuaauauacugggcaucaacaagagaauccggagucccagacagauucucaggaucaggaucaggaacugacuuuacacuaacaauaucaucacuacaagcagaagacguagcaguauacuauugccaacaauacuacucaacaccaagaacauuuggacaaggaacaaaaguagaaauaaaacgaacaguagcagccccaucaguauucauauucccaccaucagacgaacaauuaaaaucaggaacagcaucaguaguaugccuacuaaacaacuucuacccaagagaagcaaaaguacaauggaaaguagacaacgcauuacaaaguggaaacucacaagaaucaguaacagaacaagacucaaaagacucaacauacucauuaucaucaacauuaacacuaagcaaagcagacuaugaaaaacacaaaguauacgcaugcgaaguaacacaccaaggccuaucaucaccaguaacaaaaucauucaacagaggagaaugc

SEQ ID NO: 46533 - RNA, 1341 nt, Artificial Sequence
  derived and/or modified sequence opt6 from Pembrolizumab_HeavyChain1
caaguccaauuaguacaaagcggaguagaaguaaaaaaaccgggagccucaguaaaaguaucaugcaaagcauccgguuacacauucacaaauuauuauauguacuggguaagacaagcaccaggacaaggccuagaauggaugggaggaauaaacccauccaacggugguacaaauuuuaacgaaaaauucaaaaauagaguaacacucacaacugauucuucuacaacaacagcauacauggaacuuaaaagucuacaauucgacgacacugccguuuacuauugcgccagaagagacuacagauuugacaugggauucgacuacuggggacaaggaacaacaguaacagucucaucagcaucaacaaaaggcccaaguguauuuccacuugcuccauguucuagaucaacaagcgaaucgaccgccgcacuaggaugucuagucaaagacuacuuuccagaaccaguaacaguaagcuggaacucaggagcauuaacaucagguguacacacauucccagccguauuacaaucaucaggauuauauucucuaucaucaguagucacaguaccaucauccucacuaggaacaaaaacauauacaugcaacguagaucauaaaccauccaauacuaaaguagacaaaagagucgaaucaaaauauggaccaccuugucccccauguccagcacccgaauuucuaggaggaccauccguauucuuauuuccaccaaaacccaaagacacacucaugauuucaagaacaccagaagucaccugcguaguaguagauguuagucaagaagaccccgaaguacaauucaauugguauguagacgguguagaaguacauaacgcaaaaacaaaaccaagagaagaacaauucaacucaacauacagaguaguaucaguauuaacaguacuacaccaagauuggcucaacggaaaagaauauaaaugcaaaguauccaauaaaggauuaccaucauccauugaaaaaaccauaucuaaagcaaaaggacaaccuagagaaccacaagucuacacucucccacccagccaagaagaaaugacuaaaaaucaggucucacucacaugccucguuaaaggauucuacccaucugacaucgcaguugaaugggaaucuaacggacagccugaaaauaacuacaaaacaacccccccaguauuagauucagacggauccuucuucuuauacucaagacuaacuguagauaaaucaagauggcaagaaggaaauguauuuuccugcucaguaaugcaugaagcauuacauaaccacuacacacaaaaaucacuaucccuuucauuaggaaaa

SEQ ID NO: 46534 - RNA, 654 nt, Artificial Sequence
  derived and/or modified sequence opt6 from Pembrolizumab_LightChain1
gaaauaguacuaacacaaucacccgcaacauuaucccuaucaccaggagaacgagcaacccuaucaugccgagcaucaaaagguguaucaacaucaggauacucauaccuacacugguaccaacaaaaaccaggacaagcaccaagauuacuaauauaucuagcuucauaccuagaaucaggagucccagccagauucucaggaucaggaucaggcacagauuucacacuaacaaucucaucacuagaaccagaagacuuugcaguauacuacugccaacacucaagagaccuaccauuaacauucggaggaggaacaaaaguagaaaucaaaagaaccgucgcagcaccaucaguauucauauuuccaccaucagacgaacaacuaaaaucaggaacagcaucaguaguaugccuacuaaacaacuucuacccaagagaagcaaaaguacaauggaaaguagacaacgcacuacaaucaggaaacucacaagaaucaguaacagaacaagacucaaaagacucaaccuacucacuaucaucaacccuaacucuaucaaaagcagacuacgaaaaacacaaaguauacgcaugugaaguaacacaccaagguuuaucaucacccguaacaaaaucauuuaacagaggagaaugc

SEQ ID NO: 46535 - RNA, 1356 nt, Artificial Sequence
  derived and/or modified sequence opt6 from Perakizumab_HeavyChain1
gaaguacaauuaguagaauccggaggcggacucguacaaccaggaggcaguuuaagacucucaugugcagcgaguggauucacauucagcgacuauaccauguuauggguaagacaagcaccagguaaaggacuagaauggguagcaauuauaaaaucaggcggaucauauucauauuauccagacaguguaaaaggacguuucacaauuaguagagauaacgcaaaaaauaguuuauacuuacaaaugaacucacuaagagccgaagacacagcagucuacuacugugcaagagacggagauuacggaagcucauacggcgcaauggauuauuggggccaagguacguuaguaacaguaucaagugcaucaacuaaaggcccaucaguauucccauuagccccaucaaguaaaucaacaucaggaggaacagcagcacuaggaugucuuguaaaagauuacuuuccagaaccaguaacaguaagcuggaauucaggagcacuaacaucaggaguccacacauuuccagcaguauuacaaucaucaggacucuauucacuuucaucuguaguaacaguaccaagcucaucauuaggcacacaaacauauauuuguaaugugaaucacaaaccaucaaauacaaaaguugacaaaaaaguagaaccaaaaucaugugauaaaacacauacauguccaccaugcccagcaccugaagcagccgguggaccaucaguauuccuuuuucccccaaaacccaaggacacauuaaugauaaguagaacaccagaaguaacuuguguaguaguagacguaagucacgaagacccagaaguaaaauucaauugguauguugaugguguagaaguucacaaugcaaaaacaaaaccaagagaagaacaauauaacagcacauauagagucguaucaguauuaacaguacuacaucaagauugguuaaacgguaaagaauacaaauguaaaguaaguaauaaagcacuacccgcaccaauagaaaaaacaauaucaaaagcgaaaggacaaccacgagaaccacaaguauacacacuccccccaagcagagaugaacuaacaaaaaaccaaguauccuuaacaugccuagucaaaggauuuuacccaucagacauagcaguagaaugggaaucaaauggccaaccggaaaacaauuacaaaacaacaccaccaguacuugacagugacggaucauucuuucucuacucaaaacuaacaguagauaagucaagauggcaacaaggaaacguauucaguugcagcguaaugcacgaagcucuccauaaccacuacacacaaaaaucauuaucacuaucaccaggaaaa

SEQ ID NO: 46536 - RNA, 645 nt, Artificial Sequence
  derived and/or modified sequence opt6 from Perakizumab_LightChain1
gacauacaaaugacacaaucaccaucaucacuauccgccucaguaggagacagaguaacaaucacaugcagagcaucacaagacauaaauucauaccuaucaugguuucaacaaaaaccaggaaaagcaccaaaaucauuaauaguacgagcaaacagacuaguagacggaguaccaucaagauucuccggaucaggaucaggacaagacuacucacuaacaauaucaucccuacaaccagaagacuucgcaacauacuacugucuacaauacgacgcauucccaccauacacauucggacaaggaacaaaauuagaaauaaaaagaacaguagcagccccaucaguauucauauucccaccaucugacgaacaauuaaaaucaggaacagcaagcgucguaugccuacuaaacaauuucuacccaagagaagcaaaaguacaauggaaagucgacaacgcauuacaaucaggaaauucacaagaaucaguaacagaacaagacucaaaagacucaacauauucacuaucaucaacauuaacacuaucaaaagcagauuacgaaaaacacaaaguauacgcaugcgaaguaacacaccaaggauuaagcucaccaguaacaaaaucauucaacagaggagaaugc

SEQ ID NO: 46537 - RNA, 1332 nt, Artificial Sequence
  derived and/or modified sequence opt6 from Pertuzuab_HeavyChain1
gaaguacaacuaguagaauccggcggaggacuaguccaaccaggcggcucacuaagauuaucaugugcagcaucgggauuuacauucacagacuacaccgacuggguuagacaagcaccaggaaaaggacuugagugggucgcugacguaaacccaaacagcggcggaucuauauacaaccaacguuucaaaggaagauuuaccuuaagcguagauagaaguaaaaauacauuauaccuacaaaauucacuaagagcugaagauacagcuguauacuacugcgcacgcaaucuaggaccaucauuuuacuucgacuacuggggacaaggaacauuaguaacagucuccucugcaucaacaaaaggaccaucaguauucccacucgcaccauccucuaaauccacaaguggaggaacagcagcacuuggaugucuagucaaagauuacuucccugaaccaguaacaguaucauggaacuccggugcccuaacaucuggaguacacacauucccagcaguacuccaaagcucaggauuauauucacuaucauccgucguaacaguaccauccucuagucuaggcacucaaacuuacauaugcaacguaaaccacaaaccaucaaauacaaaaguagacaaaaaaguagaaccaaaaagcugcgacaaaacacauacaugcccaccaugcccagcaccugaacuacuaggaggaccuucaguauucuuauucccaccaaaaccaaaagacacccucauaucacguaccccagaagucacaugcguaguaguagacgucucacacgaagaccccgaaguaaaauucaacugguaugucgauggcguagaaguacacaaugcaaaaacaaaacccagagaagaacaauacaacucaacuuacagaguaguaucaguacuaacaguacuucaucaagacugguuaaacggaaaagaauauaaauguaaaguaucaaacaaagcacuaccagcacccauagaaaaaacaauaucaaaagccaaaggacaaccaagagaaccacaaguuuacacacuaccaccuucaagagaagaaacaaaaaaccaaguuucacuaacaugucucguaaaaggauucuaccccuccgacauagcagucgaaugggaaagcaacggacaaccugaaaacaacuacaaaacaacaccaccuguauuagacucagacggcagcuuuuucuuauacucaaaacuaacuguagacaaaucaagauggcaacaagguaacguuuuuucaugcuccguacaugaagcacuacacaaccacuauacacaaaaaucacucucuuuaucaccaggaaaa

SEQ ID NO: 46538 - RNA, 639 nt, Artificial Sequence
  derived and/or modified sequence opt6 from Pertuzuab_LightChain1
gacauacaaacacaaucaccaucaagcuuaucagcaucaguaggagacagaguaacaauaacaugcaaagcaucccaagacguaucaauaggaguagcaugguaccaacaaaaaccaggaaaagcacccaaacuacuaauauacucagcaagcuacagauacacaggaguaccaucaagauucucaggaucaggaucaggaacagacuucacacuaacaauaucaucauuacaacccgaagacuucgccacauacuacugccaacaauacuacaucuacccauacacauucggacaaggaacaaaaguagaaauaaaacgaacaguagcagcaccaagcguauucauauucccaccaucagacgaacaacuaaaaucaggcacagcaucaguaguaugccuacuaaauaacuucuacccaagagaagccaaaguacaauggaaaguagacaacgcauuacaaucaggaaacucacaagaaaguguaacagaacaagacucaaaagacucaacauauucacuaagcucaacauuaacauuaagcaaagcagacuacgaaaaacacaaaguuuacgcaugcgaaguaacacaccaaggacuaagcucaccaguaacaaaaucauucaacagaggagaaugc

SEQ ID NO: 46539 - RNA, 642 nt, Artificial Sequence
  derived and/or modified sequence opt6 from Pertuzumab_HeavyChain
gacauacaaaugacacaaucaccaucaucccuaucagcaucaguaggagaccgaguaacaauaacaugcaaagcaucacaagacguaucaauaggaguagcaugguaccaacaaaaaccaggaaaagcaccaaaacuauuaauauacucagcaucauaccgauacacaggaguaccauccagauucucaggaucaggaucaggcacagauuucacacuaaccauauccucacuacaaccagaagacuucgcuacauacuacugccaacaauacuacauauacccauacacauucggacaaggaacaaaaguagaaauaaaaagaacaguagcagcaccaucaguauucauauucccacccucagacgaacaacuaaaaucaggaacagcaucaguaguaugcuuacuaaacaauuucuacccaagagaagccaaaguccaauggaaaguagacaacgcacuccaaucaggaaacucacaagaaucaguaacagaacaagacucaaaagacucaacauauucacuauccucaacacuaacacuaucaaaagcagacuacgaaaaacacaaaguauacgcaugcgaaguaacacaccaaggacuaucaucaccagucacaaaaucauucaacagaggagaaugc

SEQ ID NO: 46540 - RNA, 1344 nt, Artificial Sequence
  derived and/or modified sequence opt6 from Pertuzumab_LightChain
gaaguacaauuaguagaaucaggcggaggacugguacaaccuggaggcucacucagacuaucaugugccgcauccggcuucacauucacagacuauacaauggacuggguacgucaagcaccaggaaaaggauuagaauggguagcagauguaaacccaaacucaggaggaucaauauacaaccaaagauucaaaggaagauucacauuaucaguagaccgaucaaaaaauacucuauauuuacaaaugaauucuuuaagagcagaagacacagcaguauauuauugugcacgaaauuuagguccaucauucuauuucgacuacuggggacaaggaacauuaguaaccguauccagcgcaucaacaaaaggaccaucaguuuucccauuagcaccuucaucaaaaaguacaucaggaggaacagccgcauuagguugcuuaguaaaagacuacuuuccagaaccaguuacaguaucauggaauucuggagcucuaacaucagguguacacacauucccagcaguauuacaauccucaggacuauacucucuaucaucaguaguaacaguaccgucaucaucacuaggaacacaaacauacauauguaacgucaaccacaaaccuucaaauacaaaagucgauaaaaaaguagaaccaaaaucaugugauaaaacacacacaugcccaccauguccagcaccagaacuacucggaggaccaucaguauucuuauuuccaccaaaaccaaaagacacacuuaugauaucacgaacaccagaaguaacauguguaguuguagacgucucacacgaagacccagaaguaaaauucaacugguacguugaugguguagaaguucacaacgccaaaacuaaaccucgagaagaacaauacaacucaacauacagaguuguaucuguacuaacaguacuacaccaagacuggcuaaauggaaaagaauacaaauguaaaguaucaaacaaagcacuaccagcaccaauagaaaaaaccauuucaaaagccaaaggacaaccaagagaaccacaaguauauacacuacccccaucuagagaagaaaugacaaaaaaccaaguaucacuuacaugucuaguaaaaggcuucuacccaucagacauagcaguagaaugggaauccaacggacaaccagaaaacaacuacaaaacaacaccaccaguucuagauucagacggaucauuuuuccuauauucaaaacuaacaguagauaaaucccgauggcaacaaggcaacguauuuuccuguucuguaaugcacgaagcauuacacaaucacuauacacaaaaaagucuaucacucucaccaggc

SEQ ID NO: 46541 - RNA, 750 nt, Artificial Sequence
  derived and/or modified sequence opt6 from Pexelizumab_h5g1.1-scFv
auggcagauauacaaaugacacaaagcccaucaaguuuaagcgcaaguguaggugauagaguaacaauaacauguggagcaagugaaaacauauauggagcauuaaauugguaucaaagaaaaccaggaaaagcaccaaaguuauuaauauauggagcaacuaauuuagcagaugguguaccuaguagauuuucaggaagcggaucaggaacagauuauacacuaacaauaaguagucuacaaccagaagauuuugcaacauauuauugucaaaauguauuaaauacaccauuaacauuuggacaaggaacaaaaguagaaauaaaaagaacaggaggaggaggaucaggaggaggaggaaguggaggaggaggaagccaaguacaauuaguacaaucaggagcagaaguagaaaaaccaggagcaucaguaaaaaaaguaucaugcaaagcaaguggauacauauucaguaacuauuggauacaauggguaagacaagcaccaggacaaggauuagaauggaugggagaaauauuaccaggaagugguaguacagaauacgcacaaaaauuucaaggaagaguaacaaugacagcagauacaucaacaaguacugcauauauggaauuaucaagucuaagaucagaagauacagcaguauauuacugugcuagauauuuuuuugguagcucaccaaauuauugguauuuugauguauggggacaaggaacucuaguaacaguaucauca

SEQ ID NO: 46542 - RNA, 345 nt, Artificial Sequence
  derived and/or modified sequence opt6 from Pexelizumab_h5g1.1VHC_+_F_Heavy_Chain_V-Region
caaguacaauuaguacaaagcggagcagaaguaaaaaaaccaggagcaagcguaaaaguaagcuguaaagcaagcggauacauauucucaaacuauuggauacaauggguaagacaagcaccaggacaaggacuagaauggaugggagaaauauuaccaggaagcggaagcacagaauaugcacaaaaauuucaaggaagaguaacaaugacagcagacacaagcacaaguacagcauauauggaauuaucaaguuuaagaucagaagauacagcaguauauuacugugcaagauacuuuuucggaagcucaccaaauugguauuucguauggggacaaggaaca

SEQ ID NO: 46543 - RNA, 318 nt, Artificial Sequence
  derived and/or modified sequence opt6 from Pexelizumab_h5g1.1VHC_+_F_Light_Chain_V-Region
gacauacaaaugacacaaucaccaucacuaucagcaucaguaggagacagaguaacaauaacaugcggagcaucagaaaacauauacggagcacuaaacugguaccaaagaaaaccaggaaaagcaccaaaacuacuaauauacggagcaacaaaccuagcagacggaguaccaucaagauucucaggaucaggaucaggaacagacuacacacuaacaauaucaucacuacaaccagaagacuucgcaacauacuacugccaaaacguacuaaacacaccacuaacauucggacaaggaacaaaaguagaaauaaaa

SEQ ID NO: 46544 - RNA, 1326 nt, Artificial Sequence
  derived and/or modified sequence opt6 from PF-05082566_HeavyChain1
gaaguacaacuaguacaaagcggcgcagaaguuaaaaaaccaggagaaagucuucguauaagcugcaaaggcuccggauacucauuuuccacuuacuggauauccuggguaagacaaaugccuggaaaaggacuagaauggaugggaaaaauauauccuggagacucauauacaaauuauucuccaucauuccaagggcaaguaacaauauccgcagauaaaucaauaucuacugcuuaccuacaauggucuuccuuaaaagccucagacacugcuauguauuauugugccagagguuacggcauauuugauuacuggggucaaggaacauuagucaccguaucaucagcaucaacaaaaggaccaucaguauuuccauuagcaccauguucaagaaguacaagcgaauccacagcagcacucggaugccuaguaaaagauuauuucccagaaccaguaaccguaucauggaacucaggcgcacuaacaucaggcguacauacauucccagcuguacuacaaucauccggauuauauucacuuucaucaguaguaacaguaccaagcucaaauuucggaacccaaacauauacauguaauguugaccauaaaccaucaaacaccaaaguugauaaaacaguagaacgcaaaugcugugucgaaugcccaccaugccccgcaccaccaguagcaggaccuucaguuuuuuuauucccuccaaaaccaaaagauacacuaaugauaucaagaacaccagaaguaacaugugucguaguugacguaucccacgaagacccagaaguccaauucaacugguauguagacggaguugaaguacacaaugcaaaaacaaaaccaagagaagaacaauuuaacuccaccuucagaguaguaucuguccuuacaguaguacaccaagauuggcucaacggaaaagaauacaaaugcaaaguauccaacaaaggccuaccagccccaauagaaaaaacaauuucaaaaacaaaaggacaaccccgagaaccccaaguauauacacucccaccauccagagaagaaaugacaaaaaaccaaguaucacuaacaugucuagucaaaggcuuuuacccaucagacauagcuguugaaugggaaucaaacggccaaccagaaaauaacuauaaaacaacuccccccauguuagacucagacggaucauuuuuccuuuacucaaaauuaacaguugacaaaucuagauggcaacaaggaaauguuuucucaugcuccguaaugcaugaagcccuccauaaucacuauacucaaaaaucccuaucacuauccccaggaaaa

SEQ ID NO: 46545 - RNA, 642 nt, Artificial Sequence
  derived and/or modified sequence opt6 from PF-05082568_LightChain1
ucauacgaacuaacacaaccaccaucaguaucaguauccccaggacaaaccgcaucaauaaccugcucaggagacaacauaggagaccaauacgcacacugguaccaacaaaaaccaggacaaagcccaguacuaguaauauaccaagacaaaaacagaccaucaggaauaccagaaagauucucaggaucaaacucaggaaacacagcaacacuaacaauaucaggaacacaagcaauggacgaagcagacuacuauugcgcaacauauacaggauucggaucacuagcaguauucggcggaggaacaaaauuaacaguauuaggacaaccaaaagcagcaccaucaguaacauuauucccaccaucaucagaagaacuacaagcaaacaaagcaacacuaguaugccucauaucagacuucuacccaggagcaguaacaguagcauggaaagcagacucaucaccaguaaaagcaggaguagaaacaacaacaccaucaaaacaaucaaacaacaaauacgcagcaucaucauaccuaucacuaacacccgaacaauggaaaucacacagaaguuauucaugucaaguaacacacgaaggaucaacaguagaaaaaaccguagcaccaacagaaugcagc

SEQ ID NO: 46546 - RNA, 1341 nt, Artificial Sequence
  derived and/or modified sequence opt6 from Pidilizumab_HeavyChain1
caaguacaacuaguccaaucaggaucagaacuaaaaaaaccaggagcaucuguaaaaauaucauguaaagcaucaggauacacauucacaaauuacggcaugaacuggguuagacaagcaccaggacaaggacuacaauggaugggauggaucaauacagauucaggagaaucaacauacgcagaagaauuuaaagguagauucguguucuccuuagacacaucuguaaacacugcauaucuacaaauaacuucacuaacagcagaagacacaggaauguacuuuugcguaagagucggauacgacgcauuagacuauuggggacaagguacgcuuguuacaguaucaucagcauccacuaaaggaccaucaguauucccauuagcaccaucaucaaaaucuacaucaggaggaacugcagcacucggaugccucguaaaagacuacuuccccgaaccaguuacaguaucauggaacucuggagcacuaacauccgguguacacacauucccagccguacuacagucuucaggacuauauucauuaucuuccguaguaacagucccaucaucaucauuaggcacacaaacuuacauauguaauguuaaccauaaaccaagcaacacaaaaguugacaaaagaguagaacccaaaucaugugacaaaacacacacaugcccuccaugcccagcaccagaauuauuaggaggaccaucaguauuuuuauucccaccaaaaccuaaagauacccuaaugauaucaagaacaccugaaguaacaugcguaguaguugacguaucacacgaagaccccgaaguaaaauucaacugguauguagacggaguagaaguacacaaugcaaaaacaaagccucgagaagaacaauauaauucaacauaccgaguaguauccguccucacuguauuacaccaagacugguuaaaugguaaagaauacaaauguaaaguaucaaacaaagcacuuccugcaccaauagaaaaaacaauuuccaaagcaaaaggacaacccagagaaccccaagucuacacacuaccucccucacgugaagaaaugacaaaaaaucaaguuucuuuaacuugccuaguaaaaggauucuauccaucggauauagcaguagaaugggaauccaacggucaaccagaaaacaacuacaaaacaacaccaccuguccuagauucagacggaucuuuuuuuuuauacucaaaauuaacaguagacaaaucacgauggcaacaaggcaacguauuuucaugcucaguaaugcacgaagcacuacauaaccacuacacacaaaaaucauuaucacuaucaccaggaaaa

SEQ ID NO: 46547 - RNA, 639 nt, Artificial Sequence
  derived and/or modified sequence opt6 from Pidilizumab_LightChain1
gaaauaguacucacacaaucaccaucaucccuaucagcaucaguaggugauagaguaacaauaacaugcucagcaagaucaucaguaucauacaugcacugguuccaacaaaaaccaggaaaagcaccaaaacuauggauauaccguacauccaacuuagcaucaggaguaccauccagauucucaggcucaggauccggaacaucauacugccuaacaauaaacucauuacaaccagaagacuucgcaacauacuacugccaacaaagaucaucauucccacuaacauuuggaggagguaccaaacuagaaauaaaaagaacaguagcagcuccaucaguauuuauauucccaccaucagacgaacaauuaaaaucaggaacagcaucaguaguaugucuacuaaauaacuuuuacccacgagaagccaaaguacaauggaaaguagacaacgcacuacaauccggaaacucccaagaaucaguaacagaacaagacucaaaagacucaaccuacucccuaucaucaacauuaacacuaucaaaagcagacuacgaaaaacacaaaguuuacgcaugugaaguaacacaucaaggacuaucaucaccaguaacaaaauccuucaacagaggagaaugu

SEQ ID NO: 46548 - RNA, 1350 nt, Artificial Sequence
  derived and/or modified sequence opt6 from Pinatuzumab_vedotin_HeavyChain1
gaaguacaacuaguagaauccggcggcggucuaguacaaccaggcggaucauuaagauuaaguugugccgcaagcggauaugaauucucaagaucuuggaugaacuggguaagacaagccccaggaaaaggauuagaauggguuggaagaauauacccaggagauggagacacaaauuacucaggaaaauuuaaagguagauucacaauaucagcagauacaucaaaaaauacugcauaucuacaaaugaacucuuuaagagccgaagacacugcaguauacuacugcgcuagagacggaucauccugggacugguauuucgaugucuggggccaaggaacacucguuacaguaucaucagccucaacaaaaggccccucaguauucccacuugcaccaucaucaaaaucaacauccggaggaacagcugcauuagguugccuaguaaaagacuacuuuccugaaccuguaacaguuucauggaacucuggagcauuaaccucaggaguacacacauucccugccguauuacaaucaucaggauuauauucauuaucaucaguaguaacuguacccucaucaucacuaggaacacaaacuuacauaugcaacguaaaccauaaaccaagcaacacuaaaguagauaaaaaaguagaaccaaaaucuugugauaaaacacacaccuguccaccauguccagccccugaacucuuagguggaccauccguuuuccuauucccaccaaaaccaaaagacacucuaaugaucucaagaacaccagaaguaacaugcguuguaguagacguaucacacgaagaucccgaaguaaaauucaacugguauguagacggaguugaaguccacaacgcaaaaacaaaaccuagagaagaacaauauaauucaacauauagaguaguaucaguccucacaguccuacaucaagauuggcuaaaugguaaagaauauaaauguaaaguaaguaacaaagcauuaccagcuccaaucgaaaaaacaauaaguaaagcuaaaggucaacccagagaaccacaaguauacacacuaccaccaucacgcgaagaaaugacaaaaaaucaaguuucacuaacaugucucguaaaaggauucuauccuuccgacauagccguagaaugggaauccaauggacaaccagaaaacaauuacaaaacaacaccaccuguacuagacucagacggaucauucuuucucuauucaaaauuaacaguugauaaaucaagauggcaacaaggcaacguuuucaguuguucagucaugcaugaagcucuccauaaucacuauacacaaaaaucacuaucacuaucaccagguaaa

SEQ ID NO: 46549 - RNA, 657 nt, Artificial Sequence
  derived and/or modified sequence opt6 from Pinatuzumab_vedotin_LightChain1
gacauacaaaugacacaaucaccaucaucacuaucagcaucaguaggagacagagucacaauaacaugcagauccucacaaucaaucguacacuccguaggaaacacauuccuagaaugguaccaacaaaaaccaggaaaagcaccaaaacuacuaauauacaaagucucaaacagauucucaggaguaccaucaagauuuucaggaucaggaucaggaacagacuuuacacuaacaauauccucacuacaaccagaagacuucgcaaccuauuacugcuuccaagguucacaauucccauacacauucggacaaggaaccaaaguagaaauaaaaagaacagucgcagcacccucaguauucauauucccaccaucagacgaacaacuaaaaucaggaacagcauccguaguaugccuccuaaacaacuucuaccccagagaagcaaaaguacaauggaaaguagacaacgcacuacaaucaggaaacucacaagaaucaguaacagaacaagacucaaaagacucaacauacucacuaucaucaacacuaacacuaucaaaagcagacuacgaaaaacacaaaguauacgcaugcgaaguaacacaccaaggacuaucaucaccaguaaccaaaucauuuaacagaggcgaaugc

SEQ ID NO: 46550 - RNA, 1023 nt, Artificial Sequence
  derived and/or modified sequence opt6 from Placulumab_chain1
gacauacaaaugacacaaucaccaucaucacuauccgcaucaguaggagaccgaguuacaauaacaugcagagcaucucaagcaauagauucauaucuacacugguaccaacaaaaaccaggaaaagcuccaaaacuacucauauacucagcaucaaaccuagaaacaggaguaccaucaagauucucaggaucaggaagugguacagacuucacauuaaccaucucaaguuuacuaccagaagacuucgcaacauacuacugccaacaagucguauggagaccauucacauucggacaaggaacaaaaguagaaauaaaaagaguagaaccuaaaucaucagauaaaacacauacauguccacccuguccagcuccagaacuacucggaggaccaucaguauucuuauucccaccaaaaccaaaagacacacucaugauaucaagaacaccagaaguaacaugcguaguaguagacgucucacaugaagaccccgaaguaaaauucaacugguacguagacggaguagaaguacacaaugcuaaaacaaaaccacgcgaagaacaauacaacucaaccuauagagucgucucaguucuaacaguacuacaccaagacugguuaaauggaaaagaauacaaauguaaaguaucaaacaaagcacuaccagcaccaauagaaaaaacaauaucaaaagcaaaaggacaaccaagagaaccacaaguauauacacuaccaccaucaagagacgaacuaaccaaaaaucaaguaucacuaacaugccuagucaaaggauucuauccaucagacaucgccgucgaaugggaaucaaacggacaaccagaaaacaacuacaaaacaacaccacccgucuuagacagugacggaucuuuuuuucuauacuccaaauuaacagucgacaaaucacgauggcaacaaggaaauguauucucauguucaguaaugcacgaagcacuacacaaccauuauacacaaaaauccuuaucauuaucaccaggaaaa

SEQ ID NO: 46551 - RNA, 1023 nt, Artificial Sequence
  derived and/or modified sequence opt6 from Placulumab_HeavyChain1
gauauacaaaugacacaaucccccucaucucuuucagcauccgucggagaccgcguaacaaucacaugccgagcuucacaagcaauagacucauaucuacacugguaccaacaaaaacccggcaaagcaccaaaacuacuaaucuacucagcaucaaaucuagaaacagguguaccaucuagauucucaggaucaggaucuggcacagacuuuacacuaacaauaucaucacuccuaccagaagacuucgccacauacuacugccaacaaguuguauggcgaccauucacauuuggacaaggaacaaaaguagaaauaaaacgaguagaaccaaaaucaucagacaaaacacacacuugcccaccaugcccagcccccgaacuccuaggaggaccaucaguauuucuauucccaccaaaaccaaaagacacauuaaugauaucaagaacaccagaaguaacaugcguagucgucgacguaucccacgaagauccagaaguaaaauucaacugguacguagacgguguagaaguacacaacgccaaaacaaaaccaagagaagaacaauacaauucaaccuacagagucguaucaguacucacaguauuacaccaagacugguuaaacggaaaagaauacaaaugcaaagucagcaauaaagccuuaccagcaccaauagaaaaaacaauaucaaaagccaaaggacaaccaagagaaccacaaguauacacauuacccccaucuagagaugaacuaacaaaaaaccaaguaucuuuaacaugccuaguaaaaggauucuacccaucagacauagcaguagaaugggaaagcaauggacaaccagaaaacaauuacaaaacaacaccacccguauuagacuccgacggauccuucuuucuauacucaaaauuaacaguagacaaaucaagauggcaacaaggaaacguauucucaugcucagucaugcacgaagcacuacacaaccacuacacucaaaaaucacucucacuaucaccaggaaaa

SEQ ID NO: 46552 - RNA, 1341 nt, Artificial Sequence
  derived and/or modified sequence opt6 from Plozalizumab_HeavyChain1
gaaguacaacuaguagaaucaggcggaggacuaguaaaacccggcgguucgcuacgauuaucuugcgcagcauccggauuuacauuuucugccuaugcaaugaauuggguuagacaagcaccaggaaaaggccuagaauggguaggaagaauaagaacaaaaaacaauaacuaugcaacauacuacgcugacucaguuaaagacagauucacuauauccagagacgacucuaaaaacacauuguacuuacaaaugaacucacucaaaaccgaagauacagcuguauauuacugcacaacuuucuacgguaacggaguauggggacaaggcacacucguaacaguaucaucagcauccacaaaaggaccaagugucuucccacuagcacccucaucaaaaagcacaucaggaggaacagcagcauuaggaugccuaguaaaagauuacuuuccagaaccaguuacagucucuuggaauagcggcgcacucacaucuggaguacacacauucccagcaguucuacaaucaucaggucuauacagccuauccuccgucguaacaguuccuucaucaagcuuaggaacucaaacauacauuugcaacguaaaccacaagccaucaaacaccaaagucgauaaaaaaguagaaccaaaaucaugcgauaaaacacacacauguccaccauguccagcacccgaacuagcuggcgcccccucagucuucuuauuuccgcccaagccuaaagacacuuuaaugauaucaagaacaccagaaguaacaugcguaguaguagauguaucucacgaagacccagaaguuaaauucaacugguacguagacggaguagaaguccacaacgcaaaaaccaaaccaagagaagaacaauauaauucaacuuacagaguaguaucaguauuaacaguauuacaucaagacuggcuuaacggaaaagaauauaaaugcaaaguaucaaauaaagcuuuaccagcaccaauugaaaaaacaauaaguaaagcaaaaggccaaccaagagaaccacaaguauauacauuaccaccuucaagagaugaacuaacaaaaaaccaaguaucccucacaugcuuaguaaaaggcuucuauccaucagauauagccguagaaugggaaucaaacggacaaccagaaaacaauuauaaaacaacaccaccaguacucgauucagacggcucauuuuuuuuauacucaaaauuaacaguagacaaaucaagauggcaacaaggaaauguauucucaugcucuguaaugcacgaagcauuacacaaccacuacacacaaaaaucacuaucauuaucaccaggcaaa

SEQ ID NO: 46553 - RNA, 657 nt, Artificial Sequence
  derived and/or modified sequence opt6 from Plozalizumab_LightChain1
gacguaguaaugacacaaucaccauuaucauuaccaguaacacuaggacaaccagcaucaauaucaugcaaaucaucacaaucauuauuagacucagacggaaaaacauuuuuaaacugguuccaacaaagaccaggacaaucaccaagaagacuaauauaccuaguaagcaaacuagacucaggaguaccagacagauucucaggaucaggaucagguacagacuucacacuaaaaaucucaagaguagaagcagaagacguaggaguauacuacugcuggcaaggaacacacuucccauacacauucggacaaggaacuagacuagaaauaaaacgaacaguagcagcaccaagcguauucauauucccaccaucagacgaacaauuaaaaucaggaacagcaucaguuguaugcuuacuaaacaacuucuacccaagagaagcaaaaguacaauggaaaguagacaacgcauuacaaagcggaaacucacaagaaucaguaacagaacaagacagcaaagacucaacauacucacuaagcucaacccuaacacuaagcaaagcagacuacgaaaaacacaaaguauaugcaugugaaguuacacaccaaggauuaagcucaccagucacaaaaagcuucaacagaggagaaugc

SEQ ID NO: 46554 - RNA, 1341 nt, Artificial Sequence
  derived and/or modified sequence opt6 from Pogalizumab_HeavyChain1
gaaguacaacuaguacaaucuggcgccgaaguaaaaaaaccaggagccucagucaaaguaucaugcaaagcauccggcuauacauucacagacaguuacaugagcuggguaagacaagcacccggacaaggacuagaauggauaggagacauguauccagacaacggugauagcucauauaaccaaaaauucagagaaagaguaacaauaaccagagacaccuccaccuccacagcauauuuagaacucucaagucuaagaucagaagacacagcaguauauuacuguguacuugccccacgcugguacuucucaguauggggacaaggaacacucguaaccguuucuucagccagcacaaaagguccaucagucuuuccacuagccccauccucaaaaucaacaucuggcggaaccgcagcacuaggaugucuaguuaaagacuacuuuccagaaccagucacaguaucauggaacucaggagcacuaacaucaggaguccacaccuuuccagcaguacuacaaucauccggauuauacucauuaucaucuguagucacaguuccauccucaucauuaggaacccaaacauauauuugcaacgucaaccauaaaccaagcaauacaaaaguagacaaaaaaguagaaccaaaaucaugcgauaaaacacauacaugcccaccaugcccagcuccagaauuacuuggaggaccaucaguauucuuauucccaccaaaaccaaaagauacauuaaugauaucccgaacaccagaaguaaccugcguaguaguagaugucucacaugaagaccccgaaguaaaauuuaacugguaugucgacggcguagaaguacacaaugccaaaacaaaaccccgugaagaacaauacaacucaacauaucgcguaguauccguauuaacaguacuacaccaagacuggcucaacggcaaagaauacaaaugcaaaguaucaaacaaagcacuaccagcacccauagaaaaaacaauaagcaaagcaaaaggccaaccaagagaaccacaaguauacacacuaccaccaucaagagaagaaaugaccaaaaaucaaguaucacucacaugccuaguaaaaggauucuacccaagcgacauugcaguagaaugggaaucaaacggucaaccagaaaacaacuacaaaacaacacccccaguauuggacucagacggauccuuuuuccuauauucuaaacuaacaguagauaaaucuagauggcaacaaggaaauguauucaguugcucaguaaugcaugaagcacuacauaaucacuauacccaaaaaucauuaucauuauccccaggaaaa

SEQ ID NO: 46555 - RNA, 642 nt, Artificial Sequence
  derived and/or modified sequence opt6 from Pogalizumab_LightChain1
gacauacaaaugacacaauccccaucaucacuaucagcauccguaggagacagaguaacaauaacuugcagagcaucccaagacauaucaaacuaccuaaauugguaccaacaaaaaccaggaaaagcaccaaaacuacuaauauacuacacaucaagacuaagaucaggaguaccauccagauucucaggauccggaucaggcacagacuucacccuaacaauaucaucacuacaacccgaagacuucgcaacauacuacugccaacaaggacacacauuaccacccacauucggacaaggaacaaaaguagaaauaaaaagaacaguagcagcaccaucaguauucauauucccaccaucagacgaacaauuaaaaucaggaacagccucaguaguaugccuauuaaacaacuucuacccaagagaagccaaaguccaauggaaaguagacaacgcacuacaaucaggaaacucacaagaauccguaacagaacaagacucaaaagauucaaccuacucauuauccucaacucuaacacuaucaaaagccgacuacgaaaaacacaaaguauacgcaugcgaaguaacacaccaaggacuaucaucaccaguaacaaaaucauucaacagaggagaaugc

SEQ ID NO: 46556 - RNA, 1341 nt, Artificial Sequence
  derived and/or modified sequence opt6 from Polatuzumab_vedotin_HeavyChain1
gaaguucaauuaguagaaucaggcggaggauuaguacaaccugguggaucacuaagauuauccugugccgcauccggauacacuuucucaucauacuggauagaauggguaagacaagcaccaggcaaaggacuagaauggauaggagaaauccucccaggaggaggagacacaaauuauaaugaaauauucaaagguagagcaacauuuuccgccgacacuuccaaaaauacagcauauuuacaaaugaauucauuaagagcagaagauacagcaguguauuauuguacccgacgaguacccauaagauuagacuauuggggacaagggacacuuguaacagucucuuccgcuaguacaaaaggaccaucagucuuuccacuugccccaucaucaaaaucaacaucagguggaacagcagcauuagguugcuuaguaaaagauuacuuucccgaaccuguuacaguauccuggaacuccggagcacuaacaucaggaguacauaccuuuccagcuguauuacaaucaucaggacuauauaguuuaucaucaguaguuacagucccuuccaguucauuaggcacacaaacauauauauguaauguaaaucauaaacccuccaauacaaaagucgauaaaaaaguagaaccaaaaagcugugacaaaacacacacauguccaccaugcccagccccggaacuacuaggaggaccuucaguauuccuauuuccacccaaaccaaaagauacacucaugaucucacgaacacccgaaguaacaugcguuguaguagauguuucucaugaagauccugaaguuaaauucaauugguacguugacggagucgaaguacauaaugccaaaacaaaaccaagagaagaacaauauaacucuacuuaccgaguaguaucaguacuaacuguacuacaucaagauuggcuaaacggaaaagaauacaaaugcaaaguuuccaauaaagccuuacccgcaccaauagaaaaaaccauaagcaaagcuaaaggucaaccaagagaaccacaaguauacacacuaccucccuccagagaagaaaugacaaaaaaccaaguaucauuaacaugccucguuaaaggauucuaucccuccgacauagcagucgaaugggaaagcaauggacaaccagaaaacaauuacaaaacaacaccaccagucuuagauucagauggauccuuuuuccuauacucaaaauuaacuguugacaaaucuagauggcaacaaggaaacguuuucucaugcaguguaaugcacgaagcucuucacaaccauuauacacaaaaaucacuaucacuauccccaggaaaa

SEQ ID NO: 46557 - RNA, 654 nt, Artificial Sequence
  derived and/or modified sequence opt6 from Polatuzumab_vedotin_LightChain1
gacauacaacuaacacaaucaccaucuucccuaucagcaucagucggagacagaguaacaauaacauguaaagcaucacaauccguagacuacgaaggagacucauuccuaaacugguaccaacaaaaaccaggaaaagcaccaaaauuacuaauauaugcagcaucaaaccucgaaucaggaguaccaucaagauucucaggcuccggaucaggaacagacuucacacuaaccauaucaucauuacaaccagaagacuuugcaacauacuacugccaacaaucaaacgaagacccacuaacauucggacaaggaacaaaaguagaaaucaaaagaacaguagcagcaccaucaguauucauauuuccaccaucagacgaacaauuaaaaucaggaacagcaucaguaguaugccuauuaaacaacuucuacccaagagaagcaaaaguacaauggaaaguagauaaugcacuacaaucaggaaacucccaagaaucaguaacagaacaagauuccaaagacucaaccuacucccuaucaucaacacuaacacucucaaaagcugacuacgaaaaacacaaaguauaugcaugcgaaguuacacaccaaggacuaagcuccccaguaacuaaaucauucaacagaggagaaugc

SEQ ID NO: 46558 - RNA, 1326 nt, Artificial Sequence
  derived and/or modified sequence opt6 from Ponezumab_HeavyChain1
caaguucaauuaguacaaucaggcgcagaaguaaaaaaaccaggcgcaagcguaaaaguuucauguaaagcaucaggauauuauacggaagcauacuacauccacuggguccgacaagcaccaggacaggguuuagaauggaugggcagaauagaucccgccacagguaacacaaaauacgcaccacgauuacaagauagaguaacaaugacaagagacacaucaacaaguaccguauacauggaacuaucauccuuaagaucagaagacacagcaguauacuacugcgcaucacuauauuccuuaccaguauacuggggacaaggcacaacaguaacaguaucaucagcaucaacaaaaggaccaucagucuucccacuagcuccaugcuccagaucaacauccgaauccaccgcagcucuagguugcuuaguaaaagauuacuuccccgaaccaguaacaguuagcuggaacagcggagcacuaacaagcggaguacauaccuuucccgccguauuacaaucaucaggacuauacucacuaagcucaguagucacaguuccaucaucaaauuucgguacucaaaccuacaccuguaacguagaucacaaacccuccaacacuaaaguagacaaaacaguugaaagaaaaugcugcguagaauguccaccaugcccagcacccccaguagcaggaccauccguauuucuauucccaccaaaaccuaaagacacacuuaugauaucacgaacgccugaaguuacaugcguagucguagacguaucucaugaagacccagaaguacaauuuaacugguaugucgacggaguagaaguacacaacgccaaaacaaaaccaagagaagaacaauuuaacuccacauuccgaguaguaagcguccuaacuguaguacaccaagacugguuaaacggaaaagaauacaaaugcaaagucucaaacaaaggauuaccaucauccauagaaaaaaccauaucaaaaacaaaaggacaaccacgagaaccacaaguauacacucuaccaccaucacgugaagaaaugacaaaaaaucaaguaucacuaacaugcuuaguaaaaggauucuacccaucugacaucgcaguagaaugggaaucaaauggacaaccugaaaacaacuacaaaacaacacccccaauguuagacucagauggaucauucuucuuauacucaaaauuaacagucgauaaaucgagauggcaacaaggaaacguauuuucaugcucaguaaugcaugaagcacuacacaaccacuacacucaaaaaucccucucacuaucuccaggaaaa

SEQ ID NO: 46559 - RNA, 657 nt, Artificial Sequence
  derived and/or modified sequence opt6 from Ponezumab_LightChain1
gacguaguuaugacacaaucaccauuaucauuaccaguaacauuaggacaaccagcaucaauaucuugcaaauccucacaaucccuacuauacucagacgcaaaaacauacuuaaacugguuccaacaaagaccaggacaauccccacgaagacuaauauaccaaauaucaagacuagauccaggaguaccagacagauucucagguucaggaucaggaacagacuucacacuaaaaauaucaagaguagaagcagaagauguaggaguauacuacugccuacaaggaacacacuacccaguauuauucggacaaggaacaagacuagaaauaaaaagaacaguagcagcaccaucaguauucauauucccaccaucagacgaacaacuaaaaucaggcacagcaucaguaguaugcuuacuaaacaacuucuaccccagagaagcaaaaguacaauggaaagucgacaaugcacuacaaucaggcaacucacaagaaucaguaacagaacaagacucaaaagacucaacauacucacuaucaucaacacuaacacuauccaaagcagacuacgaaaaacacaaaguauacgcaugcgaaguaacacaccaaggauuaucaucaccaguaacaaaaucauucaacagaggagaaugc

SEQ ID NO: 46560 - RNA, 1362 nt, Artificial Sequence
  derived and/or modified sequence opt6 from Pritoxaximab_HeavyChain1
caaguacaauuacaagaaagcggugcagaauuaguacgcucaggagccucaguaagaauguccuguaaagcaagcggcuacacuuucacaucauacaauaugcacuggguuaaacaaacaccaggccaaggacuagaauggauaggcuacauauacccaggaaacggaggcacaaacuacauacaaaaauucaaaggaaaagcaauacuaacagccgacacaucaucaucaacagcauacaugcaaauaucuucacuaaccucagaagacucagccguauacuucugcacaagaucacccucacacuacucuuccgaccccuacuucgacuacuggggacaaggaacuaccuuaacaguuagcuccgaauuugcaucaacaaaaggaccaucaguauuuccacuagcucccucaucaaaaucaacaucugguggaacagcagcauuaggauguuuagucaaagacuacuuuccagaaccaguaacaguaucauggaauucaggcgcacuaacaucaggaguucacaccuucccagcaguauuacaaucaucaggacuauacucacuaucaagcguagucacagucccaucuucuucacuaggaacccagaccuacauuugcaauguaaaccacaaaccaagcaauaccaaaguagacaaaaaaguagaaccaaaaucuugcgacaaaacacauacaugcccaccauguccagcaccagaacuauuaggcggaccaucaguauuccuuuucccucccaaacccaaagacacauuaaugauuucaagaacaccagaagucacuugcguaguaguagacguaucacacgaagacccugaaguuaaauucaauugguacguagacgguguagaaguacacaaugcaaaaacaaaaccaagggaagaacaauauaacuccaccuacagaguagucagcguacuaacaguccuccaucaagacugguuaaacggaaaagaauacaaauguaaaguaucuaauaaagcauuacccgcacccauagaaaaaacaauaucuaaagcaaaaggacaaccaagagaaccacaaguauacacauuaccacccagucgagacgaauuaacaaaaaaucaaguuucacuaaccugccucguaaaaggauuuuacccaucagauauagcaguagaaugggaaucaaacggacaaccugaaaacaacuacaaaacaacaccucccguacuagauucagacgguucauuuuuucuguauuccaaauuaacaguagacaaaucucgauggcaacaaggcaacguauucagcuguucaguuaugcaugaagcuuuacacaaucacuacacacaaaaaucauuaucccuaucaccagguaaa

SEQ ID NO: 46561 - RNA, 642 nt, Artificial Sequence
  derived and/or modified sequence opt6 from Pritoxaximab_LightChain1
gacauaguaaugucacaaucacacaaauucaugucaacaucaguaggagacagaguaucaauaaccugcaaagcaucacaagacguaggaacagcaguagcaugguaccaacaaaauccaggacaaucaccaaaauuccuaauauacugggcaucaacacgacacaccggaguaccagacagauucacaggaucuggcucuggaacagacuucacacuaacaauaaccaacguacaaucagaagaccuagcagacuacuucugccaacaauacuccucauacccacuaacauucggagcaggaacuucacuagaacucaaacgaacaguagcagcaccaucaguauucauauucccaccaucagacgaacaacuaaaaucaggaacagcaucaguaguaugccuacuaaacaacuucuacccaagagaagcaaaaguacaauggaaaguagacaacgcauuacaaucaggaaacucacaagaaucaguaacagaacaagacucaaaagacucaacuuacagccuaaguucaacacuaacacuaucaaaagcagacuacgaaaaacacaaaguauacgcaugcgaaguaacacaccaaggacuaucaucaccaguaacaaaaucauucaacagaggagaaugc

SEQ ID NO: 46562 - RNA, 1350 nt, Artificial Sequence
  derived and/or modified sequence opt6 from Pritumumab_HeavyChain1
gaaguacaauuacuagaaucaggaggagauuuaguacaacccggaggaucucuaagauuauccugcgcagccucaggauuuacauucuccaacuacgcaauguccuggguacggcaagcgccaggaaaaggacuagaauggguaagcgcaauaacuccaucaggaggcucaacaaacuacgcagacucuguaaaaggaagauucacaauauccagagacaauucacaaaauacuuuauaccuucaaaugaacucccuccgaguugaagauacagcaguauacauaugcggacgaguuccguacagaucaaccugguauccucuauacuggggucaaggaacccuaguaacagucucauccgcaucaaccaaaggaccaucaguauucccacuagcaccaagcucaaaguccaccucagguggcaccgcagcauuaggauguuuaguaaaagacuacuuuccagaaccaguaacagucucauggaacucuggagcauuaacaucaggugugcacacauucccagcaguacuacaaucaucuggauuauauucacuauccucaguaguaacuguaccaucaagcucacuaggaacacaaacauacauuugcaauguaaaccauaaaccaucuaauaccaaaguagauaaaaaaguagaaccaaaaucaugugacaaaacacacacaugcccaccauguccugcaccagaacuauuaggcggaccauccgucuuccuauuuccaccaaaaccuaaagacaccuuaaugauaagcagaacacccgaaguaacauguguaguaguagauguuucacaugaagauccagaagucaaauuuaacugguacguagacggcguugaaguacauaacgcaaaaacaaaaccaagagaagaacaauauaauucgaccuacagaguaguaucuguacucacaguuuuacaccaagacuggcuaaacggaaaagaauacaaaugcaaaguaucaaacaaagcacuaccagcacccauugaaaaaacuauaucaaaagcuaaaggacaaccuagagaaccacaaguauacacacuaccacccucaagagaugaacuaacaaaaaaccaaguauccuuaaccugucucguaaaaggauuuuauccaucugacauagcuguagaaugggaaaguaacggacaaccugaaaacaauuauaaaacuacuccucccguacuagacucagauggaucuuuuuuccuauauucaaaacuaacaguagauaaaucaagauggcaacaaggaaauguauucagcugcaguguaaugcaugaagcacuacauaaucacuacacccaaaaaucccuaucauuauccccuggaaaa

SEQ ID NO: 46563 - RNA, 642 nt, Artificial Sequence
  derived and/or modified sequence opt6 from Pritumumab_LightChain1
gacauacaaaugacacaaucaccaucaucacuuucagcauccguaggagaccgaguaaccauaacaugcagagcaucacaagacauauccaauuaccuagcaugguuccaacaaaaaccaggaaaagcaccaaaaucacuaauauaugccgcaucaucacuacacuccaaaguaccaacacaauucucaggaucaggcuccggaacagacuucacccuaaccauaucaucauuacaaccagaagacuucgcaacauacuacugccuacaauacuccacauacccaauaacauucggaggaggaacaaaaguagaaauaaaaagaacaguagcagcaccaucuguauucauauucccaccaucagacgaacaacuaaaaucaggcacagcaucaguaguaugcuuacuaaacaacuucuacccaagagaagcaaaaguacaauggaaaguagacaacgcacuacaaucaggaaauucacaagaaucaguaacagaacaagacucaaaagacucaacauacucauuaucaucaacauuaacccuauccaaagcagacuacgaaaaacacaaaguauacgcaugcgaaguaacacaccaaggacuauccucaccuguaacaaaaucauucaacagaggcgaaugc

SEQ ID NO: 46564 - RNA, 1341 nt, Artificial Sequence
  derived and/or modified sequence opt6 from Quilizumab_HeavyChain1
gaaguacaacucguagaaucuggcggcggucuaguacaaccaggaggcucucuaagacuaucaugcgcugcauccggauucacauucucagacuacggaauagcuuggguaagacaagcaccaggaaaaggacuagaauggguagcauucauaucagaccuagcauacacaauuuacuacgcagacaccguaacaggccgauucacuauaucuagagauaauucaaaaaauacacuauaccuacaaaugaauucuuuaagagcagaagacacagcaguauacuacugcgccagagacaacugggacgcaauggauuacuggggucaaggcacacuagucacaguaucaucagcaucaacaaaaggaccaagcgucuuuccauuagcuccaucauccaaaucaacauccggaggcacagcagcauuagguugccucgucaaagacuauuuuccagaaccuguaacaguaucauggaacucaggagcccucaccuccgguguccauacuuucccugcaguauuacaauccucuggauuauacucccucucuucaguaguaacaguuccuaguucaucccuaggaacacaaacauauauaugcaacguuaaccacaaaccaucaaacacaaaagucgacaaaaaaguugaaccuaaaucaugugauaaaacacauacuugcccaccuugcccagcaccagaacuacuaggcggaccaucaguuuuccuauuccccccaaaaccaaaagauacauuaaugaucucaagaacaccagaagugacaugcguaguuguagacguaucucaugaagacccugaaguuaaauucaauugguauguagauggaguagaaguacacaacgcaaaaacuaaaccaagagaagaacaguacaacucaacauacagaguaguaagcguauuaacaguacuacaucaagacugguuaaauggcaaggaauauaaaugcaaaguaaguaauaaagccuuaccugcaccaauagaaaaaacaauaucaaaagccaaaggccaaccaagagaaccacaaguauacacacuaccaccauccagagaagaaaugacaaaaaaccaaguuucacuaaccugucuaguaaaaggauucuauccaucugacauagcuguagaaugggaaucaaacggucaaccagaaaacaauuauaaaacaacaccacccguacucgacucugacggcucauucuuuuuauauucaaaauuaacaguugauaaaucaagauggcaacaaggaaacgucuucaguugcagcguaaugcaugaagcacuccacaaucauuauacacaaaaaagccuaucacuaucaccaggaaaa

SEQ ID NO: 46565 - RNA, 657 nt, Artificial Sequence
  derived and/or modified sequence opt6 from Quilizumab_LightChain1
gacauacaaaugacacaaucaccaucaucacuaucagcauccguaggagaccgaguaacaauaacaugcagaucaucacaaucauuaguacacaacaacgcaaacacauaccuacacugguaccaacaaaaaccuggaaaagcaccaaaacuacuaauauauaaaguauccaacagauucucaggagucccaucaagauucucaggaucaggaucaggaacagauuucacauuaacaauauccucacuccaaccagaagacuucgcaacauacuacugcucacaaaacacacuaguaccauggaccuucggacaaggaacaaaaguagaaauaaaaagaacaguagcagcaccaucaguauucauauuuccaccauccgacgaacaauuaaaaucaggaacagcaucaguaguaugccuacucaacaacuucuacccaagagaagcaaaaguacaauggaaaguagacaacgcauuacaaucuggcaacucccaagaaucaguaacagaacaagacuccaaagacucaacauacucacucucaucaacacuaacacuaucaaaagcagacuacgaaaaacacaaaguauacgcaugcgaaguaacacaccaaggccuaucaucaccaguaacaaaaucauucaacagaggagaaugc

SEQ ID NO: 46566 - RNA, 1335 nt, Artificial Sequence
  derived and/or modified sequence opt6 from Racotumomab_HeavyChain1
caaguacaacuacaacaaaguggagcagaacuaguaaaaccaggagcaucaguaaaauuaucaugcaaagcaucagguuacacauuuacuucauaugauauaaauuggguacgacaaagaccagaacaaggauuagaauggauaggauggauauucccaggagacggcucaaccaaauacaaugaaaaauucaaaggaaaagcaacacuaacaacagacaaaucaucuuccacagcauacaugcaacuaagccgauuaacaucagaagauuccgccguauacuucugcgcacgagaagacuacuacgacaauucauauuacuuugauuacuggggacaaggaacaacacuaacaguauccucagcuaaaaccacaccaccaucagucuacccacuagccccaggcucagcagcacaaacaaacuccaugguaacauuaggcugccucguuaaaggauacuucccagaacccguaacagucacauggaacucaggaucacuaucaaguggcguacauacauucccagcaguacuacaaucagaccuauacacauuaucaaguucagucacaguaccuagcucaccaagaccauccgaaacaguuacauguaacguugcccacccagcuuccuccacaaaagucgacaaaaaaauuguaccaagagauugcggcugcaaaccaugcauaugcacaguaccagaagucucaagcguauucauauuuccaccaaaaccaaaagacguauuaacaauaacauuaacaccaaaagucacaugcguagucgucgauauuagcaaagacgacccagaaguccaauuuucaugguucgucgaugacgucgaaguccacacagcacaaacccaaccaagagaagaacaauuuaacucaacauucagauccguauccgaacucccaaucaugcaccaagauuggcucaauggaaaagaauucaaaugccgaguaaacucugccgcauuuccagcaccaauagaaaaaacaauaagcaaaacaaaaggcagaccaaaagcaccacaaguuuacacaauaccaccuccaaaagaacaaauggcaaaagauaaaguaucacuaacaugcaugauaacagauuucuucccagaagacauaacaguagaauggcaauggaacggacaacccgcagaaaauuauaaaaacacacaaccaauuaugaacaccaauggcucauacuuugucuacucaaaacuaaacguacaaaaauccaauugggaagcuggcaauacauucacaugcuccguuuuacaugagggauuacacaaucaccacacagaaaaaucacuaucacacucaccaggaaaa

SEQ ID NO: 46567 - RNA, 642 nt, Artificial Sequence
  derived and/or modified sequence opt6 from Racotumomab_LightChain1
gacauacaaaugacacaaacaacaucaucacuaucugcaucauuaggagacagaguaacaauaucaugcagagcaucacaagacauaucaaacuaccuaaacugguaccaacaaaaacccgacggaacaguaaaacuacuaauauacuacacauccagauuacauucaggaguaccaucaagauucucaggaucaggaucaggaaccgacuacagcuuaacaauaucaaaccuagaacaagaagauauagcaacauacuucugccaacaaggaaacacacuaccauggacauucggcggaggaacaaaacuagaaauaaaaagagcagacgcagcaccaacaguaucaauauucccuccaucaucagaacaauuaacaucaggcggagcaucaguaguaugcuuccuaaacaacuucuacccaaaagacauaaacgucaaauggaaaauagacggauccgaaagacaaaauggaguacuaaacucauggacagaccaagacucaaaagacucuacauacucaaugagcucaacacuaacuuuaacaaaagacgaauacgaaagacacaacucauacacaugcgaagcaacacacaaaacaucaacaucacccauaguaaaaucauucaacagaaacgaaugc

SEQ ID NO: 46568 - RNA, 1089 nt, Artificial Sequence
  derived and/or modified sequence opt6 from Racotumomab_scVH-VH'-VH_chain
gaaguacaauugguagagucaggaggaggguuaguacaaccaggaggaucauuaagacuaagcugugcagcaaguggauucacauuuagugauuacuggauguacuggguaagacaagcacccggaaaaggacuagaauggguaucagaaauaaacacuaauggacuaauaacaaaauacccagauagcguaaaaggaagauuuacaauaagcagagacaaugcaaaaaacacacuauauuuacaaaugaauagcuuaagaccagaagauacagcaguauacuauugugcaagaucaccaaguggauucaauagaggacaaggaacauuagucacaguuagcaguggaggaggaggaaguggaggaggaagugaaguacaauuaguagaaagcggaggaggacuuguacaaccagguaauucauuacgauuaagcugugcagcaagcgguuuuacauuuaguaguuuuggaaugucauggguaagacaagcaccaggaaaaggauuagaauggguaucaucaauuaguggcaguggaagugacacacuauaugcagacucuguuaaaggaagauuuacaauaagcagagauaaugcaaaaacaacacuauauuuacaaaugaauagcuuaagaccagaagauacagcaguguauuauugcacaauaggaggaaguuuaaguagaaguagucaagguacuuuaguaacaguaagcucaggaggaggagguucagggggaggaagugaaguacaauuaguagaaagugguggaggauugguacaaccaggaggcagccuaagauuaagcugcgcagcaaguggauucacauuuagugauuauuggauguauuggguaaggcaagcaccagguaaaggauuagaguggguuagugaaauaaacacaaaugguuugauaacaaaauauccagauuccguuaaaggcagauuuacaauaucacgagauaaugcaaaaaauacauuauaucuacaaaugaauagucugagaccagaagauacagcugucuauuauugugcaagaagcccaagugguuuuaauagaggacaaggaacauuaguaacaguaagcagu

SEQ ID NO: 46569 - RNA, 1071 nt, Artificial Sequence
  derived and/or modified sequence opt6 from Radretumab_HeavyChain1
gaaguacaauuacuugaaagugguggaggauuaguacaaccaggagguuccuuaagacuaaguugcgcagcaagcggauuuacauuuaguucauucucaaugucauggguaagacaagcaccaggaaaaggauuagaauggguaucauccauuaguggaucaucuggaacaacauauuaugccgauagugucaaaggaagauuuacaauaagucgagauaacaguaaaaauacauuauauuuacaaaugaacucauuaagagcagaagauacagcuguauauuauugugcaaaaccauuucccuauuucgacuauuggggucaaggaacauuaguaacaguaucaaguggagauggaaguuccggagguagcggaggagcaucagaaauaguacucacacaaucacccggaacauuaucauuaucuccaggagaaagagcaacauuaagcuguagagcaagucaaaguguaaguucaucauuuuuagccugguaucaacaaaaaccaggucaagcgccacgauuauuaauauauuaugcaucaucaagagccacaggaauaccagacagauuuaguggaucaggaucagguacagauuuuacacuaacaauaaguagauuagaaccugaggauuucgcuguuuauuacugucaacaaacaggaagaauaccuccaacauuuggacaaggaacaaaaguugaaauaaaaucaggagggucaggaggaccaagagcagcaccagaaguauaugcauuugcaacaccagaauggccuggaucaagagauaaaagaacacuagcuugucuaauacaaaauuucaugccugaagauauuucaguacaauggcuacauaacgaaguacaacuaccugaugcaagacacucaacaacacaaccaagaaaaacaaaaggaucaggauuuuucgucuuuucaagauuagaaguaacucgagcagaaugggaacagaaagaugaauucauauguagagcaguacaugaagcagccaguccgagucaaacgguacaaagagcaguaucaguaaacccagaaucaucaagaagaggaggaugu

SEQ ID NO: 46570 - RNA, 414 nt, Artificial Sequence
  derived and/or modified sequence opt6 from Radretumab_j_chain
ggagaugacgaagcaacaauauuagcagauaacaaaugcaugugcacaagaguaacaucacgaauaauaccaaguacagaagauccaaaugaagauauaguagaaagaaacauaagaauaguaguaccauuaaacaauagagaaaacauaagcgauccaacaagcccacuaagaagaaauuucguuuaccaucuaucagacguaugcaaaaaaugugacccaguagaagucgaacuagaagaccaaguaguaacagcaacacaaagcaauauauguaacgaagacgauggaguaccagaaacauguuacauguacgauagaaauaaauguuacacaacaaugguaccacuaagauaccauggagaaacaaaaaugguacaagcagcauuaacaccagacucaugcuauccagau

SEQ ID NO: 46571 - RNA, 1368 nt, Artificial Sequence
  derived and/or modified sequence opt6 from Rafivirumab_HeavyChain1
caaguacaacuaguccaaucaggagccgaaguaaaaaaaccaggaagcucuguaaaaguaucaugcaaagcauccgggggaacauucaacagauacacaguaaacuggguacgacaagcaccaggacaaggauuagaauggaugggcggaauaauacccauuuucggaacagcaaacuacgcacaaagauuccaaggacgacuaacaauaacugcagacgaaucuacaucaaccgcauauauggaacuaucaaguuuaagaucagaugacacagcaguauacuucugugccagagaaaauuuagacaauucaggaacauacuacuauuuuagcggaugguuugacccauggggacaagguacacuaguaacaguaucauccgcaucaaccaaaggaccuucugucuuuccacuagcaccaucauccaaauccacaucuggcggcacagcagcuuuaggcugucuagucaaagacuauuucccugaaccagucaccguaucauggaacucaggagcacuaacauccggcguucauacauuuccagccguacuacaaucaaguggauuauacuccuuaucaaguguaguaacaguaccaucaucaucacuaggaacccaaacauauauauguaacguaaaccacaaaccaucaaauacaaaaguagauaaaagaguagaaccaaaaucaugcgauaaaacacacacaugccccccaugcccagcaccagaacucuuaggcgguccaagcguauucuuauucccacccaaaccuaaagacacccuuaugauuucaagaacaccagaagucacaugcguaguaguagauguaucacacgaagaucccgaaguaaaauuuaacugguacguagaugguguugaaguacauaacgccaaaaccaaacccagagaagaacaauacaacucaacauaucgcgucgucuccguacuaaccguacuacaucaagauuggcuuaacggaaaagaauauaaaugcaaagucucaaacaaagcccuaccagcccccauagaaaaaacaauaucuaaagcaaaaggccaaccaagagaaccacaagucuacacacuaccaccaucaagagaagaaaugacaaaaaaccaaguaucacuaacaugcuuaguaaaaggauucuacccauccgacauagcuguagaaugggaaucaaacggacaaccugaaaacaacuacaaaacaacaccaccaguacuagacucagacggaucauucuuccucuauuccaaacuaacaguugacaaauccagauggcaacaagguaacguauucucaugcaguguaaugcacgaagccuuacauaaucacuacacccaaaaauccuuaucauuaucuccagga

SEQ ID NO: 46572 - RNA, 1368 nt, Artificial Sequence
  derived and/or modified sequence opt6 from Rafivirumab_HeavyChain
gaaguccaauuaguacaaucaggcgcagaaguaaaaaaaccugguucaucaguaaaagucagcuguaaagcaucaggugguacauucaacagauauacaguaaacuggguuagacaagcaccaggacaaggacuagaauggauggguggaauaauaccaauauuuggaacagcaaacuacgcacaaagauuccaaggaagauuaacuauuacagcagacgaaucaacaucaaccgcauauauggaacuaucauccuuaagaucagacgacaccgcaguauauuucugcgcccgugaaaaccuagauaauucaggaacauacuauuauuuuuccgguugguuugauccauggggacaagguacauuaguaacaguaucuucagcaucaacaaaaggaccauccgucuuuccauuagcuccaagcuccaaaucaacaucaggaggaacagcagcacucggcugccuagucaaagacuauuucccagaaccaguaaccguauccuggaacaguggagcauuaacaucaggaguacauacauuuccagcaguucuacaauccucaggacuauacucucuaucaucaguaguaacaguaccaucaucuucacuaggaacucaaaccuacauauguaacguaaaucauaaacccuccaauaccaaaguagacaaacgcguagaacccaaaucaugcgacaaaacacacaccuguccucccugcccagcaccugaauuacuaggcggcccaucaguauucuuauucccuccaaaaccuaaggauacacuaaugauaucaagaacaccugaaguaacaugcgucguaguagacguaucccacgaagacccagaaguaaaauuuaauugguacguagacggcguagaaguacacaacgcaaaaacaaaaccacgagaagaacaauauaacucaacauacagaguaguaucaguacuaacaguuuuacaucaagacuggcuaaauggaaaagaauacaaauguaaaguauccaacaaagcacucccagcaccaaucgaaaaaaccauaucaaaagcaaaaggacaaccacgagagccacaagucuacacauuaccaccaucacgcgaagaaaugacaaaaaaucaaguaaguuuaacaugucuagugaaaggcuucuacccuuccgauaucgcaguagaaugggaaucaaauggacaaccagaaaacaacuacaaaacaacaccaccaguacuagacucagacggcucauuuuuucuauacucaaaauuaaccguagacaaaucaagauggcaacaagguaacguauuuucauguucuguaaugcaugaagcauuacacaaccauuacacacaaaaaucauuaucauuauccccugga

SEQ ID NO: 46573 - RNA, 654 nt, Artificial Sequence
  derived and/or modified sequence opt6 from Rafivirumab_LightChain1
caaucagcacuaacacaaccaagaucaguauccggaucaccaggacaaucaguaacuauaucaugcacaggaaccagcuccgacauaggaggauacaacuucguaucaugguaccaacaacacccaggaaaagcaccaaagcuaaugauauacgacgcaacaaaaagaccaucaggaguaccagacagauucucaggaucaaaaucaggaaacacagcaagcuuaacaauaucaggacuacaagcagaagacgaagcagauuacuacugcugcaguuaugcaggagacuacacaccaggaguaguauucggaggaggaacaaaacuaacaguacuaggacaaccaaaagcagcuccaucaguaacauuauuccccccauccucagaagaacuacaagcaaauaaagcaacacuaguaugccuaauauccgacuucuacccaggagcaguaacaguagcauggaaagcagauucaucaccaguaaaagcaggaguagaaacaacaacaccaucaaaacaaucaaacaacaaauacgcagcaucaucauaccuaucacuaacaccagaacaauggaaaucacauagaaguuauucaugccaaguaacacacgaagggucaacuguagaaaaaacaguagcacccaccgaaugcuca

SEQ ID NO: 46574 - RNA, 654 nt, Artificial Sequence
  derived and/or modified sequence opt6 from Rafivirumab_LightChain
gaaucagcacuaacacaaccaagaucagucucaggaucaccaggacaaucaguaacaauaucaugcacaggaacaucauccgacauaggcggauacaacuucgucucaugguaccaacaacacccuggaaaagcaccaaaauuaaugauauacgacgcaacaaaaagaccaagcggaguaccagacagauucucuggaucaaaaucaggaaacaccgcaucacuaacaauaucaggauuacaagcagaagacgaagcagacuacuacuguugcucauacgcaggagacuacacacccggaguaguauucggaggaggaacaaaacuaacaguauuaggacaaccaaaagcagcaccaucaguaacacuauuuccaccaucaucagaagaacuacaagcaaacaaagcaacccuagucugccuaauaucagacuucuacccaggagcaguaacaguagcauggaaagcagacucaucaccaguaaaagcaggaguagaaacaacaacaccaucaaaacaaaguaacaacaaauacgcagcaucaagcuacuuaucauuaacaccagaacaauggaaaucacacagaucauacucaugccaaguaacacacgaaggaucaacaguagaaaaaacagucgcucccacagaaugcagc

SEQ ID NO: 46575 - RNA, 1332 nt, Artificial Sequence
  derived and/or modified sequence opt6 from Ralpancizumab_HeavyChain1
caaguacaacucguacaaucaggcgcagaaguaaaaaaaccaggagcuuccguaaaaguauccugcaaagcauccggauacaccuucacaucauacuauaugcacuggguaagacaagcucccggccaaggauuagaauggaugggagaaauccaccccucaggaggaagaacaaauuauaacgaaaaauuuaaaucuagaguaacaaugacaagagacacaucuacaucaaccguauauauggaacuaagcucacuaagaucagaagacaccgcaguauauuauugcgcuagagaaagaccacuauacgccucagauuuauggggacaaggaacaacaguaacaguauccucagcuagcacaaaaggacccucaguauuuccauuagcaccauguucacgaucaaccucugaaucaacugcagcacuaggaugccuaguaaaagacuauuucccagaaccaguaacugucucauggaacuccggagcacuaacaaguggaguacacacauuuccugcaguacuccaaucuucaggacuuuacuccuuaucauccguaguaacaguacccucaucaaacuucggaacacaaacauacacaugcaacguagaucacaaaccaucaaacacaaaaguugacaaaacaguagaaagaaaaugcugcguagaaugcccacccugcccugcaccucccgucgcaggaccaucaguuuuuuuauucccacccaaaccaaaagacacacucaugauuucaagaaccccagaaguuacaugcguaguaguagacguaucacacgaagacccagaaguucaauuuaauugguaugucgauggaguagaaguacacaacgccaaaaccaaaccaagagaagaacaauuuaauucaacauuccgaguaguaucagucuuaacagucguucaccaagacuggcuaaacgguaaagaauacaaauguaaaguaucaaauaaaggauuaccauccucaauugaaaaaacaauaucuaaaacaaaaggacaaccacgagaaccacaaguuuacacacuaccaccaucuagagaagaaaugacaaaaaaccaagucucccuaacaugccuaguuaaaggauuuuaucccucagauauagcaguugaaugggaaucaaacggacaacccgaaaacaacuacaaaacaacccccccaaugcucgacucagacggauccuuuuuccuauauucaaaauuaacaguagacaaaucacgcuggcaacaaggaaacguauucucauguucaguaaugcaugaagcauuacacaaccacuauacucaaaaauccuuaucauuaaguccagguaaa

SEQ ID NO: 46576 - RNA, 642 nt, Artificial Sequence
  derived and/or modified sequence opt6 from Ralpancizumab_LightChain1
gacauacaaaugacucaaucaccaucaucacuauccgcaagcguaggagacagaguaaccauaacaugcaaagcaagccaagacguacacacagcaguagcaugguaccaacaaaaaccaggaaaagccccaaaacuacuaauauaccacgcaucauaucgauauacaggagucccaucccgauucucaggaucaggauccggaacagacuucacuuucacaauaucaucauuacaaccagaagacauagcaacauacuacugccaacaaagauacucacuauggagaacauucggacaaggaacaaaacuagaaauaaaaagaacaguagccgcaccauccguauucauauucccaccaucagacgaacaauuaaaaucaggaacagccucagucguaugccuacuaaacaacuucuacccacgugaagcaaaaguacaauggaaaguagacaacgcacuacaaagcggaaacucacaagaaucaguaacagaacaagacucaaaagacucaacauacagccuauccucaacacuaacauuaucaaaagcagacuacgaaaaacacaaaguauacgcaugcgaaguaacacaccaaggauuaucaucaccaguaacaaaaucauucaacagaggcgaaugu

SEQ ID NO: 46577 - RNA, 1338 nt, Artificial Sequence
  derived and/or modified sequence opt6 from Ramucirumab_HeavyChain1
gaaguacaauuaguacaaucuggaggaggucuaguaaaaccaggaggaucauuaagacuaucaugcgcagcaucagguuuuacauucucaucguauuccaugaauuggguaagacaagcacccgguaaaggacuagaauggguaucaagcauaucaucaucaucuucuuacauauacuacgcagacaguguaaaaggaagauuuacaaucuccagagacaacgccaaaaacucccuauacuuacaaaugaacucacuuagggcagaagacacagccguauacuauugugcacgaguaacagaugcauuugacauauggggccaaggaacaaugguaacaguauccucagcaucuacaaaaggaccaucaguauucccucuagcaccaucaucaaaauccacuucuggaggaaccgcagccuuaggaugucucguaaaagauuacuucccagaacccguaacuguauccuggaacucaggugcauuaacuaguggaguacacacauuuccugcaguauuacaauccuccggucuauacucuuuauccucaguaguaacaguaccaucaucaucauuaggaacacaaaccuacauaugcaacguaaaccacaaaccaucaaacacaaaaguagacaaaaaaguagaaccaaaauccugcgacaaaacccauacauguccaccaugcccugccccagaacuacucggaggcccaucuguuuucuuauucccuccuaaaccaaaagacacauuaaugauaucaagaacuccagaagucacaugcguaguaguagacgucucccacgaagacccagaaguaaaauucaacugguacguagauggugucgaaguacauaaugcaaaaaccaaaccaagagaagaacaauacaauuccacauauagaguaguaagcguauuaaccguucuacaccaagauugguuaaacggaaaagaauacaaaugcaaaguaucaaauaaagcacuaccagcaccaauagaaaaaacaauauccaaagccaaaggacaaccaagagaaccucaaguauauacacuaccaccaucaagggaagaaaugacaaaaaaccaaguaucacuaacaugccucgucaaaggauuuuaccccucagacaucgccguagaaugggaauccaacggacaaccugaaaacaacuacaaaacaacaccaccaguacuagacucagacggaucauucuucuuauacucgaaacuaacaguagauaaaucaagauggcaacaaggaaacguuuucucaugcucaguuaugcacgaagcacuacauaaucacuacacucaaaaaucauuaucccuaagucccggaaaa

SEQ ID NO: 46578 - RNA, 642 nt, Artificial Sequence
  derived and/or modified sequence opt6 from Ramucirumab_LightChain1
gauauccaaaugacacaaucaccaucaagcguaagugcaagcauaggagaucgaguaaccauaacauguagagcaagccaaggaauagacaauuggcuaggaugguaccaacaaaaaccaggaaaagcaccaaaacucuuaauauaugacgcaagcaaucuagacaccggaguaccaagcagauucucaggaucaggcucaggaacauacuuuacauuaacaauaagcucacuacaagcagaagacuuugcaguauacuuuugccaacaagcaaaagcauucccacccacauucggaggagguacaaaaguagauauaaaaggaacaguagcagcaccaagcguauucauauucccaccaucugacgaacaauuaaaaucaggaacagcaucugucguauguuuacuaaauaacuucuacccacgagaagcaaaaguacaauggaaaguagauaacgcacuacaaagcggaaacucacaagaaucaguaacagaacaagauaguaaagacucaacauauagcuuaaguucaacauuaacauuaagcaaagccgauuacgaaaaacauaaaguauacgcaugcgaaguaacacaccaaggacuaaguucacccguaacaaaaaguuuuaacagaggcgaaugc

SEQ ID NO: 46579 - RNA, 687 nt, Artificial Sequence
  derived and/or modified sequence opt6 from Ranibiziuab_HeavyChain1
gaaguacaacuaguagaaucaggaggcggauuaguccaaccaggcggaagccuacgauuaucaugugcagccucaggauacgauuucacucacuauggaaauuggguaagacaagcaccaggaaaaggauuagaauggguaggauggauaaacacuuacacaggagaaccaacauacgcagcagacuucaaaagaagauuuacauucucauuagauacaaguaaaucaacagcauaccuccaaaauucauuaagagcagaagauacagcaguauauuauugugcaaaauacccauacuauuacgguacaucacauugguacuuugacguauggggacaaggaacauuaguaacaguaucaucagcaucaacaaaagguccaucaguauuuccacuagcaccaucaucaaaaucaacaucaggaggaaccgcagccuuaggcugcuuaguaaaagacuacuuuccagaaccaguaacaguaucauggaacucaggagcacuaacaagcggaguacauacauuuccagcaguauuacaaucaucaggccuauauucauuaucaucagucguaacaguaccaucaucaucauuaggaacacaaacauauauauguaacguaaaccauaaaccaucaaauacaaaaguagauaaaaaagucgaaccaaaaucaugugacaaaacacauuua

SEQ ID NO: 46580 - RNA, 642 nt, Artificial Sequence
  derived and/or modified sequence opt6 from Ranibiziuab_LightChain1
gacauacaacuaacacaaucaccaucaucacuaagcgcauccguaggagacagaguaacaauaacaugcucagcaucacaagacauaucaaacuacuuaaacugguaccaacaaaaaccaggcaaagcuccaaaaguacuaauauacuucacaucaucacuacacuccggaguaccaucucgauuuucaggaucaggaucaggaacagacuucacacuaacaauaucaucacuacaacccgaagacuucgcaacauacuacugccaacaauacuccacaguaccauggacauucggacaaggaacaaaaguagaaauaaaaagaacaguugcagccccaucaguauucauauuuccacccucagacgaacaauuaaaaucaggaacagcaucaguaguaugccuacucaacaacuucuauccaagagaagcaaaaguacaauggaaaguagacaacgcacuacaaucaggaaacucccaagaaucaguaacagaacaagacucaaaagacucaacuuauucccuaucaucaacacuaacacuauccaaagcagacuacgaaaaacacaaaguauacgcaugcgaaguaacccaccaaggacuaucaucacccguaaccaaaucauucaacagaggagaaugc

SEQ ID NO: 46581 - RNA, 639 nt, Artificial Sequence
  derived and/or modified sequence opt6 from Ranibizumab_fab_fragment
gacauacaacuaacacaaucaccaucaucauuaucugcaucaguaggagacagaguaacaauaaccugcucagcaucacaagacauaucaaacuaccuaaacugguaccaacaaaaaccaggaaaagcaccaaaagucuuaauauacuucacauccucacuacacuccggaguaccaucaagauucucaggaucaggaucuggaacagacuucacacuaacaauaucaucacuacaaccagaagacuucgccacauacuacugccaacaauacagcacagucccauggacauucggacaaggaacaaaagucgaaauaaaaagaacaguagcagccccaucaguauucauauucccacccucagacgaacaauuaaaaucaggcacagcaucaguaguaugccuacuaaacaacuuuuacccaagagaagcaaaaguacaauggaaaguagacaacgcccuacaauccggaaacucacaagaaucaguaacagaacaagacucaaaagacucaaccuacucccuaucauccacacuaacauuaucaaaagcagacuacgaaaaacacaaaguauacgcaugcgaaguaacacaccaaggacuaucaucaccaguaacaaaauccuucaacagaggagaa

SEQ ID NO: 46582 - RNA, 693 nt, Artificial Sequence
  derived and/or modified sequence opt6 from Ranibizumab_HeavyChain
gaaguacaauuagucgaaucaggaggaggacuaguacaaccaggaggaucauuaagauuaagcugcgcagcaucaggauacgacuucacacacuauggaaugaacuggguaagacaagcaccaggaaaaggauuagaauggguaggauggauaaauacauauacaggcgaaccaacauaugcugcugacuuuaaaagaagauuuacauuuucauuagacacaaguaaaucaacagcauaucuacaaaugaauucauuaagagcugaagauacagcaguauauuacugugcaaaauacccuuauuauuacggaacaucacacugguacuuugacguauggggacaaggaaccuuaguaacaguaucaucagccucaacaaaagguccaucaguauuuccacuugcaccaucaucaaaaucaacaucuggaggaacagcugcauuaggaugucuaguaaaagauuacuucccagaaccaguaacaguaucauggaacucuggagcacuaacaucaggaguacacacauuuccagcaguauuacaaucaucaggacuauauagcuuaucaucuguaguaacaguaccaaguucaucacuaggaacacaaacauauauauguaacguaaaccauaaaccaucaaauacaaaaguagauaaaaaaguagaaccaaaaucaugugacaaaacacauuua

SEQ ID NO: 46583 - RNA, 654 nt, Artificial Sequence
  derived and/or modified sequence opt6 from Ranibizumab_LightChain
gaaguacaauuaguggaaucaggaggaggauuaguacaaccaggaggaucauuaagacuaucaugugcagcaucaggcuacgauuucacacacuauggaaugaacuggguaagacaagcaccaggaaaaggacuagaauggguaggauggauaaauaccuauacaggagaaccaacauaugcagcagacuuuaaacgaagauuuacauucucauuagacacaucaaaaucaacagcauauuuacaaaugaauucauuacgagcagaagauacagccgucuauuacugcgcaaaauauccauacuauuauggaacaucacacugguacuuugacguauggggacaaggaacacuaguaacaguaucaucagcaucaacaaaagguccaucaguauuuccauuagcaccaucaggaacagcugcauuaggaugucuaguaaaagauuauuuuccagaaccaguaacaguaucauggaacucaggagcacuaacaucaggaguacauacauuuccagcaguauuacaaucaucaggacuauauucauuaucaucaguaguaacaguaccaucaucaucacuaggaacacaaacauauauaugcaacguaaaccauaaaccaucaaauacaaaaguagauaaaaaaguagaaccaaaa

SEQ ID NO: 46584 - RNA, 642 nt, Artificial Sequence
  derived and/or modified sequence opt6 from Ranibizumab_LightChain_variant
gacauacaauuaacacaauccccaucaucauuaucagcauccguaggagauagaguaacaauaacauguucagcaucacaagacauaucaaacuaccuaaacugguaccaacaaaaaccaggaaaagcaccaaaaguacuaauauacuucacaucaucacuacacucaggaguaccauccagauucucaggaucaggaucaggcacagacuucacauuaacaauaucaucacuccaaccagaagacuucgccacauacuacugccaacaauacucaacaguaccauggacauucggacaaggaaccaaaguagaaaucaaacgcacaguagcagccccaucaguauucauauucccaccaucagacgaacaauuaaaaucaggaacagcaucaguaguaugcuuauuaaacaacuucuauccaagagaagccaaaguacaauggaaaguugauaacgcccuacaaucaggaaacucacaagaaaguguaacagaacaagacagcaaagacucaacauacucacuaagcucaacacuaacacuaucaaaagcagacuacgaaaaacacaaaguauacgccugcgaaguaacacaccaaggacuauccuccccaguaacaaaaucauucaacagaggagaaugc

SEQ ID NO: 46585 - RNA, 1368 nt, Artificial Sequence
  derived and/or modified sequence opt6 from Refanezumab_HeavyChain1
caaguacaacuaguccaaucuggaucagaacuaaaaaaaccuggugcaucaguaaaaguaucuuguaaagcaucaggauauacauucacaaauuacggaaugaacugggucagacaagcaccaggacaaggauuagaauggaugggauggauaaauaccuacacuggagaaccaacauaugcagacgauuucacaggaagauuuguuuuuucccuagacacaucaguaucaacagcauaccuacaaauaucuucccuaaaagcagaagacacagcaguauacuacugcgcaagaaauccaaucaauuacuacggcauaaacuacgaagguuauguaauggacuauuggggacaaggaaccuuaguaacaguauccuccgcaucaacuaaaggaccaagcgucuucccccuugcccccagcucaaaaucaaccucaggaggcacagcagcacuagggugccuaguuaaagacuacuucccagaaccaguuaccgucucauggaacucaggugcacuaaccucaggcguacacacauucccagcaguuuuacaaucaucuggcuuauauucacucucaucuguaguaacaguaccaucaucaucauuaggaacacaaacauauauauguaauguaaaccauaaaccaucaaacacaaaaguagacaaaaaaguagaaccaaaauccugcgacaaaacucauacauguccuccaugcccugcaccagaauuagcuggagcacccaguguauuccuuuucccaccaaaaccuaaagacacgcuaaugauaucacgaacuccagaaguaacaugcgucguaguagacguaucucacgaagauccagaaguaaaauucaacugguacguagacggaguagaaguacacaacgcaaaaacuaaaccaagagaagaacaauacaauucaaccuacagaguagucucaguucuaacaguauuacaucaagacuggcuaaauggaaaagaauauaaaugcaaaguaucaaacaaagcccuaccagcaccaauagaaaaaacaauaucuaaagcaaaaggacaacccagagaaccacaagucuacacauuaccaccauccagagacgaacucacaaaaaaucaaguaaguuuaacaugucuaguaaaaggauuuuauccaucugacauagcaguugaaugggaaucaaacggccaaccagaaaacaauuacaaaacaacaccacccguacuagauucugaugguucauucuucuuauacuccaaauuaacagucgacaaaucaagauggcaacaaggaaacguauuuucauguucaguaaugcacgaagcacuucacaaccacuacacccaaaaaucacucucuuuaucaccaggaaaa

SEQ ID NO: 46586 - RNA, 657 nt, Artificial Sequence
  derived and/or modified sequence opt6 from Refanezumab_LightChain1
gacauaguaaugacacaaucaccagacucacuagcaguaucacuaggagaaagagcaacaauaaacugcaaauccucacacucaguacuauacucaucaaaccaaaaaaacuacuuagcaugguaccaacaaaaaccaggacaaccaccaaaauuacuaauauacugggcauccacacgagaaucaggaguaccagauagauucuccggaucaggaucaggaacagacuucacacuaacaauaucaucacuacaagcagaagacguagcaguauacuacugccaccaauaccuaucuucauuaacauucggacaaggaacaaaauuagaaauaaaaagaacaguagcagcacccucaguauucauauucccacccucagacgaacaacuaaaaucaggaaccgcaucaguaguaugccuauuaaauaacuucuacccaagagaagcaaaaguccaauggaaaguagacaacgcacuacaaucagguaacucacaagaaucaguaacagaacaagacagcaaagacucaaccuauucacuauccucaacacuaacauuaucaaaagcagacuacgaaaaacacaaaguauacgcaugcgaaguaacacaccaaggccuaucaucacccguaacaaaaucauucaacagaggagaaugc

SEQ ID NO: 46587 - RNA, 1314 nt, Artificial Sequence
  derived and/or modified sequence opt6 from REGN2810_HeavyChain1
gaaguccaauuacuagaauccggcggaguucuaguacaaccuggaggaaguuuaagauuaucaugugcagcaucaggauuuacuuuuucaaacuuuggaacuugggucagacaagcaccuggaaaagguuuagaaugggucucaggaaucucaggaggaggaagagauaccuauuucgccgacucuguaaaaggaagauucacuauaucuagagauaacaguaaaaauacauuauacuuacaaaauucucuaaaaggagaagauacagcaguauauuauugcguaaaaugggguaacauauacuuugacuauuggggacaaggaacauuaguaacaguuucaucagcaucaacaaaaggaccaucaguauucccauuagccccauguucaagaucaacaucagaaucaacagcagcauugggaugucuaguaaaagauuacuuccccgaaccaguuacaguaagcuggaauucaggagcauuaacaucaggaguacauaccuuucccgcaguauuacaaucaaguggcuuauauucacuaucaucaguaguuacaguaccaucaagcucacucggaacaaaaacuuauacaugcaauguugaucacaaacccaguaauaccaaaguagacaaaagaguagaaucaaaauacggaccaccuuguccaccauguccagcuccagaauucuuaggaggaccaucagucuuucuauucccaccaaaaccaaaagauacuuuaauaaguagaacuccagaaguaacauguguaguaguagauguaucccaagaagacccagaaguacaauucaauugguauguagauggcgucgaaguacauaaugcaaaaacaaaaccacgugaagaacaauuuaacucaacauaucgcguaguaucaguauuaacaguauuacaucaagacugguuaaauggcaaagaauauaaaugcaaaguuucuaacaaaggacuuccaucaucaauagaaaaaacaauuucaaaagcaaaaggacaaccaagagaaccacaaguauacacucucccaccaucucaagaagaaacaaaaaaucaaguaucauuaacaugucuagucaaaggauucuacccaagcgacauagcaguagaaugggaaucuaauggacaaccagaaaauaacuacaaaacaaccccuccaguucuagacuccgacggcucuuucuuucucuacucaagacuaaccguagauaaaucacgauggcaagaaggaaacguauuuucauguucaguccacgaagcauuacacaaucacuacacacaaaaaucauuaucacuaucacuagga

SEQ ID NO: 46588 - RNA, 639 nt, Artificial Sequence
  derived and/or modified sequence opt6 from REGN2810_LightChain1
gacauacaaacacaaucaccaucaucccuaucagcauccgucggcgacucuauaaccauaacaugcagagcaucccuaucaauaaacacauuccuaaacugguaccaacaaaaaccaggaaaagcaccaaaccuccuaauauacgcagcaucaucacuacacggaggagucccaucaagauucucaggaucaggaucaggcacagacuucacauuaacaauaagaacacuacaaccagaagacuucgcaacauacuacugccaacaaucaucaaacaccccauucacauucggaccaggaacaguagucgacuucagaagaacaguagcagccccaucaguauucauauuccccccaucagacgaacaacuaaaaucaggaacagccucugucguaugccuacucaacaacuucuacccaagagaagcaaaaguacaauggaaaguagacaacgcacuucaaucaggaaacucacaagaaagcguaacagaacaagacucaaaagauuccacauacucauuauccucaacauuaaccuuaucaaaagcagacuacgaaaaacacaaaguauacgcaugcgaaguaacacaccaaggcuuaucaucaccaguaaccaaaucauucaacagaggagaaugc

SEQ ID NO: 46589 - RNA, 651 nt, Artificial Sequence
  derived and/or modified sequence opt6 from rhuMab_HER2(9CI)_LightChain
guacacucagacauacaaaugacacaaucaccaucaucacuaucagcauccguaggagacagaguaacaauaacaugcaaagcaucacaagacguaucaauaggaguagcaugguaccaacaaaaaccaggaaaagcaccaaaacuacuaauauacuccgcaucauacagauacacaggcguaccaucaagauucucaggauccggaucaggaacagacuucacacuaacaauauccucauuacaacccgaagacuucgcaacauacuacugccaacaauacuacauauacccauacacauuuggacaaggaacaaaaguugaaauaaaaagaacaguagcagcaccaucaguauucauauucccacccucagacgaacaacuaaaaucaggaacagcaucagucguaugccuacuaaacaacuucuacccaagagaagcaaaaguacaauggaaaguagacaacgcccuacaaaguggaaacucacaagaaucaguaaccgaacaagacuccaaagacucaacauacucacuaucuucaaccuuaacccuauccaaagcagacuacgaaaaacacaaaguauaugcaugcgaagucacacaccaaggacuaucaucaccaguaacaaaaucauucaacagaggagaaugc

SEQ ID NO: 46590 - RNA, 1215 nt, Artificial Sequence
  derived and/or modified sequence opt6 from rhuMab_HER2_HeavyChain
gaaguacaauuagucgaaucaggaggaggacuaguacaaccaggaggaagcuuaagauuaucaugugcagcaucaggcuucacauucacagacuauaccauggacuggguaagacaagcaccagguaaaggacuuacagcagucuacuauugcgcccgcaacuuaggaccaucauucuauuuugauuauuggggacaaggaacauuaguaacaguaagcucugcaucaacaaaaggcccauccguauuuccauuagcaccaucuaguaaaucaacuuccggaggaacagcagccuuagguugucuaguuaaagacuauuuccccgaaccagucacaguaucauggaacagcggagcacuaaccucuggaguacauacuuucccugcaguauuacaaucaucaggcuuauacucacuaucaucaguaguaacaguaccaucaucaucauuaggaacacaaacauacaucugcaacguaaaucauaaaccaucaaacaccaaaguugacaaaaaaguagaaccaaaaucaugugacaaaacacauacaugcccaccuugcccagcaccagaauuacuaggagguccauccguauuccuauucccuccaaaaccuaaagacacacuaaugaucuccagaacaccagaaguaaccugcguaguaguagacguaucacaugaagacccagaaguaaaauucaacugguacguagacggaguugaaguacauaacgcaaaaacaaaaccaagagaagaacaauauaauucaacauauagaguaguuucaguauuaacaguauuacaccaagacugguuaaacggaaaagaauacaaauguaaaguauccaauaaagcacuaccugcaccuauagaaaaaacuaucucaaaagcaaaaggacaaccaagagaaccacaaguuuacacucuaccaccaucacgagaagaaaugacaaaaaaccaaguaucacuaacaugccuaguaaaaggcuucuaccccucagacauagccguagaaugggaaucaaacggacaaccagaaaauaauuacaaaacaacaccaccaguacuagacucugacggaucauucuuccuauacucaaaauuaaccgucgauaaaucacgauggcaacaaggaaacguuuuuuccugcucaguaaugcacgaagcacuucacaaccacuacacacaaaaaucccuuucccuaucuccaggacccaaa

SEQ ID NO: 46591 - RNA, 645 nt, Artificial Sequence
  derived and/or modified sequence opt6 from rhuMab_HER2_LightChain
ucagacauacaaaugacacaaucaccaucaucccuaucagcaucaguaggagaccgagucacaauaacaugcagagcaucacaagacguaaacacagcagucgcaugguaccaacaaaaaccaggaaaagcaccaaaacuauuaaucuacucagcaucauuccucuacucaggagucccaucaagauucucaggaucaagaucaggaacagacuucacauuaacaauaucaucacuacaaccagaagacuucgccacauacuacugccaacaacacuauacaacaccaccaacauucggccaaggaaccaaaguagaaaucaaacgcacaguagcagcaccaagcguauucauauuuccaccaucagacgaacaacuaaaaucaggaacagcaucaguaguaugcuuacuaaacaacuucuacccaagagaagcaaaaguacaauggaaagucgauaacgcacuacaaucaggaaacucacaagaaucaguuacagaacaagacucaaaagauucaacauauucauuaucauccacacuaacacuuuccaaagcagauuacgaaaaacacaaaguauaugcaugcgaaguaacacaccaaggacuaucaucaccaguaacaaaauccuucaacagaggagaaugc

SEQ ID NO: 46592 - RNA, 318 nt, Artificial Sequence
  derived and/or modified sequence opt6 from rhuMab_HER2_LightChain_variant1
acaguagcagcaccaucaguauucauauucccaccaucagacgaacaacuaaaaucaggaacagcaucaguaguaugccuacuaaacaacuucuacccaagagaagcaaaaguacaauggaaaguagacaacgcacuacaaucaggaaacucacaagaaucaguaaccgaacaagacucaaaagacucaacauacucacuaucaucaacacuaacacuaucaaaagcagacuacgaaaaacacaaaguauacgcaugcgaaguaacacaccaaggacuaucaucaccaguaacaaaaucauucaacagaggagaaugc

SEQ ID NO: 46593 - RNA, 642 nt, Artificial Sequence
  derived and/or modified sequence opt6 from rhuMab_HER2_LightChain_variant2
gacauacaaaugacacaauccccaucaucacuaucagcaucaguaggagacagaguaacaauaacaugcagagcaucacaagacguaaacacagccguagcaugguaccaacaaaaaccaggaaaagcaccaaaacuacuaauauacucagcaucauuucuauacuccggaguaccauccagauucucaggcucacgaucaggaacagauuucacacuaacaauaucaucacuacaacccgaagacuucgccacauacuacugccaacaacacuacacaacaccaccaacauucggacaaggaacaaaaguugaaauaaaacgaacaugcgcagcaccaucaguauucauauucccacccucagacgaacaauuaaaaucaggcacagcaucagucguaugcuuacuaaacaacuucuauccaagagaagcaaaaguccaauggaaagucgacaacgcacuccaaucaggaaacucacaagaaucaguaacagaacaagacucaaaagauucaacauacucccuaucaucaacccuaacauuaucaaaagcagauuacgaaaaacacaaaguauacgcaugcgaagucacacaccaaggacuaucaucacccguaacaaaaucauucaacagaggcgaaugc

SEQ ID NO: 46594 - RNA, 642 nt, Artificial Sequence
  derived and/or modified sequence opt6 from rhuMab_HER2_LightChain_variant3
gacauacaaaugacacaaucaccuucaucauuaucagcuucaguaggagaccgaguaacaauaacaugcagagcaucccaagacguaaacacagcaguagccugguaccaacaaaaaccaggaaaagcaccaaaacuauuaaucuacucagcauccuucuuauacucaggagucccaucaagauucucaggaucaagaucaggaacagacuucacauuaaccauaucuucacuacaaccagaagacuucgcaacauacuacugccaacaacacuacacaaccccaccaacauucggacaaggaaccaaaguagaaauaaaacgaacaguagcagcaccaucaguauucauauuuccaccaucagacgaacaauuaaaaucaggaacagcaucaguagucugccuacuaaacaacuucuacccacgagaagccaaaguacaauggaaaguagacaacgcacuacaaucaggaaacucacaagaauccguaaccgaacaagacagcaaagacucaacauacucccuaucaucaacacuaacacuaucaaaagcagacuacgaaaaacacaaaguauacgcaugcgaaguaacacaccaaggauuaucaucaccaguaacaaaauccuucaacagaggagaaugc

SEQ ID NO: 46595 - RNA, 645 nt, Artificial Sequence
  derived and/or modified sequence opt6 from rhuMab_HER2_LightChain_variant4
ucagauauacaaaugacacaaucaccaucaucacuaucagcaucuguaggagaccgaguaacaauaacaugcagagcaucccaagacguaaacacagcaguagcaugguaccaacaaaaacccggaaaagcaccaaaacuauuaauauacuccgcaucauuccuauauucaggaguaccaucacgauucucaggaucaagaucaggcacagacuucacauuaacaauaucuucacuacaaccagaagacuuugcaacauacuacugccaacaacacuacacaacaccaccaacauucggacaaggcacaaaagucgaaaucaaaagaacagucgcagcaccaucaguauucauauucccaccaucagacgaacaacuaaaaucaggaacagcaucaguaguaugccuauuaaacaacuucuacccaagagaagcaaaaguacaauggaaaguagacaacgcacuacaaucaggaaacucacaagaaucaguaacagaacaagacucaaaagacucuacauacucccuaucauccacccuaacacuaucaaaagccgacuacgaaaaacacaaagucuacgcaugcgaaguaacacaccaaggacuaucauccccaguaaccaaaucauucaacagaggagaaugc

SEQ ID NO: 46596 - RNA, 321 nt, Artificial Sequence
  derived and/or modified sequence opt6 from rhuMab_HER2_LightChain_V-Region
gacauacaaaugacacaaucaccaucaucacuaucagcauccguaggagacagaguaacaauaacaugcagagcaucacaagacguaaacacagcaguagcaugguaccaacaaaaaccaggaaaagcaccaaaacuacuaauauacucagcaucauuccuauacucaggaguaccaucaagauucucaggaucaagaucaggaacagacuucacacuaacaauaucaucacuacaaccagaagacuucgcaacauacuacugccaacaacacuacacaacaccaccaacauucggacaaggaacaaaaguagaaauaaaa

SEQ ID NO: 46597 - RNA, 1350 nt, Artificial Sequence
  derived and/or modified sequence opt6 from rhuMab_HER2_gamma1-Chain
gaaguacaacuaguagaaucaggaggaggacucguacaaccaggaggaucacuaagacuaucaugcgcagcaucaggauucaauauaaaagauacauacauacauugggucagacaagcacccggaaaaggacuagaauggguagcaagaauauacccaacaaacggauacaccagauaugcagacuccguaaaaggacgauuuacaauaucugccgacaccuccaaaaacacugcauauuuacaaaugaacucacuucgagcagaagauacugcaguauacuacugcucuagauggggaggcgacggauucuacgcaauggacuauuggggacaaggaacauuaguaacaguauccucagccucaacaaaaggaccaucaguauuuccucuagcacccuccucaaaauccacuucaggcggaacagcagcacuaggaugccuuguaaaagacuauuucccagaaccaguuacaguaaguuggaauucuggagcauuaacaucaggaguacacacuuucccagcaguucugcaaucauccggacuauauucucuaucauccguaguaacaguacccucuucaucacuaggaacacaaaccuauauuugcaacguaaaucacaaaccaucaaacacuaaaguagacaaaaaaguagaaccuaaaaguugugauaaaacacacacaugcccucccugcccagcuccagaacuauuaggaggcccauccguauuucuauucccaccaaaaccaaaagacacacuuaugauaucccgaacacccgaaguaacuuguguaguaguagauguaucacacgaagacccagaaguaaaauucaacugguacguagacggaguugaaguacacaacgcaaaaacaaaacccagagaagaacaauauaacuccacauauagaguagucucaguacuuacaguacuucaccaagauuggcuaaauggaaaagaauacaaaugcaaaguuucaaacaaagccuuaccagcacccauagaaaaaacaauaagcaaagccaaaggacaaccacgugaaccacaaguauacacacuaccaccaucaagagaagaaaugacaaaaaaccaaguaucauuaacauguuuaguaaaaggauuuuacccaagcgacauagcaguugaaugggaaucaaacggacaacccgaaaacaacuacaaaacaacaccaccaguacuagacucagauggcucuuuuuuccuauauucaaaacuaacaguagauaaaucaagauggcaacaaggaaacgucuuuuccuguucuguaaugcacgaagcauuacacaaccacuauacucaaaaaucauuaucauuaucaccaggcaaa

SEQ ID NO: 46598 - RNA, 1350 nt, Artificial Sequence
  derived and/or modified sequence opt6 from rhuMab_HER2__gamma1-Chain
gaaguacaacuaguugaaagcggaggcggcuuaguacaaccaggaggaucacuaagacucuccugugcagcauccggcuucaauauaaaagacaccuauauacauuggguaagacaagcaccaggaaaaggacuagaauggguugcacgaauuuacccaaccaacggauacacacgauacgcagacucaguaaaaggaagauuuacaauaucagcagacacaucaaaaaacacagcauaccuacaaaugaacucacuaagagcugaagauacggcuguauacuacugcucccgauggggcggagacggauuuuaugcaauggacuacuggggacaaggaacacuagucacaguaucaucaugcucuacuaaagguccauccgucuuccccuuagcaccaagcucaaaaucaacaucuggagguacagcagcacuaggaugcuuagucaaagauuacuuuccugaaccaguuacaguaucauggaacucaggagcacuuacaucaggaguacacacauucccagcaguacuacaaucaucaggauuauacucacucucaucaguaguaacaguacccucaucaucauuaggaacucaaacauauauuugcaacguaaaccacaaacccuccaacacaaaaguagacaaaaaaguagaaccuaaaucaugcgacaaaacacauacuugcccacccuguccagcacccgaauuauuaggaggaccaucaguauucuuauucccaccaaaaccaaaagacacauuaaugauaucuagaacacccgaaguaacauguguaguagucgaugucucacaugaagacccugaaguaaaauucaacugguacguagacggaguagaaguacacaaugcaaaaacaaaaccacgagaagaacaauauaacucaacauaccgagucguaaguguucuaacaguacuccaccaagacuggcuaaauggaaaagaauacaaauguaaaguauccaauaaagcucuaccugcaccaauagaaaaaacaauaucuaaagcaaaaggacaaccgagagaaccacaaguauauacacuaccaccuucuagagaagaaaugacaaaaaaccaaguuucauuaacaugcuuagucaaaggauucuacccaucagacauagcaguagaaugggaaucaaauggacaaccagaaaacaauuacaaaacaacacccccaguacuggauucagauggaucauuuuuccuauacucaaaauuaacugucgacaaaucacgcuggcaacaaggaaacguauuuucuugcucaguaaugcaugaagcacuacacaaccacuacacacaaaaaucucuaucacuaucaccaggaaaa

SEQ ID NO: 46599 - RNA, 729 nt, Artificial Sequence
  derived and/or modified sequence opt6 from rhuMab_HER2_gamma1-Chain__rhuMab_HER2_LightChain_sc4D5
gaaguacaauuaguagaaagcggaggaggauuaguacaaccaggaggaaguuuaagacuaaguugugcagcaagcggauuuaauauaaaagacacauauauacacuggguuagacaagcaccaggaaaaggacuagaauggguagccagaauauauccaacaaauggauauacaagauaugcugauagcguaaaaggaagauuuacaauaagugcagauacaaguaaaaauacagcauauuuacaaaugaauucauuaagagcagaagauacagcaguauauuacugcaguagauggggaggagauggauuuuaugcaauggauuacuggggacaaggaacauuaguaacaguaaguagcgguggaggaggaagcggaggaggaggcucaggaggaggaggaagcgauauacaaaugacacaaaguccaucgaguuuaagugcaagcguaggagacagaguaacaauaacauguagagcgucacaagacguaaauacagcaguagcaugguaucaacaaaaacccggaaaagcaccaaaacuauuaauauauagcgcaaguuuuuuauauaguggagucccaaguagauucucaggaucaagaucaggaacagacuuuacauuaacaauaaguaguuuacaaccagaagacuuugcaacauauuauugccaacaacauuacacaacaccaccaacauucggacaaggaacaaaaguugaaauuaaaaga

SEQ ID NO: 46600 - RNA, 1350 nt, Artificial Sequence
  derived and/or modified sequence opt6 from rhuMab_HER2_gamma1-Chain_variant1
gaaguacaacuaguagaaucaggcgguggauuaguacaacccggaggaucauuaagacuuucuugcgcagcaagugguuuuaacaucaaagacacauacauccacuggguaagacaagcaccaggaaaaggacuagaauggguagcaaggauauauccaacaaauggauacaccagauaugcagacagugucaaaggacguuucacuauaucagcagacacaaguaaaaacacagcauaccuacaaaugaauucauuacgagcugaagacacagcaguauauuauuguucaagaugggguggcgauggauuuuaugccauggauuacuggggacaaggcacccucguaacgguaagcucagcaucuacaaaaggaccauccgucuucccauuagcaccaucuucaaaaucaacuucaggaggcacagcagcacuaggaugucuaguaaaagacuacuuccccgaaccaguaacaguaucauggaauucaggagcccuaaccucuggaguucacacauucccagcaguauuacaaucauccggacuauacucucuaucaaguguagucaccguaccaagcucaucacuaggaacacaaacauauauaugcaauguaaaucacaaaccaucaaauacaaaaguugacaaaaaaguagaaccaaaaucaugcgauaaaacccauacauguccaccauguccagcaccugaauuauuaggcggaccaucuguauuuuuauuuccaccaaaaccaaaagauacauuaaugauauccagaacuccagaaguaacaugcguaguaguagauguuucacacgaagacccagaaguaaaauuuaauugguacguagacggaguagaaguucauaaugcuaaaacuaaaccacgagaagaacaauacaauucaacauaucgcguagucuccguacuuacuguauuacaccaagauuggcuuaacggaaaagaauacaaauguaaaguaagcaacaaagcauuacccgcacccaucgaaaaaacaaucucuaaagcaaaagggcaaccccgagaaccacaaguauauacacuaccaccaucuagagaagaaaugacuaaaaaucaaguaagccuaacauguuuaguaaaagguuuuuacccaucugacauagccguagaaugggaauccaacggccaaccagaaaacaacuauaaaacaacaccucccguacuagauucagauggaucuuucuuccuauacaguaaacuaacagucgacaaaucaagauggcaacaaggaaacguauuuucaugcucaguaaugcaugaagcccuacauaaccacuauacacaaaaaucacuaagcuuaagcccaggaaaa

SEQ ID NO: 46601 - RNA, 1350 nt, Artificial Sequence
  derived and/or modified sequence opt6 from rhuMab_HER2_gamma1-Chain_variant2
gaaguacaauuaguagaaucaggagguggacuaguucaaccaggcggaagccuccgauuaucaugcgccgcaucaggcuucaauauaaaagacacauacauacacuggguccgacaagcaccagguaaaggacuagaauggguagcaagaauauacccuacuaacggauauacaagauaugcagauucaguuaaaggcagauuuacaauauccgcagacacaagcaaaaauacugcauauuuacaaaugaauucauuaagagcagaagacaccgcaguauauuacugcucacgauggggaggagauggauuuuaugcaauggacuacuggggacaagguaccuuaguaacaguaucuucauguucaacaaaaggaccaucaguauucccacucgcacccucaucaaaaucaacaucaggaggaacagcagcacuuggaugucuugucaaagacuacuucccagaaccaguaacaguaucauggaauucaggugcacuuacaucaggcguacauacauuuccagccguacuacaaucaucaggauuauauucacuaucuucaguuguuacaguaccaagcucaagcuuaggaacacaaacauacauaugcaacguaaaccauaaaccaucaaacacaaaaguagacaaaaagguagaaccuaaaucaugcgacaaaacccauacaugcccaccuugcccugccccagaguuauuaggagggcccucaguauuucuauucccaccaaaaccuaaagauacacuaaugauaucaagaacaccggaagucacauguguagucguagaugucucacacgaagacccagaaguuaaauuuaacugguacguagacggaguagaaguacauaacgcuaaaaccaaaccaagagaagaacaauacaauucaacauauagaguaguauccguauuaaccguacuacaucaagacuggcucaauggaaaagaauacaaaugcaaaguaagcaauaaagccuuaccagcuccaauagaaaaaacaaucucaaaagcaaaaggacaaccuagagaaccccaaguauacacacuaccaccuuccagggaagaaaugacaaaaaaucaaguaucccuaacauguuuagucaaagguuucuauccaagugacauagcaguagaaugggaaucaaacggacaaccagaaaauaacuacaaaacaacacccccaguacuagacucagacggaucauucuucuuauacucaaaacuuacaguagauaaaucuagauggcaacaaggaaacguauuuucauguucaguaaugcaugaagcacuacacaaccacuacacacaaaaaucacuaucacucagucccggaaaa

SEQ ID NO: 46602 - RNA, 1350 nt, Artificial Sequence
  derived and/or modified sequence opt6 from rhuMab_HER2_gamma1-Chain_variant3
gaaguacaacuaguagaaucaggaggcggauuaguucaaccaggaggaucauuaagacuuuccugcgcagcaucuggauucaacauaaaagauacauacauacauugggucagacaagcaccuggaaaaggauuagaauggguugcccgaauuuacccaaccaauggauauacaagauaugcagauucagucaaaggaagauuuacaauuucagcagacacaucuaaaaauacagcauacuuacaaaugaauucauuacgaugcgaagacacagcaguauauuacugcuccagauggggaggcgacggauucuacgccauggacuauuggggacaaggaacauuaguaacugucucuucagcaucaaccaaagguccaucaguauuuccacucgcaccaucauccaaaucuaccucuggaggaacagcugccuuaggaugccuagucaaagacuacuuuccagaaccaguaacaguaagcuggaauucaggugcacuaacaucaggaguacacacauucccagcuguccuacaauccucaggacuauauucacuaucaucaguaguaacuguaccaucuucaucauuaggaacacaaacauacauaugcaacguaaaccauaaaccauccaacacaaaaguugauaaaaaaguagaaccaaaaucaugugacaaaacccauacaugcccaccaugcccagcaccagaauuacuaggaggcccaucaguauucuuauucccaccaaaaccuaaagauacuuuaaugauaucaagaacuccagaagucacauguguaguaguagauguaucacaugaagauccagaaguaaaauucaacugguacgucgauggcguagaaguacacaaugcaaaaacaaaaccaagagaagaacaauacaauucuacauacagaguaguuucaguacuaacaguuuuacaucaagacuggcuaaaugguaaagaauacaaaugcaaagucuccaacaaagcacuuccagcacccauagaaaaaaccaucucaaaagccaaaggacaaccaagagaaccacaaguauacacauuaccccccucaagagaagaaaugacgaaaaaccaagucagccuuacuugcuuaguaaaaggauucuacccuucagacauagcaguagaaugggaaucaaauggucaaccugaaaacaacuacaaaacaacaccaccaguauuagacucagacggaucauuuuuccucuacucuaaacuaacaguagacaaaucucguuggcaacaaggaaacgucuuuucaugcucaguaaugcacgaagcacuacauaaccacuacacccaaaaaagccuaucacuauccccagguaaa

SEQ ID NO: 46603 - RNA, 360 nt, Artificial Sequence
  derived and/or modified sequence opt6 from rhuMab_HER2_gamma1-Chain_V-Region
gaaguacaauuaguagaaagcggaggaggauuaguacaaccaggaggaaguuuaagauuaaguugugcagcaaguggauuuaauauaaaagauacauauauacacuggguaaggcaagcaccaggaaaaggacuagaauggguagcaagaauauauccaacaaauggauauacaagauaugcagauaguguaaaaggaagauuuacaauaagugcagauacaaguaaaaauacagcauauuuacaaaugaauaguuuaagagcagaagauacagcaguauauuauuguaguagauggggaggagauggauuuuaugcaauggauuauuggggacaaggaacauuaguaacaguaaguuca

SEQ ID NO: 46604 - RNA, 1359 nt, Artificial Sequence
  derived and/or modified sequence opt6 from rhuMAb-VEGF_HeavyChain1
gaaguacaauuaguagaaucagguggaggacuaguacaaccaggaggaucauuaagauuaucaugcgccgcaucggguuauacauucacaaacuacggaaugaacuggguucgacaagcaccaggaaaaggauuagaaugggucggauggaucaauacauauacaggagaacccacauacgcagcagauuucaaacgaagauucacguuuucacucgacacaucuaaaucaacagcauacuuacaaaugaauucacuacgagcugaagauacagccguuuacuacugugcaaaauacccacacuauuauggaucaucacacugguacuuugacguauggggccaaggaacauuaguaaccguaaguucagcaucaaccaagggaccaaguguauucccacuagcacccucaucaaaaucaacaaguggcggaaccgcagccuuaggaugcuuagucaaagauuacuucccagaaccaguuacaguuucauggaacucaggagcucucacaucuggaguacacacauuuccagccguauuacaaucauccggucuauauucucuuucauccguaguuacaguuccaucuucuucacuuggaacacaaacauacauauguaauguaaaccacaaaccaucaaauacaaaaguagauaaaaaaguagaaccaaaaagcugcgacaaaacacacacauguccuccaugucccgcaccagaacuacuaggaggaccaucaguauuucuauucccaccaaaaccaaaagacacucuaaugauaucaagaaccccagaaguaacaugcguaguaguagauguaucacacgaagacccagaaguaaaauucaacugguauguagacggaguagaaguccauaaugcaaaaacgaaaccacgagaagaacaauacaacucaacauacagagucguuucaguacucacaguauuacaucaagacuggcuaaauggaaaagaauacaaaugcaaaguaucaaauaaagcccucccagcaccuauagaaaaaacaauaucaaaagccaaaggucaaccacgagaaccccaaguauacacacuuccacccucccgagaagaaaugacaaaaaaccaaguaaguuuaacuugucuuguaaaaggauucuaccccucagauaucgcaguagaaugggaaucaaacggacaaccagaaaauaauuacaaaacaacuccaccaguauuagauucugacggaucauuuuuucuauauaguaaacuaacaguugacaaaucaagauggcaacaaggaaauguauucagcugcucuguaaugcacgaagcauuacacaaccauuacacacaaaaaucccuaucauuaucccccggcaaa

SEQ ID NO: 46605 - RNA, 642 nt, Artificial Sequence
  derived and/or modified sequence opt6 from rhuMAb-VEGF_LightChain1
gacauacaaaugacacaaucccccucaucacuaucagcaucagucggagacagaguaacaaucacaugcuccgcaucacaagacaucucaaacuaccuaaacugguaccaacaaaaaccaggaaaagcaccaaaaguccuaauauacuucacaucaucacuacauuccggcguaccaucaagauucucaggaucaggaucaggaacagacuucacacuaacaauaucaucacuacaaccagaagauuucgcaacauacuacugccaacaauacucaacaguaccauggacauucggacaaggaacaaaaguagaaauaaaacgaacaguagcagcaccauccguauucauauucccaccaucagacgaacaacuaaaaucaggcacagcaucaguuguaugccuacuaaacaauuucuacccaagagaagcaaaaguccaauggaaagucgacaacgcauuacaaucaggaaacucacaagaaucaguaacagaacaagacucaaaagacucuacauacucacuaucaucaacccuaacacuaaguaaagcagacuacgaaaaacacaaaguauacgcaugcgaagucacacaccaaggacuaucaucaccaguaaccaaauccuucaacagaggagaaugc

SEQ ID NO: 46606 - RNA, 642 nt, Artificial Sequence
  derived and/or modified sequence opt6 from rhuMAb-VEGF_LightChain
gacauacaaaugacacaauccccaucaucccuaucagcaucaguaggagacagaguaacaauaaccugcucagcaucacaagacauaucaaacuacuuaaacugguaccaacaaaaaccaggaaaagcaccaaaaguacuaauauacuuuacauccucuuuacacucaggaguaccaucacgauucucaggaucaggaucaggaacagacuucacauuaacaauaagcucacuacaaccagaagacuucgcaacauacuacugccaacaauacuccacagucccauggacauucggacaaggaacaaaaguagaaauaaaacgaacaguagcagcaccaucaguauucauauucccaccauccgacgaacaacuaaaaucuggaacagcaucuguaguaugccuacuaaacaacuucuacccaagagaagcaaaaguccaauggaaagucgacaacgcacuacaaucaggaaacucacaagaaucaguaacagaacaagacucaaaagacucaacauacucacuaucaucaacauuaacacuaucuaaagccgacuacgaaaaacacaaaguauacgcaugcgaaguaacacaccaaggacuaucaucaccagucacaaaauccuucaacagaggcgaaugu

SEQ ID NO: 46607 - RNA, 321 nt, Artificial Sequence
  derived and/or modified sequence opt6 from rhuMAb-VEGF_LightChain__VG-Region
gacauacaaaugacacaaucaccaucaucacuaucagcaucaguaggagacagaguaacaauaacaugcucagcaucacaagacauaucaaacuaccuaaacugguaccaacaaaaaccaggaaaagcaccaaaaguacuaauauacuucacaucaucacuacacucaggaguaccaucaagauucucaggaucuggaucaggaacagacuucacacuaacaauaucaucacuacaaccagaagacuucgcaacauacuacugccaacaauacucaacaguaccauggacauucggacaaggaacaaaaguagaaauaaaa

SEQ ID NO: 46608 - RNA, 1359 nt, Artificial Sequence
  derived and/or modified sequence opt6 from rhuMAb-VEGF_gamma1-Chain
gaaguacaacuaguagaaucagguggagguuuaguacaaccaggcggaucacuacgucuaucuugcgcagcaucaggauauacauucacaaacuacggaaugaacuggguaagacaagcuccaggaaaaggauuagaauggguaggauggauaaacaccuacacaggugaaccaacauacgcagcagacuucaaacguagauucacauucucccuagauacaucaaaaucaacagcauacuuacaaaugaacagucucagagcagaagacacagcaguauauuacugcgcaaaauauccccacuacuacggaucaucacacugguacuucgauguauggggacaaggcacauuaguaacaguauccucagcuucaaccaaagguccaucaguauucccauuagcucccucuuccaaaucaacaucaggaggaacagcagcauuagguugccuugucaaagacuacuucccagaaccaguaacaguaucauggaauucaggagcauuaaccucuggaguacacacuuucccagcaguacuacaaucaucaggacuauacucucuaucuucugucguaacaguaccuucaucaucacucggcacacaaacuuauauuugcaacguaaaccacaaaccaucaaauaccaaaguagauaaaaaaguagaaccuaaaucuugugacaaaacacacaccugccccccauguccagccccagaauuacuaggaggaccaucaguuuuuuuauucccaccaaaacccaaagacacacuaaugauaagcagaaccccagaaguaacaugcgucguaguagaugucucucacgaagauccagaaguaaaauuuaauugguauguugacgguguagaaguacacaaugcaaaaacuaaacccagagaagaacaauacaacucaacuuacagaguaguuuccguacuaacaguauuacaccaagacuggcuuaacggaaaagaauacaaaugcaaaguuuccaauaaagcacuaccagcaccaauagaaaaaacaaucucaaaagcuaaaggacaaccaagagaaccacaaguauauacauuaccaccaucucgagaagaaaugacaaaaaaccaaguauccuuaacuugucuaguaaaaggauuuuauccuucagauaucgccguagaaugggaaucaaauggacaacccgaaaauaacuacaaaacuacucccccaguacuagauucagacggaucauucuuucuauacucaaaauuaacaguagacaaaucaagauggcaacaaggcaacguauuuucaugcucaguaaugcacgaagcccuacacaaucacuauacacaaaaaucacugucucuaagcccaggaaaa

SEQ ID NO: 46609 - RNA, 369 nt, Artificial Sequence
  derived and/or modified sequence opt6 from rhuMAb-VEGF_gamma1-Chain_VDG-Region
gaaguacaauuaguagaaaguggaggaggauuaguacaaccaggaggaaguuuaagauuaaguugugcagcaaguggauauacauuuacaaauuauggaaugaauuggguaagacaagcaccaggaaaaggauuagaauggguaggauggauaaauacauauacaggagaaccaacauaugcagcagauuuuaaaagaagauuuacauuuaguuuagauacaaguaaaaguacagcauauuuacaaaugaauaguuuaagagcagaagauacagcaguauauuauugugcaaaauauccacauuauuauggaaguagucauugguauuuugauguauggggacaaggaacauuaguaacaguaaguagu

SEQ ID NO: 46610 - RNA, 1338 nt, Artificial Sequence
  derived and/or modified sequence opt6 from Rilotumumab_HeavyChain1
caaguacaauuacaagaaucaggaccaggauuaguaaaaccaucagaaacacucucacuaacauguacagucucaggaggcucaauaucaauauacuacugguccuggauaagacaaccaccaggaaaaggauuagaauggauaggauacguauacuacucaggaucaacaaacuauaacccuucauuaaaaucacgaguaacaauaucaguagacacaucaaaaaaucaauucucucuaaaacuaaauaguguaacagcagcagacacagcaguauauuauugugccagaggaggcuacgauuucuggagcggcuauuucgacuacuggggacaaggaacauuaguaacaguaucaucagccuccacaaagggaccuucaguauuuccauuagcaccaugcucaagauccacaucagagucaacagcagccuuaggaugucuaguaaaagacuacuuuccagaacccguaacagucagcuggaauucaggagcucuaacaucaggaguucacacauuucccgcaguuuuacaaucaucuggacuauacucacuaucaucaguuguuaccguucccucaucaaacuucggcacucaaacauauacuuguaauguagaccauaaacccuccaauacuaaagucgauaaaacaguagaaagaaaaugcugcguugaauguccaccaugcccugccccaccaguagcaggaccaaguguuuuucuauuuccaccaaaaccaaaagauacccucaugauuucaagaacacccgaaguaaccugcguaguaguagauguaucucacgaagauccagaaguacaauuuaacugguacgucgacgguguagaaguacauaacgcaaaaacaaaaccaagagaagaacaauuuaacucaacauucaggguaguaucuguacuaacaguaguacaucaagauuggcuaaacggcaaagaauacaaauguaaaguuucaaacaaaggacuacccgcccccauagaaaaaacaauaucaaaaacaaaaggacaaccaagggaaccccaaguauacacccuaccaccaucaagagaagaaaugacaaaaaaccaaguaucacuaacaugcuuaguaaaaggcuuuuauccaucagacauugcaguagaaugggaaucuaacggacaacccgaaaacaacuauaaaacaacaccaccaaugcuugacucagacgguucuuucuuccucuacuccaaacuaacaguugacaaaagcagauggcaacaagguaacguauuuucaugcucaguaaugcacgaagcacuacauaaccacuacacacaaaaaucacuaagccuaucucccggaaaa

SEQ ID NO: 46611 - RNA, 645 nt, Artificial Sequence
  derived and/or modified sequence opt6 from Rilotumumab_LightChain1
gaaauaguaaugacacaaucaccagccacacuaucaguaucaccaggagaaagagcaacauuaucaugccgagcaucacaauccguagacucaaaccuagcaugguacagacaaaaaccaggacaagcaccaagacuacuaauauacggagcaucaacaagagcaacaggaauaccagcaagauucucaggaucaggaucaggaacagaauucacauuaacaauaucaucauuacaaucagaagacuucgcaguauacuacugccaacaauacauaaacuggccaccaauaacauucggacaaggaacaagacuagaaauaaaaagaacaguagcagcaccaucaguauucauauuuccaccauccgaugaacaacuaaaaucaggcacagcaucaguaguaugccuauuaaacaacuucuacccaagagaagcaaaaguacaauggaaaguagacaacgcauuacaaucaggaaacucacaagaaucaguaacagaacaagacucaaaagacucaacauacucauuauccucaacacuaacacuauccaaagcagacuacgaaaaacacaaaguauacgccugcgaaguaacacaccaaggacuaucaucaccaguaacaaaaucauuuaacagaggugaaugc

SEQ ID NO: 46612 - RNA, 1071 nt, Artificial Sequence
  derived and/or modified sequence opt6 from Rilotumumab_scFv-CH_chain
gaaguacaauuauuagaaucaggcggaggacuaguccaaccuggaggaucuuuaagauuaucaugcgcagcaucaggauuuacauuuagcucauucucaaugucauggguaagacaagcaccaggcaaaggacuagaauggguaucaucaauaucaggaucuucaggaacaacauauuaugcagacucaguaaaaggaagauuuacaauaucaagagacaauucaaaaaauacauuauaccuacaaaugaacucauuaagagcagaagauacagcaguuuauuauugcgcaaaaccauuuccauauuuugauuauuggggacaaggaacauuaguaacaguaucaucaggagacggaaguucagguggaaguggaggcgcaagugaaauuguguuaacacaaaguccaggaacauuaagcuuaucaccaggugaaagagcuacauuaucuuguagggcaagucaauccguaucaaguucauuuuuagcaugguaucaacaaaaaccuggucaagcacccagacuccuuauauauuaugcaucaucacgagcaacaggaauaccagauagauuuagcggaaguggaaguggaacagauuucacacuaacaauaucaagauuagaaccagaagauuucgcaguauauuauugucaacaaacaggaagaauaccaccaaccuuuggacaaggaaccaaaguagaaauaaaaucuggagguucaggaggaccaagagcagcaccagaagucuaugcuuuugcuacaccagaauggccaggaagcagagauaaaagaacauuagcuuguuuaauacaaaauuuuaugccagaagauaucucaguacaaugguuacauaacgaaguacaauuaccagaugccagacacucaacuacacaaccaagaaaaacaaaaggaucuggauuuuucguauuuucaagauuagaaguuacacgagcagaaugggaacaaaaagaugaauuuauuuguagagcaguacaugaagccgcaucaccaagccaaacaguacaaagagccguaucaguaaacccagaaucaaguagaagaggaggaugu

SEQ ID NO: 46613 - RNA, 1347 nt, Artificial Sequence
  derived and/or modified sequence opt6 from Rinucumab_HeavyChain1
caacuccaacuacaagaaucaggcccaggacugguaaaaccaucagaaacuuuaucacuaacauguaccguuucaggcggaucaauaacaucaucuucuuacuauuggggauggaucagacaaccacccgguaaaggacuagaauggaucggaaguauauacuacagagguucuacaaacuacaaucccuccuuaaaaucacgaguuacaauaucagucgacucuagcaaaaaccaauuuuaucuaaaaguauccuccgucacagcaguagacacagcagucuacuacugugcaagacaaaacggagcagcuagaccauccugguucgacccauggggacaaggaacacuaguuacaguuucaucagcaucuacaaaaggaccaucaguauucccccuagcaccaugcucucgcuccacaucugaaucuacagcagcacuaggaugccuaguaaaagacuacuucccagaaccaguaacagucucauggaauucaggagcucuaacaucaggcguacacacauucccugccguacuucaaucaucaggacuauacucacuaaguuccguaguaacaguaccaucaucaucauuaggaacaaaaacauacacaugcaacgucgaccauaaacccucaaacacaaaaguagacaaaagaguagaaucaaaauauggcccaccaugcccacccugcccagcccccgaauuccuaggaggaccaucaguauuuuuauuuccaccaaaacccaaagacacacuaaugauauccagaacuccagaagucacuuguguaguuguagaugucucucaagaagauccagaaguucaauucaacugguauguugacggaguugaaguacacaaugcaaaaacaaaaccacgagaagaacaauucaacucaacuuaucgaguaguaaguguauuaacaguuuuacaccaagacugguuaaaugguaaagaauacaaauguaaaguaucaaacaaaggacuaccaucaucuauagaaaaaacaauauccaaagccaaaggacaaccaagagaaccacaaguauacacauuaccaccaucacaagaagaaaugaccaaaaaccaagucucacuaacaugccuagucaaaggauuuuacccaucagacauugcaguagaaugggaaagcaacggacaaccagaaaauaauuacaaaacaacaccacccguacuagacucagacggaagcuucuuccucuacuccagacuaacaguugacaaaucaagauggcaagaagguaaugucuucucuugcucagucaugcaugaagcauuacauaaccauuauacucaaaaaucucuaucacuaucacuaggaaaa

SEQ ID NO: 46614 - RNA, 1344 nt, Artificial Sequence
  derived and/or modified sequence opt6 from Rinucumab_HeavyChain
caauuacaauuacaagaaucaggaccaggauuaguaaaaccaucagaaacccuaucccuaacaugcacaguaucaggaggaucaauaacaucauccuccuacuacuggggauggauacgacaaccacccggaaaaggacuagaauggauugguucaaucuacuacagaggaucaaccaacuacaacccaucacuaaaaagccgcguaacaauaucaguagacaguucgaaaaaucaauuuuaccuaaaaguauccucgguaacagcagucgauacagcaguauauuacugcgcccgacaaaacggagcugcaagacccuccugguucgauccuuggggacaagguacucuaguaacaguaucaucugcaucaacaaaaggcccuucaguauucccauuagcaccaugcucaagaucaacauccgaaaguacagcagcacuuggaugucuaguaaaagacuacuucccagaaccaguaacugucaguuggaauucuggagcacuaaccucugguguucacacauucccagcaguacuucaaaguaguggcuuauauucacuaucauccguaguaacaguaccaucaucauccuuagggacaaaaacauacaccuguaacguagaccauaaaccaucaaauacgaaaguagauaaaagaguagaauccaaauacggaccaccaugcccuccaugcccagcaccugaauuuuuagguggaccauccguauuccuauucccccccaaaccaaaagauacacuaaugauuucaagaacaccagaaguaaccugcgucguugucgauguaucacaagaagacccugaaguacaauuuaauugguacguagacggaguagaaguacacaacgcaaaaacaaaacccagagaagaacaauuuaacucaacauaccgaguuguaucaguacuuacaguauuacaccaagauuggcuaaacggaaaagaauacaaauguaaaguaucaaauaaaggacuuccaucaucaauagaaaaaacaauaucuaaagcaaaaggccaaccacgagaaccacaaguauacacacuaccaccaucacaggaagaaaugacaaaaaaccaaguaucacuuacuugccuaguuaaaggauuuuacccaucagacaucgcaguugaaugggaaucaaacggccaaccagaaaauaacuauaaaacaacaccaccaguacuagacucagauggauccuucuuuuuauacucaagacuaacaguagauaaaucaagauggcaagaaggaaacguauuuucuuguucagucaugcacgaagcacuacauaaccauuacacacaaaaaucauuaucacuaucauuagga

SEQ ID NO: 46615 - RNA, 645 nt, Artificial Sequence
  derived and/or modified sequence opt6 from Rinucumab_LightChain1
gaaauaguacuaacacaaucaccagacacaauaucacucucaccaggagaaagagccacacuaucaugcagagcaucacaaucaauaucaucaauauaccuagccugguaccaacaaaaacccggccaagccccaagacuauuaauauauggagccucaucacgaguaacaggaauaccagacagauucucagucucaggaucaggaacagauuucacccuaacaauaucaagacuagaaccagaagacuucgcaguauacuauugccaacauuacggaauaucaccauucacauucggacccggaacaaaaguagacauaagaagaacagucgcagcaccuucaguauucauauucccaccaucugacgaacaacuaaaaucaggaacagcaucaguaguaugcuuacuaaacaauuucuacccaagagaagcaaaaguacaauggaaaguagacaacgcauuacaaucaggaaacucacaagaaucagucacagaacaagacucaaaagacucaaccuacucccuaucaucaacccuaacauuaucaaaagcagacuacgaaaaacacaaaguauacgcaugcgaaguaacacaccaaggauuaucaucaccaguaacaaaaucauuuaacagaggagaaugc

SEQ ID NO: 46616 - RNA, 1347 nt, Artificial Sequence
  derived and/or modified sequence opt6 from Risankizumab_HeavyChain1
caaguacaacuaguucaaucaggagcagaagucaaaaaaccaggauccucagucaaaguaucaugcaaagcuucaggauacacuuucacagaccaaacaauacacuggaugcgacaagccccaggccaaggauuagaauggauaggauauauauacccccgcgacgauagcccaaaauauaaugaaaacuucaaaggaaaaguaacaauaacagccgacaaaucaaccucaacagccuacauggaacuaucuagccuaagaagcgaagacacagcagucuacuauugugcaaucccagacagaucaggauacgcaugguucauauacuggggacaaggaacacuaguaacuguuucuuccgcuucaacaaaaggaccaucaguauucccauuagcaccaucaucaaaaucaacaucuggcgguacagccgcacuaggaugcuuaguaaaagacuacuucccagaaccagucaccguaucauggaacucaggugcauuaacaucaggaguacauacauuccccgcaguauuacaaucaucaggacuauacucccuaucauccguaguaacuguaccaucaucaucacuaggaacacaaacuuacauuugcaacguaaaccacaaaccgucaaacacaaaaguagacaaaagaguugaaccaaaaucaugcgacaaaacacauacaugcccacccugccccgcaccagaagccgcaggaggaccaucaguauuccuauucccaccaaaaccaaaagacacacuaaugauaucaagaacaccugaaguaaccugcguaguagucgacguaucccacgaggauccagaaguaaaauuuaauugguacgucgaugguguagaaguacauaaugcaaaaaccaaacccagagaagaacaauacaauuccacauaccgaguaguaucaguccuaacaguccugcaccaagacugguuaaauggcaaagaauacaaaugcaaagucucaaacaaagcauuaccagcaccaauagaaaaaaccauaucaaaagcaaaaggccaaccucgagaaccccaaguuuacacauuaccuccaucaagagaagaaaugacaaaaaaucaaguuucauuaacaugcuuaguaaaaggauucuaucccucagacauagcaguagaaugggaauccaauggucaaccagaaaacaauuacaaaacaacaccaccaguucuagacucagacgguucauuuuuccuauacucaaaacuaacagucgauaaauccagauggcaacaaggaaauguauuuucauguuccguaaugcaugaagcacuccacaaccacuauacucaaaaaucacuaagccuaucacccggu

SEQ ID NO: 46617 - RNA, 642 nt, Artificial Sequence
  derived and/or modified sequence opt6 from Risankizumab_LightChain1
gauauacaaaugacacaaucaccaucaucauuaucagcuucaguaggagauagagucacaauaacauguaaagcaucaagagacguagcaauagccguagccugguaccaacaaaaaccaggcaaaguaccaaaauuacuaauauacugggcaucaacacgccacacaggaguaccauccagauucucaggaucaggaucaagaacagacuucacauuaaccauaucaucucuacaacccgaagacguagcagauuacuucugccaucaauauucaucauacccauucacauucggaucaggaacaaaauuagaaauaaaaagaacaguagcagcaccaucaguauucauauucccacccucagacgaacaauuaaaaucaggaacagcaucaguaguaugccuacuaaacaacuucuacccaagagaagcaaaaguacaauggaaaguagacaacgcacuccaaucaggaaacucacaagaaucaguaacagaacaagacucaaaagacucaacuuacucauuaucauccaccuuaacacuaucaaaagcagacuacgaaaaacacaaaguauacgcaugcgaaguaacacaucaaggacuaucaucaccaguaacaaaaucauucaauagaggagaaugu

SEQ ID NO: 46618 - RNA, 1353 nt, Artificial Sequence
  derived and/or modified sequence opt6 from Rituximab_HeavyChain
caaguacaauuacaacaaccaggagccgaacuaguaaaacccggagcaucaguaaaaaugucauguaaagcaaguggauauacuuucacauccuacaauaugcauuggguaaaacaaacaccaggaagaggacucgaauggaucggcgccauauaccccggaaauggcgacacaucauacaaccaaaaauuuaaaggaaaagcaacauuaacagcagacaaaucuucaucaaccgcauacaugcaauuaucaucauuaacaucugaagauucagcagucuauuacugugcacgcucaacauacuacggaggcgauugguauuuuaacguauggggcgcagguacaacaguaacaguaucagccgccucaacaaaagggcccucuguauucccacuugcccccucaaguaaaucaacaucuggaggaacagcagcauuaggaugcuuaguaaaagauuacuuccccgaacccguaacaguaucauggaauuccggagcacucaccucaggaguucacacauucccagccguacuccaaucaucaggucuauacucacucucauccgucguuacaguuccuuccucaucuuuaggaacacaaacauauauaugcaacguuaaucauaagccaucaaacacaaaaguagauaaaaaagucgaaccaaaaucaugugacaaaacccauacaugucccccaugcccagcaccagaauuacuaggagggcccaguguauuucuauucccacccaaaccaaaagacacacucaugauaucaagaacuccagaaguaacuugcguaguaguagacguuucacacgaagacccagaagucaaauuuaacugguauguagauggaguagaaguacacaacgcaaaaacaaaaccuagagaagaacaauauaacucaacauacagaguaguaucaguacuaacaguacuccaccaagacuggcuaaacggaaaagaauauaaaugcaaaguaucaaacaaagcccuaccagcaccaauagaaaaaacaauaucaaaagcaaaaggccaaccaagggaaccacaagucuacacacuaccucccucuagagaugaacuaacaaaaaaccaaguaucccucacaugccuaguaaaaggauuuuacccuucagacauagcaguagaaugggaaucaaacggccaaccagaaaacaacuacaaaacaacaccaccaguacuagacucagacggcucauucuuccuauauuccaaauuaacaguagacaaaucaagauggcaacaaggcaacguauucucauguucuguaaugcaugaagcucuacacaaccauuauacucaaaaaagccuaucauuaaguccagguaaa

SEQ ID NO: 46619 - RNA, 1353 nt, Artificial Sequence
  derived and/or modified sequence opt6 from Rituximab_HeavyChain_variant
caaguacaauuacaacaaccuggagcagaacuaguaaaacccggagccucagucaagaugucaugcaaagcaucuggauauacauuuacauccuacaacaugcauuggguaaaacaaacaccaggacgaggacuagaauggauaggugcaauuuauccuggcaacggagacaccucauauaaccaaaaauucaaaggaaaagcaacacuaacagccgauaaaucaagcucaacagcauacaugcaauuaucaucacucacuucagaggauucagcagucuacuacugcgcacgauccaccuacuauggcggcgacugguacuuuaauguauggggcgcaggaaccacaguaacagucagcgccgcaucaacaaaaggacccucaguauucccucuagccccaucaagcaaaucaacaucaggaggaacugcagcacuuggauguuuagucaaagauuacuuccccgaacccguaaccguaucauggaacucaggagcuuuaacuucaggcguacacacauuccccgcugucuuacaaaguucaggacuauacucacuaucaucaguaguaacaguacccaguucaucauuaggcacacaaacuuacauuugcaacgucaaccauaaaccaucaaacacaaaaguagauaaaaaagcagaaccaaaaucuugcgauaaaacccacacaugcccaccaugcccagcaccagaacuccuaggaggaccaucaguauuccuauuccccccaaaaccaaaagacacauuaaugauauccagaacaccugaaguuacauguguaguaguagaugucucacacgaagacccagaaguaaaauuuaauugguacguagacggaguagaaguccacaacgcaaaaaccaaaccucgagaagaacaauacaacucaacauacagaguaguaucuguacuaacaguacuccaccaagacuggcucaacggaaaagaauauaaaugcaaaguaucaaacaaagcacuaccugcaccaaucgaaaaaacaauaucuaaagcaaaaggacaaccaagagaaccccaaguauacacauuaccaccaagccgagacgaacuaacuaaaaaccaaguaucacuuacaugcuuaguaaaaggauucuacccaucagauauagcaguagaaugggaaucaaacggacaaccagaaaauaacuacaaaacaacaccaccaguacucgauuccgacggaucauuuuuucuauacucaaaacuaaccguagacaaaucaagauggcaacaaggaaauguauucucaugcucaguaaugcaugaagcauuacauaaccacuacacacaaaaaucacuaucacuaucaccaggaaaa

SEQ ID NO: 46620 - RNA, 639 nt, Artificial Sequence
  derived and/or modified sequence opt6 from Rituximab_LightChain
caaauaguauuaucacaaucacccgccauacuaucagcaucaccaggcgaaaaaguaacaaugacaugcagagcaucaucaucaguaucauacauacacugguuccaacaaaaaccaggaucaucaccaaaaccauggauauacgcaacaucaaacuuagcaucaggaguaccaguaagauucucaggaucaggcucaggaacaucauacucacuaacaauaucaagaguagaagcagaagacgcagcaacauacuacugccaacaauggacaagcaauccaccaacauucggaggaggaacaaaacuugaaauaaaaagaacaguagcagcaccaucaguauuuauauuuccaccaucagaugaacaacuaaaauccggaacagcaucaguaguaugccuacuaaacaacuucuacccuagagaagcaaaaguacaauggaaaguagacaaugcacuacaaucaggaaacucacaagaaucaguaacagaacaagacucaaaagacucaaccuacucauuaucaucaacacuaacacuaucaaaagccgacuacgaaaaacacaaaguauacgcaugcgaaguaacacaccaaggccuaucauccccaguaacaaaauccuucaacagaggagaaugc

SEQ ID NO: 46621 - RNA, 714 nt, Artificial Sequence
  derived and/or modified sequence opt6 from Rivabazumab_pegol_HeavyChain1
gaaguacaacuaguagaaucaggagguggaguaguacaaccaggcagaucacuacgacuaucaugcgcagccaguggauucacauucucaaauuacccaaugcacuggguaagacaagcaccaggaaaaggcuuagaauggguagcaguuauaucauaugacggaucagaaaaaugguacgcagacucaguaaaaggaagauuuacaauaucaagagauaauagcaaaaacacauuauacuuagaaaugaacucauuaagaccagaagauacagcaguauauuauugcgccagaaacagaggagacauauacuaugacuuuacauaugcaauggacauauggggccaaggaacaacuguaacaguaagcagcgcaucaacaaaaggaccaucaguauuuccacuagcaccuucaucaaaaucaacaagcggcggaacagcagcacuaggauguuuagucaaagacuauuucccagaaccaguaacaguaucauggaacagcggagcacuaacaucaggaguacauacauuuccagcuguacuacaaucaucaggucuauauucauuaucaaguguaguaacaguuccaucaucaaguuuaggaacccaaacauacauauguaacguaaaccauaaaccaagcaacacaaaaguagacaaaaaagucgaaccaaaaucaagugacaaaacacauacaugucccccaugcccagca

SEQ ID NO: 46622 - RNA, 642 nt, Artificial Sequence
  derived and/or modified sequence opt6 from Rivabazumab_pegol_LightChain1
gauauucaacuaacacaaucaccaucaacacuaagcgcaagcguaggagauagcguaacaauaacaugcagagcaagugaaggaguagacagauggcuagcaugguaccaacaaaaaccaggaagagcuccaaaacuccuaauauaugacgcaucaacacuacaaagcggaguaccaucaagauucucaggaucaggaucaggaacagaauuuagccuaaccauaaguucacuccaaccagaugacguagcaacauacuauugccaacacuuuuggggaacaccauacacauucggacaaggaacaaaacuagaaauaaaaagaacaguagcagcaccaucaguauucauauucccaccaucagacgaacaauuaaaaucaggcacagcaucaguaguaugcuuacuaaacaacuuuuacccaagagaagccaaaguccaauggaaagucgauaacgcacuacaaucaggaaacucacaagaauccguaacagaacaagacagcaaagacucaacauacagccuaucaucaacauuaacauuaagcaaagccgauuacgaaaaacauaaaguauacgcaugcgaaguaacacaccaaggauuaucaucuccaguaacaaaaucauuuaacagaggagaauca

SEQ ID NO: 46623 - RNA, 1344 nt, Artificial Sequence
  derived and/or modified sequence opt6 from Robatumumab_HeavyChain1
gaaguucaacuaguccaaucaggaggaggauuaguaaaacccggaggaucacuuagauuaucaugcgcagcuaguggauuuacuuuuucaucauucgcaaugcauuggguaagacaagccccaggcaaaggauuagaauggauaucaguuauagauacaagaggugcaacauacuaugccgacucaguaaaaggcagauucacaauuucacgagauaacgccaaaaauucuuuauacuuacaaaugaacucacuacgagccgaagacacagccguuuacuacugcgcaagacuaggaaacuucuacuauggcauggauguuuggggacaaggcacaacaguuacaguauccucagcuuccaccaaaggaccaucuguuuuuccucuagccccaucaucaaaaucaacaucaggaggaacagccgcacuagguugcuuaguuaaagacuauuucccagaaccaguuacaguaucuuggaauagcggugcuuuaacuuccgguguacauacauucccagccgucuuacaauccucuggccuauacucacuaucauccguaguuacaguaccauccuccucacuaggaacacagacauacauaugcaacguuaaccauaaaccaucaaacacaaaagucgacaaaaaaguagaaccuaaauccugugauaaaacacacaccugucccccauguccagcacccgaacuauuaggaggaccauccguauuucuauuuccaccaaaaccaaaagacacauuaaugauaucaagaacaccagaaguaacauguguaguaguagacguaucacaugaagaccccgaaguaaaauucaacugguacguagacggaguagaaguacauaacgcaaaaacaaaacccagagaagaacaauauaacucaacauauagaguuguaucaguauuaacaguacuucaccaagacuggcucaacgguaaagaauauaaaugcaaagucucgaacaaagcauuaccugcaccuauagaaaaaacaauaucaaaagcuaaaggacaaccaagagaaccacaggucuauacacucccaccaagcagagacgaauuaacuaaaaaucaaguuucacuuacuugucuuguaaaaggauucuauccaucagacauugcaguagaaugggaaucaaacggacaaccagaaaacaauuacaaaacaacacccccuguacuagacucagacgguuccuucuuccuauacucuaaauuaacaguagauaaaucaagauggcaacaaggcaacgucuucucuuguucagucaugcaugaagcccuccacaaccauuacacucaaaaauccuuaucacucucuccaggaaaa

SEQ ID NO: 46624 - RNA, 642 nt, Artificial Sequence
  derived and/or modified sequence opt6 from Robatumumab_LightChain1
gaaauaguacuaacacaaucaccaggaacacuaucaguaucaccaggagaaagagcaacacuaucaugccgagcaucacaaucaauaggaucaucacuacacugguaccaacaaaaaccaggacaagcaccaagauuauuaaucaaauacgcaucacaaucacuaucaggaauaccagacagauucucaggaucaggaucaggaacagacuucaccuuaaccauauccagacuagaaccagaagacuucgcaguauacuacugccaccaaucaagccgacuaccacacacauucggacaaggaacaaaagucgaaauaaaacgaacaguagcagccccaucuguauucauauucccaccaucagacgaacaacuaaaaucaggaacagcaucaguaguaugccuauuaaacaacuucuacccaagagaagcaaaaguucaauggaaaguagacaacgcacuacaaucaggaaacucacaagaaucaguaaccgaacaagacucaaaagacucaacauacucacuaaguucaacauuaacacuaucaaaagccgacuacgaaaaacacaaaguauacgcaugcgaaguaacacaccaaggacuaucaucaccaguaacaaaaucauucaacagaggagaaugc

SEQ ID NO: 46625 - RNA, 1368 nt, Artificial Sequence
  derived and/or modified sequence opt6 from Roledumab_HeavyChain1
caaguacaacuaguagaaucagguggcgguguugugcaaccaggaagaucucuuagauuaucauguacagcauccggauucacuuucaaaaacuaugcaaugcacuggguacgacaagcaccagcaaaaggacuagaauggguagcaacaauuaguuaugacggaagaaacauacaauacgcagauucaguaaaaggaagauucacauucucaagagacaacucacaagacacauuauaucuacaauuaaacagucuaagacccgaagauacugcagucuauuacugcgcaagaccaguaagaucaagauggcuccaauuaggauuagaagaugcauuccacaucuggggacaaggaacaaugguaacagugucuuccgcaucaacuaaaggacccaguguauucccauuagcaccaucaucaaaaucaacuuccggggguacugcagcacuaggaugucuaguaaaagauuauuuuccagaaccaguaacaguaucauggaauucaggagcacuaacaucaggaguacauacauucccugcaguccuacaaucaucuggacucuacucuuuaucaucagucguaacuguaccauccaguucauuagguacucaaacauacauaugcaauguaaaccacaaaccaucuaauacaaaaguugacaaaaaaguagaaccaaaaucaugugacaaaacacauacaugcccaccaugccccgcaccagaauuauuaggcggaccaucaguauucuuauuccccccaaaaccaaaagauacauuaaugauuucaagaacaccagaaguaacuuguguaguugucgauguaucacacgaagacccagaagucaaauucaacugguacguagauggaguagaaguacauaacgcuaaaacaaaaccccgagaagaacaauacaacuccacuuacagagucgucaguguacuaacaguacuacaccaagacuggcuaaacggaaaagaauauaaauguaaagucucaaacaaagcauuaccagcaccaauagaaaaaacaauauccaaagcuaaaggucaaccacgagaaccacaaguauacacacuaccaccaucaagagacgaauuaacaaaaaaccaaguaucauuaacauguuuaguaaaaggauuuuauccaucagacauagcaguagaaugggaaucaaacggacaaccagaaaauaacuauaaaacaacaccaccuguauuagacagcgacggauccuucuuuuuauacucuaaacuaacaguagacaaaagcagauggcaacaaggaaauguauucucuugcucaguaaugcaugaagcauuacacaaucacuacacacaaaaauccuuaucacuauccccuggaaaa

SEQ ID NO: 46626 - RNA, 642 nt, Artificial Sequence
  derived and/or modified sequence opt6 from Roledumab_LightChain1
gccaucagaaugacacaaucaccaucaucauucuccgcaucaacaggagacagaguaaccauaacaugccgcgcaucacaagauauacgaaacuacguagcaugguaucaacaaaaauccggaaaagcacccaaauuccuaauauacgcagcaucaacacuacaauccggaguaccaucuagauucucaggaucaggaucaggaacagacuuuacauuaacaauaaacucacuacaaucagaagacuucgccacauacuacugccaacaauacuacaacucaccaccaacauucggacaaggaaccagagucgaaauaacaagaacaguagcagcaccaucaguauucauauucccaccaucagacgaacaacuaaaaucaggaacagcaucaguaguaugccuacuaaauaacuucuacccaagagaagcaaaaguacaauggaaagucgacaaugcacuacaauccggaaacucacaagaaucaguaacagaacaagacucaaaagacucaacauacagccuuucaucaacccuaacccuaagcaaagcagacuacgaaaaacacaaaguauacgcaugcgaaguaacacaccaaggacuauccucaccagucacaaaaucauucaacagaggagaaugc

SEQ ID NO: 46627 - RNA, 639 nt, Artificial Sequence
  derived and/or modified sequence opt6 from Romosozumab_fab_fragment
gauauacaacuaacacaaucaccaucuucacuaucagcaagcguaggcgaccgaguaacaauaaccugcucagcaucacaagacauaucaaacuacuuaaacugguaccaacaaaaacccggaaaagcaccuaaaguauuaauauacuucacaucaucacuacacucaggcguaccaucaagauucucaggaucaggaucaggcacagacuucacccuaacaauauccucacuacaaccagaagacuucgccacauacuacugccaacaauacuccacaguaccauggacauucggacaaggaacaaaaguagaaauaaaaagaacaguagcagccccaucaguauucauauucccaccaucagacgaacaacuaaaaucaggaacagcaucaguaguaugccuauuaaacaacuucuacccaagagaagcaaaaguacaauggaaaguagacaacgcacuacaaagcggaaacucacaagaaucaguaacagaacaagacucaaaagacucuacauacagccuaucaucaacacuaacacuaucaaaagcagacuacgaaaaacacaaaguauacgcaugcgaaguaacacaccaaggacuaucaucaccaguaacaaaaucauuuaacagaggagaa

SEQ ID NO: 46628 - RNA, 1347 nt, Artificial Sequence
  derived and/or modified sequence opt6 from Romosozumab_HeavyChain1
gaaguacaacuaguacaaagcggagcagaaguuaaaaaaccaggagcaucagucaaaguauccuguaaagcaucaggauacacauuuacagauuacaauaugcacugggucagacaagcaccaggacaaggacuagaauggaugggagaaauaaauccaaacuccggaggagcaggcuauaaccaaaaauuuaaaggaagaguaacuaugacaacagacacaagcacuucaacugccuauauggaacuuagauccuuaagaucugacgacacagcuguauauuacugcgcaagacuaggauaugacgauauauacgaugacugguauuuugacguauggggacaaggaacaacagucacuguuucaagcgcaucaaccaaagguccaucaguauuuccacuagcaccaugcucaagaucaacaucagaaucaacugcagcacuuggcugcuuagucaaagacuacuucccagaaccuguaacuguaucauggaacuccggagcacuaacaagcggaguccauacauucccugcaguacuacaaucgagcgggcuauauuccuuaucaucaguaguaacaguaccaucaaguaauuuuggaacacaaacauacacauguaauguagaucauaaaccaucaaauacaaaaguagauaaaacaguugaacguaaaugcuguguagaauguccaccauguccagcaccaccaguagcaggaccaaguguauucuuauucccacccaaaccaaaagauacacuaaugauaucaagaacaccagaaguaacuugcguaguaguagauguaagucaugaagauccugaaguacaauucaauugguaugucgaugguguugaaguacacaacgcaaaaacaaaaccacgugaagaacaauuuaacucgacauuuagaguaguaucaguccuaacaguaguacaccaagacuggcuaaacgguaaagaauacaaauguaaaguaucuaacaaaggacuaccagcaccuauagaaaaaacaauaucaaaaacaaaaggacaaccaagagaaccacaaguauauacuuuacccccaucuagagaagaaaugaccaaaaaucaaguaucacuaacaugccuaguaaaaggauuuuacccauccgauauagcaguagaaugggaaucaaauggacaaccagaaaacaauuacaaaacaacaccaccaauguuagacuccgauggaaguuuuuucuuauacucaaaacuaacaguagacaaaagccgauggcaacaaggaaacguuuucagcuguucgguaaugcaugaagcacuacauaaccauuacacacaaaaaucacuaucacuaucacccggaaaa

SEQ ID NO: 46629 - RNA, 642 nt, Artificial Sequence
  derived and/or modified sequence opt6 from Romosozumab_LightChain1
gacauacaaaugacacaaucaccaucaucacuaagcgcaucaguaggagaccguguaaccauaacaugcagagcaucccaagacauaagcaacuaccuaaacugguaccaacaaaaaccaggaaaagcaccaaaacuauuaauauacuacacaucaagacuauuauccggaguaccaucaagauucucaggaucaggaucaggaacagacuuuacacuaacaauaucaucacuacaaccagaagacuucgcaacauacuauugccaacaaggagacacacuaccauacacauucggaggcggaacaaaaguugaaauaaaaagaacaguagcagcaccaagcguauucauauucccacccucagacgaacaacuaaaaucaggaacagccucaguaguauguuuacuuaauaacuucuacccaagagaagcaaaaguacaauggaaaguagacaacgcacuacaaagcggaaacucccaagaaucaguuacagaacaagacucuaaagauucaacauacagccuaagcucaacacuaacacuaagcaaagcagacuacgaaaaacacaaaguauacgcaugugaaguaacacaccaaggacuauccucaccaguaacaaaaagcuucaacagaggagaaugc

SEQ ID NO: 46630 - RNA, 1326 nt, Artificial Sequence
  derived and/or modified sequence opt6 from Rontalizuab_HeavyChain1
gaaguacaacucgucgaaucuggaggaggacuaguacaaccaggaggaucacuaagacuaaguugugcaacuagcggauauacauuuacagaauacauuauacauuggguaagacaagcacccggcaaaggacuugaauggguagcaucaauaaacccagacuacgacaucaccaacuacaaucaacgauucaaaggaagauucacuauaucauuagacaaauccaaacgcacagccuacuuacaaaacuccuuaagagcagaagauacagcugucuacuauugugcaucauggauaucagauuuuuuugacuauuggggacaaggaacccuaguaacaguaucaucagcaucaacaaaaggacccaguguauucccacuugccccaucaucaaaaucaacuucuggaggaacggccgcacuaggaugccuagucaaagacuacuucccugaaccaguaacaguaucauggaacucaggagcccuaacauccggaguacauacuuuuccagcaguacuacaaucaucaggccuauacucauuaucauccguagucacaguaccaucaucuucacuagguacccaaacuuauauauguaauguaaaucacaaacccucaaacaccaaaguagacaaaaaaguagaaccaaaaucaugcgauaaaacacacaccuguccaccuuguccagcaccagaacuauuaggaggcccaucaguauuccuauucccuccuaagccaaaagauacacuaauaucccgaacaccagaagucacaugcguaguaguagacgucucucacgaagacccagaaguaaaauucaacugguacgucgauggagucgaaguacauaaugccaaaaccaaaccuagagaagaacaauauaauucaacauacagaguuguaucaguacuuacaguacuacaccaagacugguuaaacgguaaagaauacaaauguaaaguauccaauaaagccuuaccagcaccaauagaaaaaacaauaucaaaagccaaaggucaaccaagagaaccacaagucuacacacuacccccaucaagagaagaaacaaaaaaucaaguuucacuaacaugucuaguaaaagguuucuacccauccgacauagccguagaaugggaauccaacggacaaccagaaaauaacuacaaaacaacaccaccaguauuagauucagacggaaguuucuuucuauauucaaaauuaacaguagacaaaucacgcuggcaacaaggaaacgucuucucaugcucuguacacgaagcacuacauaaucauuacacacaaaaaucucuuucccucucaccugga

SEQ ID NO: 46631 - RNA, 648 nt, Artificial Sequence
  derived and/or modified sequence opt6 from Rontalizuab_LightChain1
gauauacaaacacaaucaccaucaucacuaucagcaucaguaggcgacagaguaacaauaacaugcagagcaucacaaucaguaucaacaucaucauacucauaccacugguaccaacaaaaacccggaaaagcaccaaaaguacuaauaucauacgcaucaaaccuagaaucaggcguaccaucaagauucuccggauccggaucaggaacagacuucacacuaacaauauccucacuacaaccagaagacuucgcaacauacuacugccaacacuccuggggaauaccaagaacauucggacaaggaacaaaaguagaaauaaaacgaacaguagcagcaccauccguauucauauucccaccaucagaugaacaacuaaaaucaggaacagcaucuguaguaugccuacuuaacaacuucuacccaagagaagcaaaaguacaauggaaaguagacaacgcacuacaaucuggaaacucacaagaaucaguaacagaacaagacuccaaagacuccacauacucauuaucaucaacacuaacauuaucaaaagcagacuacgaaaaacacaaaguauacgcaugcgaaguaacacaccaaggacuaucaucaccaguaacaaaaucauuuaacagaggcgaaugc

SEQ ID NO: 46632 - RNA, 1341 nt, Artificial Sequence
  derived and/or modified sequence opt6 from Rontalizumab_HeavyChain1
gaaguucaacuagucgaaucaggaggcggauuaguucaaccaggaggaucacuaagacucucaugcgccacaucaggauacacauucacagaauauauaauccacuggguaagacaagcaccuggaaaaggacuagaauggguagccagcauaaacccagacuacgacauaaccaacuacaaucaaagauuuaaagguagauucacaaucuccuuagacaaauccaaacguacagcauaccuccaaaugaauagccuaagagcagaagacacagccguauauuacugcgcaucuuggauaucagacuuuuucgauuacuggggacaaggaacccuugucacaguaagcuccgccucaacaaaaggaccaaguguauucccauuagcacccucaucaaaaucaaccuccggaggaaccgccgcacuuggcuguuuaguaaaagauuacuuccccgaaccuguaacaguaaguuggaacagcggagcacuuacaucuggaguacauacuuucccagcaguacuacaaucauccggccucuacagucuaucuucaguuguaaccguaccaucaucaucacuaggaacccaaacauauaucugcaauguaaaccacaaaccaucaaacacaaaaguagacaaaaaaguagaaccaaaaucaugcgacaaaacacacaccugcccaccaugccccgcccccgaauuacuuggagguccaaguguauucuuauuuccacccaaaccaaaagacaccuuaaugauuucaagaacaccagaaguaacauguguaguuguagacgucucacacgaagacccagaaguaaaguuuaacugguacguagacgguguagaaguccacaaugcaaaaacaaaaccaagagaagaacaauacaauucaaccuacagaguugucagcguauuaaccguacuucaucaagacuggcuaaacggaaaagaauacaaauguaaaguaucaaacaaagcauuacccgcccccaucgaaaaaacaauaagcaaagcuaaaggccaaccacgagaaccucaaguauacacauuaccacccucaagagaagaaaugacaaaaaaccaaguaucacuaacaugccuaguaaaaggcuucuaccccucagauaucgcagucgaaugggaaucuaacggacaaccagaaaacaauuauaaaacaacaccacccguacuagacagugauggcucauuuuuucuauauucaaaauuaaccguagauaaaucucgauggcaacaaggaaacguauucucaugcucagucaugcacgaagcacuacacaaucauuacacacaaaaaucacuaucacuuucacccggaaaa

SEQ ID NO: 46633 - RNA, 654 nt, Artificial Sequence
  derived and/or modified sequence opt6 from Rontalizumab_LightChain1
gacauacaaaugacacaaucacccucaucauuauccgcaucaguaggagacagaguaacaauaacaugcagagcaagccaaaguguaucaacaucaucauacucauacaugcacugguaccaacaaaaaccaggaaaagcaccaaaaguacuaauaucauacgcaucaaaccucgaaucaggaguaccaucaagauucucaggaucaggaucaggaacagacuucacacuaacaauaucaucacuacaaccagaagauuucgcaacauauuacugccaacacucauggggcauaccaagaacauucggacaaggaacaaaaguagaaauaaaaagaacaguagcagcaccaucaguauucauauucccaccaucagacgaacaacuaaaaucaggaacagcaucagucgucugccuacuaaacaacuucuacccaagagaagcaaaaguccaauggaaaguagacaacgcacuacaaucaggaaacucccaagaaucuguaacagaacaagacagcaaagacucaacauacagcuuaagcucaacacuaacacuaucaaaagcagacuacgaaaaacacaaaguauacgcaugcgaaguaacacaccaaggauuaucaucaccaguaaccaaaucauuuaacagaggagaaugc

SEQ ID NO: 46634 - RNA, 1341 nt, Artificial Sequence
  derived and/or modified sequence opt6 from Rovalpituzumab_tesirine_HeavyChain1
caaguacaacuaguacaaucaggagcagaaguaaaaaaaccaggcgcaagcguaaagguaucuugcaaagcaucagguuacacauuuacaaacuacggaaugaauuggguaagacaagcaccaggacaaggacuagaauggaugggcuggauaaacaccuacacaggagaacccacuuaugcagacgauuuuaaaggaagaguaacaaugacaaccgacacauccacauccaccgcauauauggaacuaagaucacuaagaucugaugacacagccguauacuacugugcaagaaucggagacucaucacccucagacuauuggggacaaggaacacuaguaacaguuucaucagcuucaacaaaaggaccaucaguauucccacuagcacccucuaguaaaucaacaucuggcggaacagcagcacuaggauguuuaguaaaagacuacuucccagaaccaguaacuguaucauggaacucaggagcucuaacauccggcguccacacauucccagcaguuuuacaaucaucaggacuauacucccucucaucaguaguaacaguaccauccagcucuuuaggcacccaaacauauauaugcaacguaaaccauaaaccaucuaacacaaaagucgacaaaaaaguagaaccaaaaucaugcgauaaaacccacaccugcccaccaugcccagccccagaacuacuagguggaccaucaguuuuucucuucccaccaaaaccaaaagacaccuuaaugauaucacgcaccccugaaguaacaugcguaguaguagacguaucacaugaagacccagaaguaaaguucaacugguacguagauggaguagaaguacacaaugcaaaaaccaaaccaagagaagaacaauauaauucaacauacagaguagucucaguacuaacaguauuacaucaagacugguuaaacggaaaagaauacaaaugcaaaguaucaaauaaagcacuaccagcaccaauagaaaaaacuauaucaaaagcuaaaggucaaccaagagaaccacaaguauacacauuaccacccaguagagaugaauuaacaaaaaaccaaguaucacucacaugccuaguuaaaggauuuuaccccucugacauagcaguagaaugggaaucaaacggacaaccagaaaacaacuauaaaacaacaccaccaguauuagauucagauggaucuuuuuucuuauauucuaaacuaacaguagacaaaucacgcuggcaacaagguaauguuuuuagcugcucaguuaugcacgaagcacuacacaaucacuacacccaaaaaucacuaucacucucacccgga

SEQ ID NO: 46635 - RNA, 642 nt, Artificial Sequence
  derived and/or modified sequence opt6 from Rovalpituzumab_tesirine_LightChain1
gaaauaguaaugacacaaucaccagcaacacuaucaguaucaccaggagaacgagcaacacuauccugcaaagcaucacaaucaguauccaacgacgucguaugguaucaacaaaaaccaggacaagcaccaagacuacuaauauacuacgcauccaacagauacacaggaauaccugcaagauucuccggcucaggaucaggaacagaauucacauuaacaauauccucucuccaauccgaagacuucgccguauacuacugccaacaagacuacacaucaccauggacauucggacaaggaaccaaacucgaaauaaaacgaacaguagcagcaccauccguauucauauucccaccaucagacgaacaacuaaaaucaggaacagcuucagucguaugcuuauuaaacaacuucuacccaagagaagcaaaaguacaauggaaaguagacaacgcacuacaaucaggaaauucacaagaaucaguaacagaacaagacucaaaagacucaacauacucacuaucaucaacccuaacacuauccaaagcagacuacgaaaaacacaaaguauacgcaugcgaaguaacacaccaaggauuaucaucaccaguaacaaaaucauucaacagaggagaaugu

SEQ ID NO: 46636 - RNA, 1341 nt, Artificial Sequence
  derived and/or modified sequence opt6 from Rovelizumab_HeavyChain1
caaguucaacuaguacaaucaggagccgaaguaaaaaaaccaggagcauccguaaaaguaagcuguaaagccagugguuauacauucacaaauaauuggaugcaauggguaagacaagcgccuggacaaggauuagaauggaugggagcaauuuuucccggagacgaugaaacaagauauacacaaaaauuuagaggcaaagcaacuauaacagcagacacaucaacgucaacagcauauauggaacuuucaagccuuagaucagaagacacagcaguauauuacuguggaagagguggaaaacuaagaccauucgcuuuagauuacuggggccaagguacacuaguaacaguaucuuccgcuaguacaaaagguccauccguguuuccacuagcaccaugcucaagaucaacaucagaaucaacugcagcauuagguugccuaguaaaagacuacuuuccagaaccaguaacaguaucuuggaauagcggagcucuaacaagcggcguacacacauuuccagcaguacuccaaucaucaggauuauacuccuuaagcagcguaguaacaguaccaagcucaucauuaggaacaaaaacauauacauguaacguagaucacaaaccaucaaauacaaaagucgauaaaagaguagaaucaaaauauggaccaccaugcccuucaugcccugcuccagaauuccuaggugguccaaguguauucuuauuccccccaaaaccaaaagacacauuaaugauaucucguacaccagaaguaacaugcguagucguagauguaagucaagaagauccugaaguccaauuuaacugguauguugacggcguagaaguacauaacgcaaaaacaaaaccuagagaagaacaauucaacucaacauauagaguagucucaguauuaaccguacuacaccaagauugguuaaacggaaaagaauacaaauguaaagucucaaauaaagguuuaccaucaucaaucgaaaaaaccauaucaaaagcuaaaggucaacccagagaaccacaaguauauacacuaccaccuucccaagaagaaaugacuaaaaaccaagucucacuaacaugccuaguaaaaggauuuuauccgagugacauagccguagaaugggaauccaacgggcaaccagagaauaauuauaaaacaacuccaccaguauuagacucagauggcaguuuuuuucuauauucacgccucaccguagauaaaaguagauggcaagaaggaaauguauuuucaugcucaguaaugcacgaagccuuacacaaccauuacacacaaaaaucauuaucccuaucacuaggaaaa

SEQ ID NO: 46637 - RNA, 654 nt, Artificial Sequence
  derived and/or modified sequence opt6 from Rovelizumab_LightChain1
gacauacaaaugacacaaucaccaucaucccuauccgcauccguaggagacagaguaacaauaacaugccgagcauccgaaucaguagaaucauacggaaacaacuucauguacugguaccaacaaaaaccaggaaaagcaccaaaacucuuaauauaccuagcaucaaacuuagaaucaggcguaccaucaagauucucaggaucaggaucaggcaccgacuucacacuaacaauaucaucacuacaaccagaagacuuugcaacauacuacugccaccaagacaaugaagacccaccaacauucggacaaggaaccaaacucgaaauaaaacgaacaguagcagcaccaucaguauucauauucccaccaucugacgaacaauuaaaaucaggcacagcaucaguagucugccuacuaaacaacuucuacccaagagaagccaaaguccaauggaaaguagacaacgcacuacaaucaggaaacucccaagaaucaguaacagaacaagauucaaaagacucaacuuacucacuaucaucaacacuaacccuaucaaaagcagacuaugaaaaacacaaaguauacgcaugcgaagucacacaccaaggacuaucauccccaguaacaaaaucauucaacagaggagaaugc

SEQ ID NO: 46638 - RNA, 1341 nt, Artificial Sequence
  derived and/or modified sequence opt6 from Ruplizumab_HeavyChain1
caaguacaacuaguccaaucaggagcagaaguaguaaaaccaggagcauccguaaaacuaucaugcaaagcaucaggauauaucuuuacaagcuauuacauguacugggucaaacaagccccaggccaaggauuagaauggauaggcgaaauaaaccccucuaauggagacacaaacuucaaugaaaaauuuaaauccaaagcaacucuaaccguagacaaaagcgcaucaacagcauauauggaauuaucuagcuuaagaucagaagauacagccguauacuauuguacaagaucagacggaagaaacgacauggauagcuggggccagggcacacucguaacaguuucaucagcauccacuaaaggcccaucaguauucccacuagcaccuagcucuaaaucaacaucaggaggaacagcagcacucggauguuuagucaaagacuauuucccagaaccaguaacaguuucauggaauuccggagccuuaacuucaggaguacacacauucccagccguauuacaaucaagcggacuauauucacuaucuuccguagucacaguaccaucaucaucauuagguacucaaacauacauaugcaacguaaaucacaaacccaguaacaccaaaguagauaaaaaaguagaaccaaaaucaugugacaaaacacacacauguccuccauguccagcuccagaacuauuaggaggcccaucaguauuucuauuuccaccuaaacccaaagacacacuaaugaucucaagaacaccugaaguaacaugcguaguaguagauguaucccacgaagauccggaagucaaauucaauugguacguagauggcguagaaguacauaacgccaaaacaaaaccaagagaagaacaauauaauucaaccuaccgaguagucagcguacuaacaguccuacaccaagacuggcucaacggaaaagaauauaaauguaaaguuucaaacaaagcauuaccagcccccauagaaaaaacaauuucuaaagcaaaaggacaaccaagagaaccucaaguauacacacuaccuccuucaagagacgaacuaacaaaaaaccaaguaucccuaacaugccuaguuaaaggcuucuacccaagcgacaucgcugucgaaugggaaucgaacggacaaccagaaaauaacuacaaaaccacaccaccaguacuagacuccgacggaucauuuuuccuauauucaaaacuaacagucgacaaaucaagauggcaacaagguaauguauucucaugcuccguaaugcacgaagcacuucacaaccacuacacucaaaaaucucuaucauuaucccccgga

SEQ ID NO: 46639 - RNA, 654 nt, Artificial Sequence
  derived and/or modified sequence opt6 from Ruplizumab_LightChain1
gacauaguacucacacaaucaccagcaacauuaucaguaucaccaggagaaagagcaacaauauccugcagagcaucacaacgaguaucaucaucaacauacucauacaugcacugguaccaacaaaaacccggccaaccaccaaaauuacuaauaaaauacgcauccaaccuagaauccggaguaccagcuagauucucaggaucaggaucaggcacagacuucacacuaacaauauccucaguagaaccagaagacuucgccacauacuacugccaacacucaugggaaauaccaccaacauucggaggaggaaccaaacucgaaauaaaacgcacaguugcagccccaucaguauuuauauucccaccauccgacgaacaacuaaaaucaggaacagcaucaguagucugccuacucaauaacuucuacccaagagaagcaaaaguccaauggaaaguagacaacgcacuacaaucaggaaacucacaagaaucaguaacagaacaagauucaaaagauucaacauacucacuaucaucaacauuaacauuaucaaaagcagacuaugaaaaacacaaaguauacgcaugcgaaguaacacaucaaggacuaucaucaccaguaacaaaaucauucaacagaggagaaugc

SEQ ID NO: 46640 - RNA, 1353 nt, Artificial Sequence
  derived and/or modified sequence opt6 from Sacituzumab_govitecan_HeavyChain1
caaguacaacuacaacaaucaggauccgaacucaaaaaaccaggcgcaucaguaaaaguaucauguaaagcaucaggauacacauuuacaaacuauggcaugaacuggguaaaacaagcacccggacaaggacuaaaauggaugggauggauaaacacauauaccggagaaccaacauacacugacgacuucaaaggaagauucgcuuuuucacuagauacuuccguaucaacagcauaccuucaaauaaguucauuaaaagcagacgacacagcaguauacuucugcgcaagaggcggcuucggaucuucauauugguacuuugacgucuggggacaaggaucacuaguaacaguaucaagugccucaacaaaaggacccucaguauuuccacuagccccaagcucuaaaucaaccucaggaggaacagcagcacuaggauguuuaguaaaagacuauuucccagaaccaguaaccguaucauggaauucaggagcacuaacaucuggaguacacacauucccugcaguacuacaaucaucaggccuauacucacuaucaucaguaguaacugucccaucaucuucucucggaacacaaacauauauaugcaauguuaaccauaaacccucaaauaccaaaguagacaaaagaguagaaccaaaaucaugcgauaaaacacauacaugcccaccuugcccagccccugaacuacuuggaggcccuucuguauuccucuuuccaccaaaaccaaaagacacauuaaugauaucaagaaccccugaaguaacauguguaguaguagacguaucacaugaagacccagaaguaaaauuuaauugguacgucgacggagucgaaguacacaaugcuaaaacaaaaccaagagaagaacaauauaacucaacauauagaguaguaucaguuuuaaccguacuccaucaagauugguuaaauggcaaagaauacaaauguaaaguaucaaauaaagcacuaccugcaccaaucgaaaaaacaauauccaaagcaaaaggacaaccaagagaaccccaaguauacacacucccccccucaagagaggaaaugacaaaaaaccaggucuccuuaacauguuuagucaaaggcuuuuauccaucugacauugcaguagaaugggaauccaauggacaaccagaaaacaauuacaaaacaacacccccaguacuagauucagauggaucauuuuuccuauauucuaaacuaacaguagauaaaucuagauggcaacaaggaaacguauuuucaugcucugucaugcacgaagcacuacacaaccacuauacacaaaaaucucucuccuuaucaccaggaaaa

SEQ ID NO: 46641 - RNA, 642 nt, Artificial Sequence
  derived and/or modified sequence opt6 from Sacituzumab_govitecan_LightChain1
gacauacaacucacacaaucaccaucaucccuaucagcaucaguaggagacagaguauccauaacaugcaaagcaucacaagacguauccauagcaguagcaugguaccaacaaaaaccaggaaaagcaccaaaacuauuaauauacucagcaucauacagauacacaggaguaccagacagauuuucaggaucuggaucaggcacagacuucacacuaacaauaucaucacuacaaccagaagacuucgcaguauacuacugccaacaacacuacauaacaccacuaacauucggagcaggaacaaaaguagaaauaaaaagaacaguagcagccccaucaguauucauauucccaccaucagacgaacaauuaaaaucaggaacagcaucugucguaugccuacucaacaauuucuacccaagagaagcaaaaguccaauggaaaguagacaacgcacuacaaucaggaaacucacaagaauccguaacagaacaagacucaaaagacucaacauacucacuauccucaacacuaacacuaucaaaagcagacuacgaaaaacacaaaguauacgcaugcgaaguuacacaccaaggauuauccucuccaguaacaaaaucauuuaacagaggcgaaugc

SEQ ID NO: 46642 - RNA, 1326 nt, Artificial Sequence
  derived and/or modified sequence opt6 from Samalizumab_HeavyChain1
caaguccaauuacaacaaucaggaagcgaacuaaaaaaaccaggugcuagcguuaaaauuagcuguaaagcaucaggauacuccuucacagacuauauuauacuuugggucagacaaaaucccggaaaaggacucgaauggauaggccacauugacccauauuacggauccucaaauuacaacuuaaaauucaaaggucgcgucaccaucacagcagaucaaucaacaaccacagcauauauggaacuaucaagccuaagaucagaagauacagcagucuacuacuguggaagaaguaaaagagauuacuuugacuauuggggacaaggaaccacauuaacaguaucaucagcaucaaccaaagguccuucaguauuuccacuugcaccgugcucacgaucaacaucagaaucaacagcagcucuaggaugucucguaaaagauuacuuuccagaaccaguaacaguaucauggaacucaggagcauuaacaagcggaguacacaccuuuccagcaguacuacaaucaagcggacucuauucauuaagcuccguaguaacaguaccaucuucaaacuuuggaacacaaacauauacaugcaacguagaccauaaaccuaguaauacaaaagucgauaaaacaguagaaagaaaaugcuguguagaaugcccuccuuguccagccccaccaguagcagguccaagcguauuuuuauucccacccaaacccaaagauacacuaaugaucucaagaacuccugaaguaacaugcguaguaguagauguaucacaagaagacccagaaguccaauuuaacugguaugucgauggcguagaaguccacaaugcaaagaccaaaccuagagaagaacaauuuaauucuacauacagaguagucucuguauuaacaguccuacaucaagacugguuaaacggaaaagaauacaaaugcaaaguaucaaacaaaggauuaccaaguucaauagaaaaaacuauaucaaaagccaaaggccaaccaagagaaccacaaguauauacacuaccaccaucucaagaagaaaugaccaaaaaccaaguaucacuaacaugcuuagucaaaggauuuuaccccucagauauagccguagaaugggaaagcaauggccaacccgaaaauaauuacaaaacuacuccacccguauuagacucugacggaucauuuuuuuuauauucuagauuaacaguagacaaaaguagauggcaagaaggaaacguuuucucaugcucagucaugcaugaagcacuacacaaucacuauacucaaaaaucacuauccuuaucacuaggc

SEQ ID NO: 46643 - RNA, 642 nt, Artificial Sequence
  derived and/or modified sequence opt6 from Samalizumab_LightChain1
gacauacaaaugacacaaucaccaucaucacuaucagcaucaauaggagacagaguaaccauaacaugcaaagcaucacaagacauaaauucauacuuaucaugguuccaacaaaaaccaggaaaagcaccaaaauuacuaauauaccgagcaaacagacuaguagacggaguaccaagcagauuuucaggaucaggaucaggaacagacuacacucuaacaauaucaucacuacaaccagaagauuucgccguauacuauugccuacaauacgacgaauucccauacacauucggaggaggaacaaaacuagaaauaaaaagaacaguagcagcaccaucaguauucauauucccaccaucagacgaacaauuaaaaucaggaacagcaucaguaguaugcuuauuaaauaacuucuacccaagagaagcaaaaguacaauggaaaguagacaacgcacuacaaucaggaaacucacaagaaucaguaacagaacaagacucaaaagacucaacauacucccuaucaucaacccuaacacuaucaaaagccgacuacgaaaaacacaaaguauacgccugugaaguaacacaccaaggacuaucaucaccaguaacaaaaucauucaacagaggagaaugc

SEQ ID NO: 46644 - RNA, 1338 nt, Artificial Sequence
  derived and/or modified sequence opt6 from Sarilumab_HeavyChain1
gaaguucaacuaguagaaucagguggagguuuaguacaaccaggccgaucacuaagacuaucaugcgcagccucacgauuuacuuuugaugauuacgccaugcauuggguacgccaagccccagguaaaggacuagaaugggucuccgguauaaguuggaauucaggaagaauaggauacgccgacuccguaaaaggacgauuuacaaucucaagagacaaugcagaaaacucauuauuccuacaaaugaacgguuuaagagcugaagauacagccuuauauuauugcgcaaaaggacgagacucuuucgauauauggggacaaggaacaaugguaaccguaucaucagcaucaacaaaaggcccaucagucuucccauuagccccaucaaguaaaucuacaucugguggaacagcagcauuaggcugucuaguaaaagacuacuucccugaacccguaacaguaucuuggaacucgggagcauuaacauccggaguacacacauuucccgcaguacuacaaucaucaggcuuauacucucuauccucaguaguaacuguaccaucaucaucacucggaacacaaacauacaucugcaauguaaaccauaaaccaucaaauacuaagguugacaaaaaaguagaaccaaaaucaugcgacaaaacacacacaugcccaccaugucccgccccagaacuccucggaggaccauccgucuucuuauuuccaccaaaaccaaaagacacgcuaaugauaucacgaacaccagaagucacuugcguaguaguagacguaucccacgaagauccagaagucaaauuuaacugguacguugauggaguagaaguacacaacgcaaaaacaaaaccacgagaagaacaauacaacucaaccuaccgagucguaagcguuuuaaccguauuacaucaagacuggcuaaacgguaaagaauauaaauguaaagucuccaauaaagcauuaccagcaccaauagaaaaaacaaucaguaaagcaaaaggccaaccaagagaaccacaagucuacacacuaccaccaagcagagacgaauuaacaaaaaaccaaguaucacuaacaugccuaguaaaaggauuuuauccaucagacauagcaguagaaugggaaaguaacggccaaccagaaaauaacuauaaaacaacaccaccaguacuagacucugauggaaguuuuuuuuuauacucaaaauuaacaguagacaaaucaagauggcaacaaggaaacguauucucauguucaguaaugcacgaagcauuacacaaucauuacacacaaaaaucccuaucauugucaccaggaaaa

SEQ ID NO: 46645 - RNA, 642 nt, Artificial Sequence
  derived and/or modified sequence opt6 from Sarilumab_LightChain1
gacauccaaaugacacaaucaccaucuucaguaagcgcaucaguaggagacagaguaacaauaacaugcagagcaagccaaggaauauccucauggcuagcaugguaccaacaaaaacccggaaaagcaccaaaacuacuaauauacggcgcaucaucauuagaaagcggagucccaucaagauucucaggaucaggaucuggaacagacuucacacuaacaauaagcucacuacaaccagaagacuuugcaucauacuacugccaacaagcaaacucauucccauacacauucggacaaggaacaaaacuagaaauaaaaagaacaguagcagcaccaucaguauucauauucccaccaucagacgaacaacuaaaaucaggaaccgcaucaguaguaugccuacuaaacaacuucuacccaagagaagcaaaaguacaauggaaagucgacaaugcauuacaaagcggaaacucacaagaaucaguaaccgaacaagacucaaaagacucaacauacucauuaagcucaacauuaacauuaagcaaagcagacuacgaaaaacacaaaguauacgcaugcgaagucacacaccaaggauuaucaucaccaguaacaaaaucauucaacagaggagaaugc

SEQ ID NO: 46646 - RNA, 1296 nt, Artificial Sequence
  derived and/or modified sequence opt6 from Satumomab_pendetide_HeavyChain
caaguacaacuacaacaaucagacgcagaacuaguaaaacccggcgcaucaguaaaaauaucaugcaaagcaucaggauauacauuuaccgaccacgccauacacugggccaaacaaaaaccagaacaaggccuagaauggauuggcuacauauccccaggaaacgacgacauaaaauacaacgaaaaauuuaaaggcaaagcaacauuaacagcagacaaaaguucaaguacagcauauaugcaauuaaauucacucacaucagaagacucagcagucuauuucuguaaaagaucauacuacggacacuggggacaaggaacaacacuaacagucucaucugcauccacaaaaggcccaucaguauucccccucgcaccaugcucccgcagcacaucagaaucuacagcagcacuaggaugcuuaguaaaagacuacuuuccagaaccggucacaguaucauggaacaguggagcacuaacaucagguguacacacauucccagcaguacuacaauccucaggacuauauucacuaucaucaguaguuacaguaccauccucaucacuaggaacaaaaaccuacaccugcaacguagaccacaaaccaucuaauacaaaaguagacaaaagaguaugucccccaugcaaaugccccgccccuaacuuauuaggcggaccaucagucuucauauucccacccaaaauaaaagacgucuuaaugauaucauuaucaccuauaguuacaugcguaguaguagacguuucagaagacgacccagacguacaaauauccugguuuguaaacaaugucgaaguacacacagcucaaacacaaacacauagagaagacuacaacagcacacuaagaguaguaagcgcauuaccaauacaacaccaagacuggaugucaggaaaagaauuuaaaugcaaaguaaacaauaaagacuuaccagcaccaauagaaagaacaauuucaaaacccaaagguaguguaagagcaccacaaguauauguccuaccuccaccagaagaagaaaugacaaaaaaacaaguaacacuaaccuguauggucaccgauuuuaugccagaagauauauauguagaauggacaaacaacggaaaaacagaauuaaacuacaaaaacacagaacccguacucgauucagacggaucauauuucauguauucaaaacuaagaguagaaaaaaaaaauuggguagaacgaaacaguuacuccugcucaguaguccaugaaggacuacacaaucaccacacaacaaaaaguuucuccaga

SEQ ID NO: 46647 - RNA, 630 nt, Artificial Sequence
  derived and/or modified sequence opt6 from Satumomab_pendetide_LightChain
gacauacaaaugacacaaucaccagcaaguuuaucaguaucaguaggagaaacaguaacaauaacaugcagagcaucagaaaacauauacucaaaccuagcaugguaccaacaaaaacaaggaaaaucaccacaacuacuagucuacgcagcaacaaaucuagcagacggaguaccaucaagauucuccggaucaggaucaggaacacaauacagcuuaaaaauaaacucacuacaaucagaagacuucggauccuacuacugccaacacuucuggggaacaccauacacauucggaggaggaacaagacuagaaaucaaaagagcagacgcagcaccaacaguauucauauucccaccaucagacgaacaauuaaaaucaggaacagcaucaguaguaugccuauuaaacaacuucuacccaagagaagcaaaaguacaauggaaaguagacaacgcauuacaaucaggaaacucacaagaaucaguaacagaacaagacagcaaagacucaaccuacucauuaucaucaacauuaacauuaagcaaagccgacuacgaaaaacacaaaguauacgcaugcgaaguaacacaccaaggacuaucaucaccaguaacaaaaucauucaac

SEQ ID NO: 46648 - RNA, 1371 nt, Artificial Sequence
  derived and/or modified sequence opt6 from Secukinumab_HeavyChain1
gaaguacaacuaguugaaucaggcggaggccuaguacaaccuggaggcucauuaagauuaucaugcgcagccuccggauucacauuuagcaauuauuggaugaacuggguaagacaagcaccaggaaaaggucuagaauggguugcagcaauaaaccaagauggaucagaaaaauacuacguaggaucaguaaaaggaagauucacaauaagccgagauaacgcaaaaaacucccuauacuuacaaaugaacucacuaagaguagaagauacagcaguauacuacugugucagagauuauuaugacauauuaacagauuauuauauacacuacugguauuucgaccuauggggaagaggaacacuagucacaguaucuucggccucuacaaaaggaccaucaguuuuuccacuugccccaucaucaaaaucaacaaguggcggaacagccgcuuuaggaugcuuaguaaaagauuauuuuccagaaccaguaacaguuuccuggaacucaggagcucuaacaucaggaguacacacguucccagcuguacuacaaucaucagguuuauacucauuaaguuccguaguaacaguccccuccucaucauuaggaacacaaacauauauaugcaauguaaaccauaaaccaucaaacacaaaaguagacaaaagaguagaaccuaaaucaugcgauaaaacccacacauguccaccuugcccagcaccugaacuacuaggcggaccaucaguauuccuauucccaccuaaaccaaaagauacauuaaugauuucccgaacuccagaaguaacaugcgucguaguagacguuucacacgaagaccccgaaguaaaauucaauugguaugucgauggcgucgaaguucacaacgcuaaaacuaaacccagagaagaacaauauaacucaacuuaccgaguuguaucaguauuaacaguacuacaccaagacuggcuaaacggcaaagaauacaaaugcaaaguaucuaacaaagcacucccugcaccaauagaaaaaacaauaucaaaagccaaaggacaaccuagagaaccccaaguauacacacucccaccaucacgagaagaaaugacaaaaaaccaaguaucuuuaacuugucuuguaaaaggauuuuacccaucagauauagcaguagaaugggaaucuaacggacaaccagaaaacaauuauaaaaccacacccccagucuuagacucagacggaucauucuucuuauacuccaaacuaacaguagacaaaucaagauggcaacaaggaaauguauucucaugcucagucaugcacgaagcccuacacaaucacuauacucaaaaaucacuaucauuauccccaggaaaa

SEQ ID NO: 46649 - RNA, 645 nt, Artificial Sequence
  derived and/or modified sequence opt6 from Secukinumab_LightChain1
gaaauaguacuaacacaaagccccggaacacuaucacuaucaccaggagaaagagcaacauuaucaugcagagcaucacaaucaguaucaucaucauacuuagcaugguaccaacaaaaaccaggacaagccccacgacuacuaauauacggagcaucaucaagagcaacagguauaccagacagauuuucaggaucaggaucuggaacagacuucacacuaacaauaucaagacuagaaccagaagacuuugcaguauacuacugccaacaauacggcucuucaccaugcacauucggacaaggaacaagauuagaaauaaaaagaacaguagcagcaccaucaguauucauauucccaccauccgacgaacaacuaaaauccggaacagcaucaguaguaugccuacuaaacaacuuuuacccaagagaagcaaaaguacaauggaaaguagacaacgcauuacaaucaggaaacucacaagaaucaguaacagaacaagacucaaaagacucaacauacucauuaucaucaacacuaacacuaucaaaagcagacuaugaaaaacacaaaguauacgcaugcgaaguaacacaccaaggccuaucaucaccaguaacaaaaucauucaacagaggagaaugc

SEQ ID NO: 46650 - RNA, 1335 nt, Artificial Sequence
  derived and/or modified sequence opt6 from Seribantumab_HeavyChain1
gaaguacaacuauuagaaucgggaggagguuuaguacaaccaggaggaucacucagauuauccugcgcagcaucuggauucacauucucacacuacguaauggcauggguacgacaagcaccuggaaaaggauuagaauggguaucaucaauaucaucuucaggaggcuggacucuauacgcagacucagucaaaggaagauuuacaauaucaagagacaacaguaaaaacacacuauacuuacaaaugaauucacuacgagcugaagauacagcaguauacuauuguacccgaggauuaaaaauggcaacaaucuucgacuauuggggacaagguacacuagucacaguaucauccgcauccaccaaaggaccaagcgucuuuccauuagcuccuuguagucgaucuaccucagaaucuacagcagccuuaggaugucuaguaaaagauuacuucccugaaccuguuacaguauccuggaauucaggcgcacucacaucaggaguacacacauucccugcaguauuacaaucaucaggauuauacucauuauccaguguagucaccgucccauccucuaauuuuggaacacaaacauacacauguaacguagaucauaaacccagcaacacaaaaguugauaaaacagucgaacgaaaaugcugcguagaauguccuccauguccagcacccccuguagcaggaccaucaguauuccuauucccuccaaaaccuaaagacacacuaaugauaucaagaacaccagaaguuacaugcguaguaguagacgucucucacgaagauccagaaguacaauucaacugguacgucgauggaguagaaguccacaacgcaaaaacaaaaccaagagaagaacaauucaacaguaccuucagaguaguaucaguacuaacaguaguacaccaagacugguuaaacgguaaagaauacaaaugcaaagucucaaauaaaggacuaccagcacccauagaaaaaacaauaucaaaaacaaaaggacagccaagagaaccacaaguauauacacuaccaccaucaagagaagaaaugacaaaaaaccaaguuucauuaacuugccuaguuaaaggauuuuacccaucagauauagcagucgaaugggaaucaaauggacaaccagaaaauaauuacaaaacaaccccaccaauguuagacucagacggauccuucuucuuauacagcaaacuaacaguugacaaauccagauggcaacaaggcaacguauucucuuguuccguaaugcaugaagcuuuacacaaucauuauacacaaaaaaguuuaucacucucaccaggaaaa

SEQ ID NO: 46651 - RNA, 651 nt, Artificial Sequence
  derived and/or modified sequence opt6 from Seribantumab_LightChain1
caaucagcauuaacacaacccgcaucaguaucaggaucaccaggacaaucaauaacaauaucaugcacaggaacaucaucagauguaggaagcuacaacguaguaucaugguaucaacaacacccaggaaaagcaccaaaauuaauaauuuaugaaguaucacaaagaccaucaggaguaagcaacagauucucaggaucaaaaucaggaaacacagccucauuaacaauaagcggacuacaaacagaagacgaagcagacuacuacugcugcucauacgcaggaucaucaauauucguaauauucggaggaggaacaaaaguaacaguauuaggacaaccaaaagcagcaccaagcguaacacuauucccaccaucaagugaagaauuacaagcaaacaaagcaacacuaguaugccuaguaucagacuucuacccaggagcugucacaguagcauggaaagcagacggaucaccaguaaaagucggaguagaaacaacaaaaccaucaaaacaaucaaacaacaaauacgcagcaucaucauacuuaucacuaacaccagaacaauggaaaucacacagaucauacucaugcagaguaacacaugaaggauccacaguagaaaaaacaguagcaccagcagaaugcuca

SEQ ID NO: 46652 - RNA, 1353 nt, Artificial Sequence
  derived and/or modified sequence opt6 from Setoxaximab_HeavyChain1
gaaguacaacuacaacaaccaggaccugaauuagaaaaaccaggagcaucagucaaacucucaugcaaagccucaggauacucauuuacagacuacaacaugaacuggguaaaacaaaacaacggagaaucucuagaauggauaggaaaaauagaccccuacuacggagguccauccuacaaccaaaaauuuaaagacaaagcgacauuaacuguagacaaaaguuccucaacagcauauaugcaacuaaaaucacuaacaucagaagacucagcaguauauuacuguaccagaggaggaaacagagacugguacuucgacguauggggagcagguacaacacuaacaguaagugcagaauucgcaucuacaaaaggaccaucagucuuccccuuagcuccaucuucaaaaucaacauccggaggaacagcagcacucggaugucuaguaaaagacuacuucccagaaccaguaacaguauccuggaauucaggagcauuaacuuccggcguacacacauucccugcaguauuacaaucaucaggccuauauucacuaucaucaguaguuaccguaccaagcucaucacuaggaacacaaaccuacauaugcaacguaaaucacaaaccaucaaauacaaaaguagacaaaaaaguagaaccuaaaucaugcgacaaaacacacacaugcccacccuguccagcaccagaacuauuaggaggaccaucaguauuuuuauucccacccaaaccuaaggacacuuugaugaucagucgaacaccagaagucacaugcguaguaguugacguaucacaugaagacccagaagucaaauucaacugguacguagauggaguagaaguacacaaugcaaaaacaaaaccacgcgaagaacaauauaacucaacauacagaguagucucuguauuaacagucuuacaccaagauuggcuaaacggaaaagaauacaaaugcaaagucuccaacaaagcacuaccagcaccaauugaaaaaacaauaucuaaagcuaaaggccaaccaagagaaccacaaguauauacacuaccucccaguagagacgaauuaacaaaaaaccaaguaucacuaacauguuuaguaaaaggauuuuauccuucagacauugccguagaaugggaaucaaacggucagcccgaaaacaacuauaaaacaacuccaccaguacuagacucagacggauccuucuucuuauacucaaaacuaaccguagauaaaucccguuggcaacaaggcaacguauucuccuguucagugaugcacgaagcacuacacaaccauuacacacaaaaaucauuaucccuaucgccaggaaaa

SEQ ID NO: 46653 - RNA, 660 nt, Artificial Sequence
  derived and/or modified sequence opt6 from Setoxaximab_LightChain1
gacauaguauuaucacaaucaccaucaucacuaguaguaucaguaggagaaaaaguaacaaugucaugcaaauccucacaaucuuuacuauacucaagaaaccaaaaaaacuaccuagcaugguaucaacaaaaacccggacaaucaccaaaaguacuaauauacugggcaucaacaagagaaucaggcguaccagacagacuaacaggaucaggaucaggaacagacuucacccuaacaauaucaucaguaaaagcagaagaccuagcaguauacuacugccaacaauacuacuccuacccauuaacauucggugcaggaacaaaacuagaacuaaaaagaaccgucgcagccccauccguauucauauucccaccaucagacgaacaacuaaaaucaggcaccgccucaguaguaugccuacuaaauaacuucuacccacgagaagccaaaguacaauggaaaguagacaacgcacuacaaucaggaaacucacaagaaucaguaaccgaacaagacuccaaagauucaacauacucacuaucaucaacacuaacauuaucaaaagccgacuacgaaaaacauaaaguauacgcaugcgaaguaacacaccaaggacuauccucaccaguaacaaaaucauucaacagaggagaaugc

SEQ ID NO: 46654 - RNA, 1338 nt, Artificial Sequence
  derived and/or modified sequence opt6 from Sifalimumab_HeavyChain1
caaguacaauuaguacaaucaggagcagaaguaaaaaaaccgggagcaucuguaaaaguaucaugcaaagcaucaggauacaccuucacuagcuauucaauaagcuggguuagacaagcaccaggacaaggacuugaauggaugggauggauaucagucuauaacggcaacacaaacuaugcacaaaaauuccaaggacgaguaacaaugaccacagacacaagcacaucaaccgcauaucucgaacuacgcucauuaagaucagacgacacagcgguauacuauugcgcaagagacccaauugcugcaggauacuggggacaaggaacauuaguaacaguaucaucagcauccaccaaaggaccaagcguauuuccauuagcuccauccuccaaaucaaccucuggaggaacagcagcccuaggaugucuaguaaaagacuacuucccagaaccagucacaguaucauggaauucaggagcauuaacuuccggaguccacacauucccagcaguacuacaauccucaggacuauacucacuaaguucgguaguaacaguaccaucaucaucauuagguacucaaacauacauaugcaacguaaaucacaaaccaucaaacacaaaaguagauaaaaaaguagaaccuaaaucaugcgacaaaacccauacauguccaccaugcccagcaccagaacuacuuggaggaccaucaguuuuucuauucccaccaaaaccaaaagauacauuaaugaucaguaggacaccagaaguaacaugcguaguaguagauguuucacacgaagacccagaaguaaaauuuaacugguauguagacggagucgaaguacauaacgcaaaaacaaaacccagagaagaacaauacaauucaacuuaccgaguuguuagcguauuaacaguacuccaccaagauuggcuaaacggaaaagaauauaaauguaaaguaucaaacaaagcucuaccagcuccaauagaaaaaacuauaucaaaagcaaaaggacaaccaagagaaccacaaguauacacacucccacccucaagagaagaaaugaccaaaaaucaaguaaguuuaacaugucuaguaaaaggauuuuacccauccgauauagcaguagaaugggaaucaaaugggcaaccugaaaacaauuacaaaaccacaccuccaguacuugacuccgaugguuccuucuucuuauacagcaaacuaacuguugauaaaucaagauggcaacaaggcaaugucuuuucauguaguguuaugcacgaagcauuacacaaccacuauacucaaaaaucauuaucauuaagcccaggaaaa

SEQ ID NO: 46655 - RNA, 645 nt, Artificial Sequence
  derived and/or modified sequence opt6 from Sifalimumab_LightChain1
gaaauaguacuaacacaaucaccaggaacacuaucacuaucacccggagaaagagcaacauuaucuugcagagcaucacaaucaguaucaucaacauaccuagccugguaccaacaaaaaccaggacaagcaccaagacuacuaauuuacggagcaucaucaagagcaacaggaauaccagacagauucucaggaucuggaucaggaacagacuucacacuaacaauaucaagacuagaaccagaagacuucgcuguauacuauugccaacaauauggauccucaccaagaacauucggacaaggaacaaaaguagaaauaaaaagaacaguagcugcaccaucaguauuuauauuccccccaucagacgaacaauuaaaaucaggaacugcuucaguagucugcuuacuaaacaacuucuacccacgagaagcaaaaguccaauggaaaguagacaacgcacuacaaucagguaauucacaagaaucaguaacagaacaagacucuaaagacucaacauacucauuauccucaacacuaacacuaagcaaagccgacuacgaaaaacacaaaguauacgcuugugaagucacacaccaaggauuaucaucaccaguaacaaaaucauuuaauagaggcgaaugc

SEQ ID NO: 46656 - RNA, 1347 nt, Artificial Sequence
  derived and/or modified sequence opt6 from Siltuximab_HeavyChain1
gaaguccaacuaguagaaucaggaggaaaacuacuaaaaccaggaggaucauuaaaauuaucaugcgcagcaucaggcuucacauucucaucauucgcaaugagcugguuuagacaaucaccagaaaaaagacuugaauggguagcagaaaucucauccggaggcagcuauaccuacuacccugauacaguaacaggaagauuuacaaucucaagagacaacgcaaaaaacacauuauaccuagaaaugucaucacuuagaucagaagacaccgcuauguacuacugcgcaagagguuuauggggcuauuacgcacucgacuacuggggccaaggaacaucagucacaguaucauccgcaucaacaaaaggcccaucaguauucccucuagcccccucaucaaaaucaaccucaggcggaaccgcagcauuaggaugcuuaguaaaagacuauuuuccagaaccagucacaguauccuggaacucaggagcucuuacaucaggaguccacacuuuuccagcaguacuacaaucaucaggacuauacucucuaucaucaguuguaacaguaccaucaucaucauuaggcacacaaacuuacauaugcaauguuaaccacaaaccaucaaauacaaaaguagacaaaaaaguagaaccaaaaucaugugacaaaacccacacaugcccaccaugcccagccccagaauuacuuggaggaccaucagucuucuuauuuccaccaaaaccaaaagacacacuaaugaucucaagaacaccagaagucaccugcguaguaguagacguaucacacgaagauccugaagucaaauucaacugguauguagacggagucgaaguacauaacgcaaaaacaaaaccaagagaagaacaauacaauucaacauacagaguaguaagugucuuaacaguccuacaucaagauuggcuuaauggaaaagaauauaaaugcaaaguauccaauaaagcacucccagcaccaauagaaaaaacaauaaguaaagccaaaggucaaccaagagaaccacaaguuuacacauuaccaccuucacgagaugaauuaacuaaaaaccaaguaagccuaacaugucuaguaaaaggguuuuacccaucagacauagcaguagaaugggaaucaaauggacaaccagaaaacaauuauaaaaccacaccaccaguuuuagacucagacggaucauucuuccuauacucaaaauuaacagucgacaaaucaagauggcaacaaggcaauguauucucaugcucaguaaugcacgaagcccuacauaaccauuauacacaaaaaucccugucacuuuccccaggaaaa

SEQ ID NO: 46657 - RNA, 639 nt, Artificial Sequence
  derived and/or modified sequence opt6 from Siltuximab_LightChain1
caaaucguauuaauacaaucaccagcaauaaugucagcaucaccaggagaaaaaguaacaaugacaugcucagccuccuccucaguauccuacauguacugguaccaacaaaaaccaggaucaucaccaagacuacuaauauacgacacaucaaaucuagcaucaggagucccaguaagauuuucaggaucaggaucaggaacauccuacucacuaacaauaucaagaauggaagcagaagacgcagcaacauacuacugccaacaauggucaggauauccauacacauucggaggcggaacaaaacuagaaauaaaaagaacaguagcagcaccaucaguauuuauauucccaccaucagaugaacaacuaaaaucaggaacagcaucaguaguaugccuacuaaacaacuucuacccaagagaagcaaaaguacaauggaaaguagacaacgcacuacaaucaggaaacucacaagaaucaguaacagaacaagauucaaaagacucaacauacucacuaucauccacacuaacacuaucaaaagcagacuacgaaaaacacaaaguauacgcaugugaagucacacaucaaggucuaucaucaccaguaacaaaaucauucaaccgcggagaaugc

SEQ ID NO: 46658 - RNA, 1329 nt, Artificial Sequence
  derived and/or modified sequence opt6 from Simtuzumab_HeavyChain1
caaguacaauuaguccaaaguggcgccgaaguuaagaaaccaggagcaagcguaaaaguaucaugcaaagccagcggcuacgcauucacauacuaccuaauagaaugggucagacaagcaccaggacaaggauuagaauggauaggaguaauaaacccuggaucaggaggcacaaacuacaacgaaaaauucaaagggagagcaacaauaacugcagacaaaaguacaagcacagcuuauauggaacuaucuucacuaagaucagaagacacagcaguauacuucugcgcaagaaauuggaugaacuucgacuacuggggacaaggaacaacaguaacagucuccucagccucaacaaaaggaccaucaguauucccuuuagccccaugcucaagaucaacaucagaaaguacagcagcauuaggaugcuuagucaaagacuacuuuccagaaccaguaacaguaucauggaacucaggugcacuuacaagcggcguacauacuuuuccagcaguauuacaaagcucaggccucuacucacucagcaguguaguaaccguaccaucaucaucacuagguacaaaaacauacacaugcaacgucgaucauaaaccaucuaacaccaaaguagacaaaagaguagaaucaaaauacggaccaccaugcccacccugcccagcaccagaauuccuagguggacccucaguauucuuauucccaccuaaaccuaaagacacauuaaugauaucaagaacaccagaagucacaugcguagucguagacguaucacaagaagacccagaaguacaauucaacugguacguugacggaguagaagugcacaaugcaaaaacuaaaccaagagaagaacaauucaauaguacauaccgaguagucaguguuuuaacaguacuacaccaagacugguuaaacggaaaagaauauaaaugcaaagucucaaacaaaggcuuaccaucaagcauagaaaaaacaauaucaaaagcaaaaggacaaccaagagaaccacaaguauacacacuaccaccaucacaagaagaaaugacaaaaaaccaaguuucauuaacaugucuaguaaaaggauuuuacccuagcgacauagcaguagaaugggaaucaaacggacaaccagaaaauaacuacaaaacaacaccaccaguacuagauucugacggcucauuuuucuuauauucaagacuaacaguagacaaaagcagauggcaagaaggaaauguauuuucaugcucagucaugcaugaagcacuccacaaucacuauacacaaaaaucacuaucacuaucauuaggaaaa

SEQ ID NO: 46659 - RNA, 657 nt, Artificial Sequence
  derived and/or modified sequence opt6 from Simtuzumab_LightChain1
gacauaguaaugacacaaaccccauuaucacuauccguaacaccaggacaaccagcuucaauaucauguagaucaucuaaaucacuacuacauucaaacggaaacacauaccuauacugguucuuacaaaaaccaggacaaucaccacaauuccuaauauacagaaugucaaacuuagcaucaggagucccagacagauucuccggcucuggaucaggaacagacuuuacacuaaaaauauccagaguagaagcagaagacguaggaguauacuauuguaugcaacacuuagaauacccauacacauucggaggagggacaaaaguagaaauaaaaagaacaguagcagccccauccguauucaucuucccacccucagacgaacaacuaaaaucaggaacagccucaguaguaugccuauuaaauaacuuuuacccacgagaagcaaaaguacaauggaaaguagacaacgcucuacaaucaggaaacucacaagaaucaguaacagaacaagauucaaaagacucaacauacucacuaagcucaaccuuaacacuaucaaaagcagacuacgaaaaacacaaaguauacgcaugcgaaguaacacaccaaggacuaucaucaccaguaacaaaaucauucaacagaggagaaugc

SEQ ID NO: 46660 - RNA, 1347 nt, Artificial Sequence
  derived and/or modified sequence opt6 from Sirukumab_HeavyChain1
gaaguacaauuagucgaaucaggaggaggacuuguacaaccaggcggcaguuuaagauuaucaugcgccgcaagcggauuuacauuuucaccauucgccaugucauggguucgacaagcacccggcaaaggauuagaauggguagcaaaaauaucuccaggaggaucuuggacauacuauucugacaccguaacaggacguuuuaccauaucacgagacaacgcaaaaaauucauuauaccuacaaaugaacagcuuaagggcagaagacacagcaguguauuauugcgcaagacaauuauggggauauuacgccuuagauauauggggacaaggaacaacaguaacaguaucaucagcaucaacuaaagguccuagugucuucccauuagcaccaucauccaaaucaacaucuggcggaacagcagcuuuaggcugccuagucaaagauuacuucccugaaccagucacagucucauggaacagcggagcacuuacaucuggaguucacacauucccagcaguuuuacaaucuucaggacuauacucauuaucaucaguuguaacaguacccucaaguucauuagguacucaaacuuacauaugcaauguaaaucauaaaccaucuaacacaaaaguagacaaaaaaguagaacccaaaucuugcgauaaaacacacacaugcccaccauguccagcacccgaauuauuaggaggaccaucaguauuucuuuucccaccaaaacccaaagacacacuuaugauaucaagaacaccugaaguaacauguguaguuguagauguaucacacgaagaccccgaaguaaaauucaacugguacgucgacgguguagaaguacauaaugcaaaaacaaaaccaagagaagaacaauacaacucuaccuacagagugguaucuguucuaacuguacuucaccaagauuggcuaaauggaaaagaauacaaaugcaaagucucaaauaaagcauuacccgcaccaauugaaaaaacaauauccaaagcaaaaggucaaccaagagaaccacaaguauauacauuaccacccucacgagacgaacucacaaaaaaccaaguaucucuuacaugccuaguaaaaggauuuuacccaucagacauagcaguagaaugggaauccaacggacaaccagaaaacaauuacaaaacaacuccuccaguuuuagacucagacgguucauucuuccucuauucuaaacuaacaguugauaaauccagauggcaacaaggaaacgucuuuuccuguucugucaugcaugaagcacuacacaaccacuacacacaaaaaucauuaucauuaucaccaggaaaa

SEQ ID NO: 46661 - RNA, 639 nt, Artificial Sequence
  derived and/or modified sequence opt6 from Sirukumab_LightChain1
gaaauaguacuaacacaaucaccagcaacauuaucacuaucaccaggagaaagagcaacacuaucaugcucagcaucaauaucaguaucauacauguacugguaccaacaaaaaccaggacaagccccaagacuauuaauauacgauaugagcaaccuagcaucaggcauaccagcaagauucucaggaucaggaucaggaacagacuucacauuaacaauaucaucauuagaaccagaagauuucgcagucuacuacugcaugcaauggagcggcuacccauacacauucggaggaggaacaaaaguagaaauaaaaagaacaguagcagcaccaucaguauucauauucccaccaucagacgaacaacuaaaaucaggaacagcaucaguaguaugccuacuaaacaacuuuuacccaagagaagcaaaaguacaauggaaaguagacaacgcacuucaaucaggcaacucacaagaaucaguaacagaacaagacucaaaagacucaacauacagcuuaucaucaacauuaaccuuaucaaaagcagacuaugaaaaacauaaaguauacgcaugcgaaguaacacaccaaggacuaagcucaccaguaacaaaaagcuucaacagaggagaaugc

SEQ ID NO: 46662 - RNA, 1338 nt, Artificial Sequence
  derived and/or modified sequence opt6 from Sofituzumab_vedotin_HeavyChain1
gaaguacaauuaguagaaucugguggaggcuuaguacaaccaggagguagcuuacgauuaucaugcgcagccucaggauacaguauaacaaaugauuacgcuuggaacuggguuagacaagcaccagguaaaggauuagaauggguaggcuacauaucauauucaggcuacacaacauauaacccaucacuuaaaucuagauucaccauaucaagagauacuuccaaaaacacacuauaccuacaaaugaacucauuacgagcagaagacacagcaguauacuacugcgcaagauggaccucaggcuuagacuauuggggucaaggaaccuugguaacaguaucaucagcaucaacuaaaggcccaucuguauucccucuagcaccaucaucaaaaaguacaucaggcggaaccgcagcacuaggaugccuugucaaagacuacuuuccagaacccguaacaguauccuggaacucaggcgcacuaacaucaggaguacacacauuuccagcaguacuacaaucaucaggucuauacucacuauccucuguaguaacaguuccaucauccucacucggaacacaaacauacauaugcaacguaaaccacaaaccaucaaacacaaaagucgacaaaaaagucgaacccaaaucaugcgacaaaacccauaccugucccccaugccccgcaccagaacuucuaggaggccccucaguauuccuauucccaccaaaaccaaaagauacacuuaugauaucacgaaccccagaaguaacauguguaguaguagacgucucucacgaagacccagaagucaaauuuaacugguacguagacggaguagaaguacacaacgcaaaaacaaaaccaagagaagaacaauacaauucaacuuacagagucguaucaguccuaacuguacuacaccaagacugguuaaacggaaaagaauauaaaugcaaaguaucaaacaaagcauuacccgcacccauagaaaaaaccauuuccaaagcaaaaggucaaccaagagaaccacaaguauacacacucccaccuucccgcgaagaaaugacuaaaaaccaaguaucacuaaccugucuaguuaaaggauucuacccuuccgacauugcaguagaaugggaaucuaacggccaacccgaaaacaacuacaaaacaacaccucccguacuagauucagauggaucauucuucuuauacucaaaauuaacaguagauaaauccagauggcaacaaggaaacgucuucucaugcucuguuaugcacgaagcacuacauaaccauuacacccaaaaaucuuuaucauuauccccaggaaaa

SEQ ID NO: 46663 - RNA, 642 nt, Artificial Sequence
  derived and/or modified sequence opt6 from Sofituzumab_vedotin_LightChain1
gacauacaaaugacacaaucaccaucaucauuaucagcaucaguaggagacagaguaacaauaaccugcaaagcaucagaccuaauacacaacuggcuagcaugguaccaacaaaaaccaggaaaagcaccaaaauuacuaauauacggagcaacaucacuagaaacaggaguaccaucaagauucucaggaucaggaucaggaacagacuucacauuaaccauaagcucacuacaaccagaagacuucgcaacauacuauugccaacaauacuggacaaccccauucacauucggacaaggaacaaaaguagaaauaaaaagaacaguagcagcaccaucaguauucauauucccaccaucagacgaacaacuaaaaucaggaacagcaucaguaguaugccuacucaacaacuucuacccaagagaagcaaaaguacaauggaaaguagacaacgcacuacaaucaggaaacucacaagaaucaguaacagaacaagacucaaaagacucaacauacucauuaucaucaacacuaacacuaucaaaagcagacuacgaaaaacacaaaguauacgcaugugaaguaacacaccaaggauuaagcucaccaguaacaaaaucauuuaacagaggagaaugc

SEQ ID NO: 46664 - RNA, 1323 nt, Artificial Sequence
  derived and/or modified sequence opt6 from Solanezumab_HeavyChain1
gaaguacaauuaguagaaucaggcggaggacuaguacaaccaggcggaucccuaagacuaucaugcgcagcauccggauucacauucagcagauacucaaugucuuggguucgacaagcuccaggaaaaggccucgaauuaguagcacaaauaaauucaguaggaaauuccacauacuacccugauacugucaaaggaagauucacaauaagucgagacaacgccaaaaacacucuauaccuacaaaugaauucacucagagcugaagacacagcagucuacuacugcgcaucuggagacuacuggggacaaggaacacuaguuacagucucaucagcauccacaaaaggaccaucuguauucccacuagcaccaucaucaaaaucaacaucaggcggcaccgcagcacuaggaugucucguaaaagauuacuuccccgaacccgugacagucagcuggaauucaggagcacuaacaagugguguccacacauuccccgcuguacuccaauccucaggauuauauucacuaucuucagucguaaccgucccaucaucaucccuuggaacacaaacauacauuugcaacguaaaucauaaaccaucaaacaccaaaguagacaaaaaaguagaaccaaaaucaugugauaaaacacauacauguccaccaugcccagcaccagaauuacuuggaggcccauccguauuucuauuccccccuaaaccaaaagauacacuaaugauauccagaacaccugaaguaacauguguaguaguagacguaucucacgaagaccccgaagucaaauucaauugguauguugacggaguagaaguucacaacgccaaaacaaaaccaagagaagaacaauacaacucaacauacagagucguaucaguauuaacaguacuccaccaagacuggcucaacggaaaagaauacaaaugcaaaguaucaaacaaagcacuaccugcaccuauagaaaaaacuaucucaaaagcaaaaggacaaccaagagaaccacaaguuuacacacuaccaccaucaagagacgaauuaacaaaaaaccaaguaucacuaacaugccuaguaaaaggauuuuacccaucagauauugcaguugaaugggaauccaacggacaaccagaaaauaacuacaaaacuacuccuccaguccuagauucagacggauccuucuuucucuacucgaaacucaccguagacaaaucccgauggcaacaaggcaauguauucucauguucagucaugcaugaagcacuacacaaccauuacacacaaaaaucacuaucccucagccccgga

SEQ ID NO: 46665 - RNA, 1326 nt, Artificial Sequence
  derived and/or modified sequence opt6 from Solanezumab_HeavyChain
gaaguacaauuagucgaaucaggaggaggauuaguccaaccaggaggaucucuaagauuauccugugcagccucgggauucacauuuucacgauauucuaugagcuggguacgacaagcacccggaaaaggacuggaauuagucgcacaaaucaacuccgucggaaauagcacauacuauccagauacaguaaaagguagauucacaauaucaagagacaaugcaaaaaacacucuauaccuucaaaugaauagcuuaagagccgaagacacagcaguauauuacugcgcaucaggagacuacuggggacaaggaacacucguaacaguaucaucagccuccacaaaaggccccagcguuuuccccuuagcaccaucaaguaaaucaacuagcggaggcaccgcugcuuuaggaugccuagucaaagacuacuuccccgaaccaguaacuguaucauggaauucaggagcacuaacaucaggaguacauacauuccccgcaguacuacaaucuuccggauuauacucauuaucaagcguaguaacuguaccaucauccucauuaggaacacaaacauacauauguaauguaaaccauaaaccaucuaacaccaaagucgacaaaaaaguagaaccaaaaucaugugacaaaacacacacaugccccccauguccagcaccagaacuauuaggaggaccaucuguauuucuauuuccaccaaaaccaaaagauacacuaaugauaucaagaacuccugaaguaacauguguagucguagauguaucacaugaagacccugaaguaaaauuuaacugguacguagauggaguagaaguacauaacgcaaaaacaaaaccaagagaagaacaauacaacucaacuuacagaguuguauccguucuaacagucuuacaccaagacuggcuaaacgguaaggaauauaaaugcaaaguaucaaacaaagcucuaccagcaccaaucgaaaaaacaauaucaaaagcaaaaggacaaccaagagaaccccaagucuauaccuuaccaccaagcagagaugaacucacuaaaaaucaaguauccuuaacauguuuaguaaaaggauucuaccccuccgacauagcaguugaaugggaaaguaacggacaacccgaaaauaacuacaaaaccacaccaccagucuuagauucagacggaucauucuuccuauauucaaaacuaacaguagacaaaagcagauggcaacaaggaaauguauucucauguucuguaaugcaugaagcacuacauaaccauuacacucaaaaaucauuaagccuaucaccagguaaa

SEQ ID NO: 46666 - RNA, 657 nt, Artificial Sequence
  derived and/or modified sequence opt6 from Solanezumab_LightChain1
gacguaguaaugacacaaagcccccucucacuaccagucacacuaggacaaccagcaucaauaucaugcagaaguucacaaucauuaauauacucagacggaaacgcauacuuacacugguucuuacaaaaaccaggacaaucaccaagacuacuaauauacaaaguaucaaacagauucucaggaguaccagacagauuuucaggcucaggaucaggaacagauuucacacuaaaaauaucaagaguagaagccgaagauguaggaguauacuacugcucacaaucaacacacguaccauggacauucggacaaggaaccaaaguagaaauaaaaagaacaguagcagcaccaucaguauucauauucccaccaucagaugaacaacuaaaaucaggaaccgcaucaguaguaugccuauuaaacaacuucuacccaagagaagcaaaaguacaauggaaaguagacaaugcacuacaauccggcaacucccaagaaucaguaacagaacaagacagcaaagacucaacauauucacuaucaucaacauuaacacuaucaaaagcagacuacgaaaaacacaaaguauaugcaugcgaaguaacacaucaaggacuaucaucaccaguaacaaaaucauucaacagaggagaaugc

SEQ ID NO: 46667 - RNA, 1506 nt, Artificial Sequence
  derived and/or modified sequence opt6 from Solitomab_HeavyChain1
gaauuaguaaugacacaaaguccuucaucauuaacaguaacagcuggugaaaaaguaacuaugucauguaaaagcucacaaaguuuauuaaacucaggaaaucaaaaaaauuauuuaacaugguaucaacaaaaaccuggacaaccacccaaauuacuaauauauugggccucaacuagagaaucagggguaccagaucgcuuuacuggaucaggaucaggaacagauuuuacuuuaacaauaucaucaguccaagccgaagauuuagcaguauauuauugucaaaaugauuacaguuauccacucacauuuggagcuggaacaaaacuagaaauuaaaggagguggcggaucuggaggagguggaucagguggaggagguagugaaguacaauuauuagaacaaucaggagcugaauuaguacgaccagguacaagcgucaaaauuucaugcaaagcaagugguuacgcauucacaaacuauuggcuaggguggguaaaacaaagaccgggucacggauuagaauggauaggugacauauuuccaggauccggaaacauucauuacaacgaaaaguuuaaaggaaaagcaacauuaacagcagacaaaaguagcagcacugcuuauaugcaauuaaguagucuaacauucgaagacagcgcaguauauuuuugugcaagauuacgaaauugggaugaaccaauggauuauuggggacaaggaacaaccguaacaguauccucaggaggaggaggaucagauguucaauuaguacaaucaggagcagaaguaaaaaaaccaggagcaaguguaaaaguaucauguaaagcuucaggauacacuuuuacaagauacacaaugcacuggguaagacaagcaccuggacaaggacuugaauggauagguuacauaaaucccucaagagguuauacaaauuaugcagauucaguuaaaggaagguuuacaaucacaacggauaaaaguacaaguacagcuuauauggaacuuaguucauuaagaagugaagauacagcaacauauuacugugcacgauacuaugaugaucauuacuguuuggacuauuggggacaagguacaacaguaaccguaaguaguggcgaaggaacaucuaccggaaguggaggaagcggcgguucagguggagcugaugacauaguauuaacacaaaguccugcuacacuaagucuaaguccaggugaaagagcaacauuaucauguagagcaucacaaagcguuagcuacaugaacugguaucaacaaaaaccuggaaaagcaccaaaaagauggauuuacgauacaagcaaaguagcaucaggaguaccugcaagauuuucaggaucuggaucaggaacagauuauucccucacuauaaauucauuagaagcggaagaugcugcaacauauuauugucaacaauggucaagcaauccauuaacauuuggaggcggaacaaaaguagaaauaaaacaucaucaucaucaucac

SEQ ID NO: 46668 - RNA, 1506 nt, Artificial Sequence
  derived and/or modified sequence opt6 from Solitomab_SingleChain
gaacuaguaaugacucaaagcccaucaucacuaacagucacggcaggagaaaaaguuacaaugucauguaaaucuagucaaucacuacuaaacaguggaaaucaaaagaauuaucuaacaugguaucaacaaaaaccaggccaaccuccuaaauuauuaauauacugggcaagcacuagagaaucugguguaccagauagauuuacaggaucaggaagcggaacugauuucacauuaacaauaagcucaguacaagcagaagacuuagcaguauauuauugucaaaaugauuauucauauccauuaacauuuggagccggaacaaaacuagaaauaaaaggcggagguggaucaggaggaggaggaucaggagguggaggaucagaaguucaacuauuagaacagagcggagcagaauuaguaaggcccggaacaaguguaaaaauaucauguaaagcuucugguuaugcauuuacaaauuacugguuaggauggguaaaacagagaccaggccacggauuagaauggauaggagauauauucccuggaucagguaauauacauuacaaugaaaaauuuaaaggaaaagcaacauuaaccgcagauaaaaguagcaguacagcauauaugcaauuaucaucauuaacauucgaagauagcgcaguauauuuuugugcaagguuaagaaauugggacgaaccaauggauuacuggggacaagguaccacaguaacaguaucaucaggaggagguggaagcgauguucaacuaguacaaucaggagcagaaguaaaaaaaccaggugccaguguaaaaguaucauguaaagccaguggauauacauuuacaagauauacuaugcauuggguaagacaagcaccaggucaaggacuugaauggauaggauauauaaauccaagucgaggauauacaaacuaugcggauagcguuaaaggaagauuuacgauaacaacagacaaaaguacuucaacagcuuauauggaauuaucaaguuuaagaagcgaagauacagcaacuuacuauugcgccagauauuacgacgaucauuauugucuagauuauuggggccaagguacaacaguaacaguaucaucaggagaagguaccucuacugguucaggaggaucaggaggcucaggaggggcagaugauauuguauuaacucaaucaccagcuacauuaucacuuuccccaggagaacgagccacacuaucauguagagcuagccaaucaguaucauauaugaacugguaucaacaaaaaccuggaaaagcuccaaaaagauggauauacgauacuuccaaagucgcaaguggcgugccagcaagauucaguggaucaggaagcggaacagauuacucacuaacgauaaauagucuagaagcagaagaugcggcaaccuauuacugucaacaauggagcaguaacccauuaacauuuggaggaggaacaaaaguugaaauaaagcaucaucaucaucaucau

SEQ ID NO: 46669 - RNA, 702 nt, Artificial Sequence
  derived and/or modified sequence opt6 from Sonepcizumab_LightChain_Precursor
augucaguaccaacacaaguacuaggauuacuacuacuaugguuaacagacgcaagaugcgaaacuacaguaacacaaucaccauccuucuuauccgcaucuguaggagacagaguaacaauaacaugcauaacaacaacagauauagacgacgacaugaacugguuccaacaagaacccggaaaagcaccaaaacuauuaauaucugaaggaaacauacuaagaccaggagucccaucaagauucucaucaucaggauacggaacagacuucacacuaacaauaucaaaacuacaaccagaagacuucgcaacauauuacugccuacaaucagacaaccucccauucacauucggacaaggaacaaaauuagaaauaaaaagaacaguagcagcaccaucaguauucauauucccaccuucagacgaacaauuaaaaucaggaacagcaucaguagucugccuccuaaacaauuucuacccaagagaagcaaaaguacaauggaaaguagacaaugcauuacaaucaggaaacucacaagaaucaguaaccgaacaagauucaaaagacucaacauacucauuaagcucaacucuaacauuaagcaaagcagacuacgaaaaacacaaaguauacgcaugcgaaguaacacaucaaggacuaucaucaccaguaacaaaauccuucaaccgcggagaaugc

SEQ ID NO: 46670 - RNA, 1365 nt, Artificial Sequence
  derived and/or modified sequence opt6 from Sonepcizumab_gamma1-Chain_Precursor
auggaauggucauggguauuccucuucuuucuaucaguaaccacaggcguccacucagaaguacaacuaguccaaucaggugcagaagucaaaaaaccaggagaauccuuaaaaauaucaugccaaagcuucgguuacauauucauagaccacacaauccacuggaugagacaaaugccaggacaaggccuagaauggaugggagcaauaaguccacgacaugacauaacaaaauauaaugaaauguucagaggacaaguaacaauaucagcagauaaaucuucaucaacugcauauuuacaaugguccucucuaaaagcauccgacaccgccauguacuucugcgcaagaggaggauucuauggaucaacaauaugguucgauuuuuggggacaaggaacaaugguaacaguaucauccgcauccacaaaaggaccaaguguuuuccccuuagccccaucuucaaaaucaacaagcggaggaacagccgcauuaggaugcuuaguuaaagacuacuucccagaaccaguaacaguaucauggaacaguggagcauuaacaucaggaguacacaccuucccagcuguucuacaauccucaggauuauacucacuuucaucuguaguaacaguaccaucaagcuccuuaggaacacaaacauacaucuguaauguaaaccauaaaccuucaaacacaaaaguugacaaaagagucgcccccgaauuacucgguggacccucuguauuccuuuuuccaccgaaaccuaaagacaccuuaaugauaucuagaaccccagaaguaacaugcguaguaguagauguaucccaugaagacccagaaguaaaguucaacugguacguagacggaguagaaguacacaacgcaaaaaccaaacccagagaagaacaauacaacuccacuuaucgcguaguaucaguccuaacaguauuacaccaagauuggcuaaauggaaaagaauauaaaugcaaaguaucaaacaaagcccuacccgcaccaauagaaaaaacaaucucuaaagcaaaaggacaaccacgagaaccacaaguauacacacucccaccaucaagagaagaaaugacuaaaaaccaaguaucccuaacauguuuaguaaaaggauuuuaucccucagauauagccgucgaaugggaaucuaacggucaaccagaaaacaacuacaaaacaacaccuccaguacuagacuccgauggaucauuuuucuuauacucaaaacuaacaguagacaaaagcagauggcaacaaggaaauguauucucuuguuccgucaugcaugaagcccuacacaaccauuauacacaaaaaucucuaucacuuucacccggaaaa

SEQ ID NO: 46671 - RNA, 1338 nt, Artificial Sequence
  derived and/or modified sequence opt6 from Stamulumab_HeavyChain1
guacaauuaguacaaucuggagcugaaguaaaaaaaccaggagcaucaguaaaaguaucaugcaaagcaucagguuauacauucacauccuacuacaugcacuggguaagacaagcaccaggucaaggacuagaauggaugggaauaauaaauccaucaggaggaucuacauccuaugcacaaaaauuccaaggacgaguuacaaugaccagagauacuuccacaucaacaguauacauggaacuuucaucacuacgcucagaagauacagccguauacuacugugcaagagaugaaaacuggggauucgauccauggggacaaggaacauuaguaacaguaucaucagcaagcacaaaaggcccaucaguuuuucccuuggcaccaucaucaaagaguaccucaggcgguacagcagcucuaggcugccuaguaaaagacuacuucccagaacccguaacaguuucauggaauucaggagcacuaacaucugguguacauacauucccagcaguauuacaauccagcggauuauacucacuaagcuccgucguaacuguaccaucaagcucacuaggaacacaaaccuauauaugcaacguaaaccauaaaccaucuaauacaaaaguagauaaaaaaguagagccaaaaucuugugacaaaacccacacaugcccuccaugcccagcaccagaauuacuuggcggaccuucaguauuucuauucccaccaaaaccaaaagacacacucaugaucucuagaacaccagaaguaacaugcguaguaguagacguaucacacgaagacccagaaguaaaauuuaacugguacguagacggaguagaaguacauaacgcaaaaaccaaaccaagagaagaacaauacaacuccacauacagaguugucucaguauuaacaguacuacaucaagacuggcuaaacggaaaagaauauaaaugcaaaguaaguaacaaagcauuaccagcaccaauagaaaaaaccauaucaaaagcaaaaggucaacccagagaaccccaagucuacacacuuccaccauccagagaagaaaugacaaaaaaccaaguuuccuuaacaugcuuaguaaaaggauucuauccaucagacaucgccguagaaugggaaucaaacggacaaccugaaaacaacuacaaaacaacccccccaguacuagacucagacggauccuucuuccuauacucaaaacuaacuguugauaaaucacgcuggcaacaaggaaaugucuuuucuugcucaguaaugcaugaagcacuucacaaccacuacacccaaaaaucacuaucauuaucacccggaaaa

SEQ ID NO: 46672 - RNA, 633 nt, Artificial Sequence
  derived and/or modified sequence opt6 from Stamulumab_LightChain1
ucauacgaauuaacacaaccuccaucaguaucaguaucaccaggacaaacagcaucaauaacauguucaggacacgcacuaggagacaaauucguaucaugguaccaacaaaaacccggacaaucaccaguucuaguaauauacgacgacacacaaagaccaucaggcauaccagaaagauucucaggaucaaacucaggaaacacagcaacacucacaauaucaggaacacaagcaauggacgaagcagacuacuacugccaagcaugggacucaucauuuguauucgguggaggaacaaaaguaacaguacuaggacaaccaaaagcagcaccauccguaacacuauucccaccaagcucagaagaacuacaagcaaacaaagcaacacuaguaugccuaauaucagacuucuacccaggagcaguaacagucgcauggaaagcagacucaucaccaguaaaagcaggaguagaaacaacaacaccaucaaaacaaucaaacaacaaauacgcagcaucaucauaccuaucauuaacaccugaacaauggaaaucacacagauccuacucaugccaaguaacacacgaaggaucaacaguagaaaaaacaguagcaccaacagaaugcuca

SEQ ID NO: 46673 - RNA, 1356 nt, Artificial Sequence
  derived and/or modified sequence opt6 from Suptavumab_HeavyChain1
gaaguacaauuagucgaaucuggaggagauuuaguucaaccaggaagauccuuaagauuaucaugcgucgccagcggauucacauuugacgacuacgccaugcacuggguaagacaagcaccuggaaaaggacucgaauggguaucaggaguauccuggaguggcuccaccgucggcuacgcagauucaguaaaaggaagauuuacaguaucaagagacaaugcucaaaaaucauuauaucuccaaaugaacucacucagagcagaagacacugcacuauauuauuguguaaaagacgcauauaaauucaauuauuauuacuauggcuuagacguauggggacaaggaaccacaguaacaguaucaucagcaucuacaaaaggucccucaguauuuccauuagcuccaucaucaaaaucaaccucaggaggaacagccgcauugggaugucuaguaaaagacuauuucccagaaccaguaaccguaucuuggaauucuggagcccucacauccggaguacauaccuuuccagcaguacuucaaucuuccggacuauauucauuauccuccguagucacaguaccaagcucaucacuaggaacacaaacuuauauaugcaacgucaaccauaaaccuucaaacacaaaaguagauaaaaaaguagaacccaaaucaugcgauaaaacacauacaugcccaccuugcccagcaccugaacuucuaggaggaccauccguuuuccuauucccaccgaaaccaaaagauacacucaugauaucaagaacaccagaaguaacaugcgucguaguugacguaucacacgaagacccagaaguaaaauucaacugguauguagacgguguagaaguacauaacgcaaaaacaaaaccuagagaagaacaauauaacucaacauacagagucguaucaguuuuaaccguauuacaucaagacuggcuaaacggaaaagaauauaaaugcaagguaucuaauaaagcacuaccagcuccaauagaaaaaacaauaucaaaagcuaaaggacaaccaagagaaccccaaguauacacacuaccaccuucaagggacgaacuaacaaaaaaccaaguaucuuuaacgugcuuagucaaaggauuuuauccaucagauaucgcuguugaaugggaaucaaauggacaacccgaaaacaauuacaaaacaacaccaccaguacuagacucagauggaucauucuucuuauauucaaaacuaaccguagacaaaucaagauggcaacaaggaaacguauuuucuugcucaguaaugcaugaagcacuacacaaccacuacacacaaaaaucauuaucauuaucuccaggu

SEQ ID NO: 46674 - RNA, 642 nt, Artificial Sequence
  derived and/or modified sequence opt6 from Suptavumab_LightChain1
gaaauaguaaugacacaaucaccagcaacacuaagcguaagcccaggcgaaagagcaacacuaagcuguagagcuagccaaacaauacuaucaaacuuagcaugguacuuacaaaaaccaggacaagcaccaagacuauuaauauacggagcaagcacacgagcaacaggacuaccagccagguuuucaggaucaggauccggaacagaauuuacuuuaacaauaaguucgcuacaaagcgaagacuuugcaguauacuauugccaacaauauaacaauuggccacuaacauucggaggaggaacaaaaguagaaauaaaacgaacaguagcagcaccaagcguauucauauucccacccucagacgaacaauuaaaaucaggaacagcaucaguaguaugcuuacuaaauaacuuuuacccaagagaagcaaaaguacaauggaaaguagauaacgcauuacaaagcggaaacucacaagaaagcguaacagaacaagauucaaaagacucaacauauagcuuaagcucaacacuaacccuaagcaaagcagacuacgaaaaacauaaaguauacgcaugcgaaguaacacaccaaggauuaagcucaccaguaacaaaaagcuuuaacaggggagaaugc

SEQ ID NO: 46675 - RNA, 1344 nt, Artificial Sequence
  derived and/or modified sequence opt6 from Suvizumab_HeavyChain1
caaguacaauuaguacaaucaggcgcagaaguaaaaaaaccaggcgcaucaguaaaaguauccugcaaagcaaguggauacacuuucacaaacucuuggauuggaugguucagacaagcacccggacagggacuagaauggauuggagacauauauccaggaggagguuacacuaacuauaacgaaauauuuaaaggaaaagcaacaaugacagcagacacaaguacaaacacagcauacauggaauuaucuagcuuaagaucagaagauacagcaguauacuacuguaguagaggaauaccaggauacgcgauggauuauuggggacagggaacucuagucacaguaagcucagcaucaacaaaaggaccaagcguauucccacuagcccccucaagcaaaagcacauccggaggaacagcagcacucggcuguuuaguuaaagauuauuuuccugaaccaguuacaguuagcuggaauagcggagcauuaaccucuggaguccacacuuuuccagcaguacuacaaucaucaggacuauauucauuaucaucaguagugacaguaccaagcucuucauuagguacacaaacauauauaugcaacguaaaucauaaaccaucaaauacgaaaguagacaaaaaaguugaaccuaaaaguugugauaaaacccacacuugcccaccauguccagcaccagaacuacuaggaggaccaucaguauuccuauuuccaccaaaaccuaaagauacauuaaugauaagcagaacaccagaaguaacaugugucguaguagaugucucacacgaagauccagaaguuaaauucaauugguacguagacggaguagaaguacauaaugcaaaaacaaaaccacgagaagaacaguacaauucaacauacagaguaguaucaguacuaacaguauuacaccaagacuggcuaaauggaaaagaguauaaauguaaaguaagcaauaaagcacuaccagcaccaauagaaaaaacaauaucaaaagcaaaaggccaaccuagagaaccucaaguauauacccuaccacccucaagagaugaauuaacaaaaaaccaaguaucacuuacaugucuaguuaaagguuucuaucccucagacauagcaguugaaugggaaucaaacggccaacccgaaaauaauuauaaaaccacucccccaguauuagauagugacggcucauucuucuuauauucaaaauuaacaguagauaaaucaagauggcaacaaggaaauguauucucaugcagcguuaugcaugaagcccuacacaaccacuacacucaaaaaucacuuucacucagccccggaaaa

SEQ ID NO: 46676 - RNA, 660 nt, Artificial Sequence
  derived and/or modified sequence opt6 from Suvizumab_LightChain1
gacauacaaaugacacaaagaccagacucacuaucagcaucaguaggagaccgaguaacaaugaguugcaaaucaagccaaucccuacucaacagcggagaccaaaaaaauuaccuaacaugguaccaacaaaaaccaggacaaccaccaaaacucuuaaucuacugggcaucaacaggagaaucaggaguaccagacagauucucaggauccggaucuggaacagauuucacauucacaauauccucacuacaaccagaagacauagcaacauacuacugucaaaacgacuacucauacccauggacauucggacaaggaacaaaaguagaaauaaaaagaaccguagcagcaccaucaguauucauauucccaccaucagacgaacaacuaaaaucaggcacagcaucaguaguaugccuacuaaauaauuucuacccaagagaagcaaaaguacaauggaaagucgacaacgcauuacaaagcggaaacucacaagaaucaguaacagaacaagacucaaaagacucaacauacagccuaucaucaacccuaacucuaucaaaagcagacuacgaaaaacacaaaguauacgcaugcgaagucacacaccaaggauuaucaucaccaguaacaaaaucauucaacagaggagaaugc

SEQ ID NO: 46677 - RNA, 1350 nt, Artificial Sequence
  derived and/or modified sequence opt6 from Tabalumab_HeavyChain1
caaguacaauuacaacaauggggagcaggacuauuaaaacccucugaaacacucucauuaacaugcgcaguauacgguggauccuucuccggauauuauuggucauggauaagacaaccacccggcaaaggacuagaauggauaggagaaauaaaccacucaggaucaacaaacuacaacccaucauuaaaaucaagagucacuauaucaguagacacaucaaaaaaucaauucucauuaaaacuaucuucaguuacagcagcugacacagcagucuacuauugcgcaagaggcuacuaugacauacuaacaggauacuacuacuauuuugacuacuggggacaaggcacacuaguaaccguuucauccgccucuacaaaaggaccaucaguauuuccccuagcaccuuguuccagaucuacaucugaaucaacagccgcccucggaugccuaguaaaagacuacuuuccagaaccagucacagucuccuggaacucuggagcauuaacaucaggcguccacacauucccagccguacuacaaucaucaggacuauacucacuauccucagucgucaccgucccaucuucaucucuaggaacaaaaacauauaccugcaacguagaucauaaaccaucuaacaccaaaguagacaaacgaguagaaucaaaauacggaccacccuguccaccaugcccagcacccgaauuucuuggaggacccuccguauuccuauuuccaccaaaaccaaaagauacccuaaugauaucaagaacaccagaaguuacaugcgucguaguagacguuucacaagaagauccggaaguacaauucaacugguaugucgauggcguagaaguacacaaugccaaaacaaaaccaagagaagaacaauucaacucaacauaccgagucguaucuguacuaaccguauuacaccaagauugguuaaacggaaaagaauacaaaugcaaaguuucaaacaaaggacuaccaucaucaauagaaaaaacaauauccaaagcaaaaggacaaccuagagaaccacaaguauauacacuaccuccaucacaagaagaaaugacuaaaaaucaaguaucacuaacaugucuaguaaaaggauuuuauccuuccgacauagcaguagaaugggaaagcaauggacaaccagaaaacaacuacaaaacaacaccaccaguauuagauuccgacggaucauucuucuuauauucaagacuaaccguagacaaaucaagauggcaagaagguaauguauucucauguuccgucaugcaugaagcauuacacaaucacuauacacaaaaaucuuuaucacuuucauuaggaaaa

SEQ ID NO: 46678 - RNA, 642 nt, Artificial Sequence
  derived and/or modified sequence opt6 from Tabalumab_LightChain1
gaaauaguacuaacacaaucacccgcaacacuaucacuaucaccaggagaaagagcaacccuaagcugccgagcaucacaaagcguaucaagauaccuagcaugguaccaacaaaaaccaggacaagcacccagacuacuaauauacgacgcaucaaacagagcaacaggaauaccagcaagauucucaggaucaggcuccggaacagacucaacauuaacuauaagcucacuagaaccagaagacuuugcaguauauuauugccaacaaagaucaaacuggccaagaacauucggacaaggaacaaaaguagaaauaaaacgaacaguagcagcaccaucaguauucauauucccaccaucagacgaacaacuaaaaucaggaacagcaucagucguaugccuauuaaacaacuucuacccaagagaagcaaaaguacaauggaaagucgacaacgcauuacaaucaggaaacucacaagaaucaguaacagaacaagacagcaaagacucaacauacuccuuaucaaauacauuaacacuauccaaagcagacuacgaaaaacacaaaguuuacgcaugcgaaguaacacaccaaggauuaucaucaccaguaacaaaaucauucaaccgaggagaaugc

SEQ ID NO: 46679 - RNA, 1332 nt, Artificial Sequence
  derived and/or modified sequence opt6 from Tacatuzuab_HeavyChain1
caaguucaauuacaacaaucaggagcagaaguaaaaaaaccagguuccucaguaaaaguauccuguaaagccucuggauacgcauucacaagcuacguaauccacuggguacgacaagccccaggucaaggacucuacuggauagguuacauacacccauacaacggagguacaaaauacaacgaaaaauucaaaggaaaagccacaauaacagcagacgaaucaacaaauacagcauaugaacucucaucucuuagaucagaagauacagcuuucuacuucugugcaagaucaggcggaggagacccauucgcauauuggggacaaggaucccucguaacaguaucaucugcaucaacaaaaggacccuccguauucccacuagccccuucaucaaaaucaacaaguggcggaacagcagcauuaggcugccucgucaaagacuacuucccagaaccuguaacuguaaguuggaauucaggcgcacuaacaucaggaguacauacuuucccagcaguacuacaauccucaggccucuauucacuaucaaguguugucacaguaccaucauccucuuuaggaacacaaacauacauauguaacguaaaccacaaaccaucaaauacaaaaguagacaaacguguagaaccaaaaucaugcgacaaaacacacaccugucccccuugcccagccccagaauuacuagguggaccaucaguuuuccucuucccaccaaaaccaaaagacacauuaauaucaagaacuccagaaguaacaugcguuguaguagacguaucacacgaagacccagaaguuaaauuuaauugguacguagacggagucgaaguacacaacgccaaaacaaaaccaagagaagaacaauauaacucaacauauagagucgucucagucuuaacaguccuacaccaagacuggcuaaacggcaaagaauacaaaugcaaagucucaaacaaagcccuaccagccccaauagaaaaaacaauaucuaaagcaaaaggacaaccacgagaaccacaaguuuauacauuaccaccuucaagagaagaaacaaaaaaccaaguaucauuaacaugccuaguaaaaggauucuacccauccgacaucgccguagaaugggaaucaaacggacaaccagaaaacaacuauaaaacaacuccaccaguauuagacagugauggauccuucuucuuauacaguaaauuaacagucgacaaaucaagauggcaacaaggcaacguauucucaugcucaguacaugaagcacuacacaaccacuacacacaaaaaucacuaagcuuaucaccaggaaaa

SEQ ID NO: 46680 - RNA, 636 nt, Artificial Sequence
  derived and/or modified sequence opt6 from Tacatuzuab_LightChain1
gacauacaacuaacacaaucaccaucaagccuaucagcaucaguaggcgacagaguaacaauaacaugcaaagcaagccaagauauaaauaaauacauaggaugguaccaacaaaaaccaggaaaagcaccaaaauuauuacacuacacaucagccuuacucccaggaauaccaucaagauucucaggaucaggaagcggaagagacuacacauucacaauaucaagucuacaaccagaagacauagcaacauacuacugccuacaauacgacgaccuauggacauuuggaggaggaacaaaacuacaaauaaaacgaacaguagcagcaccaagcguauucauuuucccaccaucagacgaacaauuaaaaucaggaacagcaucaguaguaugccuacuaaauaacuucuacccaagagaagcaaaaguacaauggaaaguagacaacgcacuccaaagcggaaacucacaagaaagcgucaccgaacaagacagcaaagacucaacauacagccuauccucaacacuaacccucucaaaagcagacuacgaaaaacacaaaguauacgcaugugaaguaacacaccaaggacuaagcucaccaguaacaaaaucauucaacagaggagaaugc

SEQ ID NO: 46681 - RNA, 678 nt, Artificial Sequence
  derived and/or modified sequence opt6 from Tadocizumab_fab_fragment_HeavyChain
caaguacaacuaguacaaagcggagcagaaguaaaaaaacccggaucaucaguaaaaguaucauguaaagcaucaggcuacgcauucacaaacuaucuaauagaauggguaagacaagcacccggacaaggacuagaauggauaggaguaauauauccaggaucagguggaacuaacuauaacgaaaaauuuaaaggcagaguaacauuaacaguagacgaaagcacaaacacagcauauauggaacuaucaucauuaagaucagaagacacagcaguauauuucugugcaagaagagauggaaauuacggaugguuugcauauuggggacaaggaacacuaguaacaguaucaucagcaagcacaaaaggaccaucaguauuuccacuagcaccaucaucaaaaaguacaaguggaggaacagcagcauuaggaugucuaguaaaagauuacuuuccagaaccaguaacaguuucauggaacucaggagcacuaacaucaggaguacacacauucccagcaguauuacaaucaucaggauuauauucauuaagcucaguaguaacaguaccaucaucaucauuaggaacacaaacauauauauguaacguaaaccauaaaccaucaaauacaaaaguagauaaaaaaguagaaccaaaaucaugugauaaaacacau

SEQ ID NO: 46682 - RNA, 582 nt, Artificial Sequence
  derived and/or modified sequence opt6 from Tadocizumab_fab_fragment_LightChain
gacauacaaaugacacaaacaccaucaacauuaucagcaucaguaggagacagaguaacuauaucaugccgagcaucacaagacauaaacaacuaccuaaacugguaucaacaaaaaccaggaaaagcaccaaaacuacuaauauacuacacaucaacacuacacucaggaguaccaucaagauucucaggaucaggaucaggcacagauuacacacuaacaauaucaucacuacaaccagacgacuucgcaacauacuucugucaacaaggaaacacacuaccauggacauucggacaaggaacaaaaguagaaguaaaacgcacaguagcagcaccaucaguauucauauucccaccaucagacgaacaacuaaaaucaggaacagcaucaguaguaugccuacucaacaacuucuacgaaucaguaaccgaacaagacucaaaagacucaacauacucacuaucaucaacauuaacacuaucaaaagcagacuacgaaaaacacaaaguauacgcaugcgaaguaacacaccaaggauuaucauccccaguaacaaaaucauucaacagaggagaaugc

SEQ ID NO: 46683 - RNA, 1359 nt, Artificial Sequence
  derived and/or modified sequence opt6 from Talizumab_HeavyChain1
caaguacaauuaguccaaucaggagcagaaguaaaaaaaccaggagcgucaguaaaaguauccugcaaagccucuggcuauacauucuccauguacuggcuagaauggguacgccaagccccaggacauggacuagaauggguaggagaaauaucaccaggaacauuuacaacaaacuacaacgaaaaauuuaaagccagagcaacuuuuacagcagauacaucuaccaauacagcauacauggaauuaucaucauuaagaucagaagacacagccguauauuauugcgccagauucucacacuucucaggaucaaauuacgacuacuucgauuacuggggacaaggcacacuuguaacaguaucaagugcauccacaaaaggaccuuccguguuuccuuuagcaccauccucaaaaucaacaagcggaggcaccgcagcauuaggaugucucguaaaagacuacuuuccagaaccaguaacagucucauggaacaguggugcuuuaacaucaggaguucauacauucccugcaguauuacaaucaucaggauuauauucccuaucauccgucguaacaguaccauccucuucauuaggcacacaaacauacauaugcaacguaaaccauaaaccaucaaauacaaaaguagacaaaaaagucgaaccaaaaucuugcgacaaaacacacaccugcccaccuugcccagcaccagaacuacuuggcggaccaucaguauuccuauuccccccaaaaccaaaagauacacuaaugauauccagaacuccagaagucacaugcguaguaguagacgucucucacgaagacccagaaguaaaauucaauugguacgucgacgguguagaaguacauaacgcaaaaaccaaaccaagagaagaacaauacaacuccacauauagaguagucucaguauuaacaguccuucaccaagacugguuaaacgguaaagaauacaaauguaaaguauccaacaaagcuuuaccagcaccaauagaaaaaacaauuucaaaagccaaaggacaaccacgugaaccacaaguuuacacauuaccuccaucaagagacgaacuaacaaaaaaccaagucucucuaacuugccuaguuaaaggcuuuuacccaucagacauagccguagaaugggaauccaacggacaacccgaaaacaauuacaaaacaacaccaccaguuuuagacucagacggcucauuuuuucuauauucaaaauuaacaguagacaaaucacgauggcaacaaggaaacguauucucaugcucuguaaugcacgaagcacuacauaaucauuacacacaaaaaucuuuaucacuaucuccagguaaa

SEQ ID NO: 46684 - RNA, 642 nt, Artificial Sequence
  derived and/or modified sequence opt6 from Talizumab_LightChain1
gacauauuacuaacacaaucaccaggaacacuaagcuuaagcccaggagaacgcgcaacauuaagcugcagagcaagucaaagcauaggaacaaacauacacugguaccaacaaaaaccaggacaagcaccaagacucuuaauaaaauacgcaucagaaagcauaaguggaauaccaucaagauucucaggaucaggaucaggcacagacuuuacacuaacaauaagcagacuagaaccagaagacuucgcuauguacuacugucaacaaucagacucauggccaacaacauuuggacaaggaacaaaaguagaaauaaaaagaacaguagcagcaccaucaguauucauauucccaccaucagacgaacaacuaaaaucaggaacagcaucaguaguaugcuuacucaacaacuucuacccaagagaagcaaaaguacaauggaaaguagacaacgcacuacaaagcgguaacucacaagaaagcguaacagaacaagacucaaaagauucaacauacagccuaucaucaaccuuaacacuaagcaaagcagacuacgaaaaacacaaaguauacgcaugcgaaguaacacaccaaggccuaagcucaccaguaacaaaaagcuucaacagaggcgaaugc

SEQ ID NO: 46685 - RNA, 1368 nt, Artificial Sequence
  derived and/or modified sequence opt6 from Tamtuvetmab_HeavyChain1
gaaguaaaacuauuagaaucagguggaggucuaguccaaccaggagguucaaugagauuaagcugcgcagguuccggauuuacauucacagacuuuuauaugaauuggauaagacaaccagcaggaaaagcuccagaaugguuagguuuuauacgagacaaagcuaaaggauacaccacagaauauaacccaucaguaaaaggccgcuuuacuauuucaagagacaauacgcaaaauauguuauaccuacaaaugaauacccuaagagcagaagauacagcuaccuauuauugugcaagagaaggacauacagcagcaccauuugacuauuggggucaaggcacacuaguaacaguaucaucagcaucaacaacagccccaucuguguuuccucuagcaccuucaugugguucaacaucuggaagcaccguagcauuagcauguuuaguaucaggauacuuuccagaaccaguaacaguaucauggaacucuggaagucuaacaucuggaguccauacauuuccaucaguauuacaaucaucaggcuuauacuccuuaucaagcaugguaacagucccaucaucaagauggccaucagaaacauuuacaugcaauguugcacacccagcuucaaaaacuaagguagauaaaccuguaccaaaaagagaaaauggaagaguaccaagaccaccugauuguccuaaaugucccgcaccagaaauguuaggaggaccuucuguauuuauauuuccacccaaaccuaaagauacacuacuaaucgcaagaacaccagaaguaacaugcguaguaguagauuuagauccggaagacccagagguacaaaucucaugguuuguugacggaaaacaaaugcaaacagcuaaaacacaaccacgagaagaacaauucaacggaacauaucgaguaguaucaguacuaccuaucggacaccaagacugguuaaaaggaaaacaauuuacauguaaaguuaacaauaaagccuuaccaagcccaaucgaaagaacaauaucaaaagcuagaggucaagcucaucaaccauccguuuauguacucccaccaaguagagaagaacuauccaaaaacacaguaucuuuaacaugccuaauuaaagauuuuuuccccccagacauagacguugaauggcaaucaaacggacaacaagaaccugaauccaaauauagaaccacaccuccgcaacuagaugaagauggauccuauuuuuuauacucaaaauuaucaguagauaaaucaagauggcaacgaggagauacauuuauaugugcaguaaugcaugaagcuuuacauaaccacuauacacaaaaaucucucucacauucacccggaaaa

SEQ ID NO: 46686 - RNA, 639 nt, Artificial Sequence
  derived and/or modified sequence opt6 from Tamtuvetmab_LightChain1
gacauaaaaaugacacaaucaccaucauuccuaucagcaucaguaggagauagaguaacacuaaacugcaaagccucccaaaacauagauaaauaccuaaacugguaucaacaaaaacuaggagaauccccaaaacuccuaaucuacaacacaaacaaccuacaaacaggaauaccaucaagauucucaggaucagguucaggaacagacuuuacacuaacaauaucaucacuacaaccagaagacguagcaacauauuucugccuacaacacaucucaagaccaagaacauucggcggaggaacccaccuaacaguauuaggacaaccaaaagcauccccaucaguaacauuauuuccaccaucaucagaagaauuaggagcaaacaaagcaacccuaguaugucuaauaucagacuucuacccaucaggaguaacaguagcauggaaagcagacggaucaccaaucacacaaggagucgaaacaacaaaaccaucaaaacaaucaaacaacaaauacgcagcaucaucauaccuaucacuaacaccagacaaauggaaaucacacuccucauucucaugcuuaguaacacaugaaggauccacaguagaaaaaaaagucgcaccagcagaaugcuca

SEQ ID NO: 46687 - RNA, 360 nt, Artificial Sequence
  derived and/or modified sequence opt6 from Tanezumab_HeavyChain
caaguacaauuacaagaaagcggaccaggacuaguaaaaccaagcgaaacauuaagcuuaacauguacaguaagcggauucucacuaauaggauaugacuuaaacuggauaagacaaccaccaggaaaaggacuagaauggauaggaauaauauggggagauggaacaacagauuacaauagugcaguaaaaagcagaguaacaauaucaaaagauacaucaaaaaaucaauuuaguuuaaaauuaagcucaguaacagcagcagacacagcaguauacuauugcgcaagaggaggauauugguaugcaacaagcuauuacuuugacuauuggggacaaggaacauuaguaacaguauca

SEQ ID NO: 46688 - RNA, 327 nt, Artificial Sequence
  derived and/or modified sequence opt6 from Tanezumab_LightChain
gacauacaaaugacacaaucaccaucaucauuaucagcaucaguaggagacagaguaacaauaacaugcagagcaucacaaucaauaucaaacaaccuaaacugguaccaacaaaaaccaggaaaagcaccaaaacuacuaauauacuacacaucaagauuccacucaggaguaccaucaagauucucaggaucaggaucaggaacagacuucacauucacaauaucaucacuacaaccagaagacauagcaacauacuacugccaacaagaacacacacuaccauacacauucggacaaggaacaaaacuagaaauaaaaagaaca

SEQ ID NO: 46689 - RNA, 1323 nt, Artificial Sequence
  derived and/or modified sequence opt6 from Tarextumab_HeavyChain1
gaaguucaacuaguagaaagcggcggaggucuaguacaaccaggaggaucacuaagacuaagcugugccgcaucuggcuucacauucucauccucaggaaugucauggguccgacaagcaccaggaaaaggauuagaauggguaucaguaauagcaaguucuggaucaaauaccuacuaugcagauagcguaaaaggaagauuuacaauaagcagagacaauagcaaaaacacacuauaucuacaaaugaauucucuaagagcagaagauacagcaguuuauuacugcgcucgaucaauauuuuauacaacauggggacaaggaacucuagucacaguaucuagcgcaucuacuaaaggaccaucagucuuuccauuagccccaugcucuagaucaacaucagaauccacugcagcauuagguugucuaguaaaagauuauuuucccgaaccaguuacaguaaguuggaacucaggagcacuaacuucaggaguacauaccuuuccagcaguacuacaaucaagcggauuauauucauuaucaucaguaguuacaguacccucuucaaacuucggaacacaaacauauacaugcaauguugaccauaaaccauccaacacaaaaguagauaaaacagucgaaagaaaaugcuguguugaaugcccacccuguccagcacccccaguugcuggaccaucuguauucuuauucccaccaaaaccaaaagacacacuaaugauaucaagaacaccagaaguuacaugcguaguuguagauguaagccacgaagaucccgaaguacaauucaacugguauguagacggaguugaaguacauaaugccaaaacuaaacccagagaagaacaauuuaacaguacauuucgcguaguaucaguauuaaccguaguucaucaagauuggcuaaacggaaaagaauacaaauguaaaguaucuaacaaaggacuuccugcuccaauagaaaaaacaauaucaaaaaccaaaggacaacccagagaaccacaaguauacacacuuccuccaucaagagaagaaaugaccaaaaaccaagucucacuaacaugccuaguaaaaggcuucuacccaucagacauagcuguagaaugggaaucaaauggacaaccugaaaacaauuauaaaacaacaccaccaauguuagauucagacggaucuuuuuuccuauacucaaaauuaaccguagauaaaucuagauggcaacaaggaaauguauucucauguaguguaaugcacgaagcacuacauaaccacuauacacaaaaaucacuaucauuaucaccagguaaa

SEQ ID NO: 46690 - RNA, 645 nt, Artificial Sequence
  derived and/or modified sequence opt6 from Tarextumab_LightChain1
gacauaguauuaacacaaucaccagcaacccuaucacuaucaccaggagaacgagcaaccuuauccugccgagcaucucaaucaguaagauccaacuaccuagccugguaccaacaaaaaccuggacaagcaccaagacuuuuaauauacggcgcaucaucaagagcaaccggaguaccagcaagauucucaggaucagguucaggcacagacuucacacuaacaauaucaucauuagaaccagaagacuucgcaguauacuacugccaacaauacucaaacuucccaauaacauucggacaaggaacaaaaguagaaauaaaaagaacaguagcagccccaucaguauucauauucccaccaagcgacgaacaacuaaaaucaggaacagcaucagucguaugcuuacuaaacaacuucuacccaagagaagcaaaaguacaauggaaaguagacaacgcauuacaaucaggaaauucacaagaaucaguaacagaacaagacucaaaagauuccacauacucacuauccucaacacuaacacuaucuaaagcagacuacgaaaaacacaaaguauacgcaugcgaagucacacaucaaggauuaucaucaccaguaacaaaaucauucaacagaggagaaugc

SEQ ID NO: 46691 - RNA, 363 nt, Artificial Sequence
  derived and/or modified sequence opt6 from Tefibazumab_HeavyChain1
caaguacaauuaaaagaaagcggaccaggacuaguaaaaccaagccaaacauuaagcauaacauguacaauaagcggauucucacuaucaagauauagcguacacuggguaagacaaccaccaggaaaaggacuagaauggcuaggaaugauauggggaggaggaaauacagauuacaauagcgcacuaaaaagcagacuaucaauaucaaaagauaacucaaaaaaucaaguauucuuaaaaaugaacucacuaacagcagcagacacagcaguauacuauugcgcaagaaaaggagaauucuauuacggauacgauggauuuguauauuggggacaaggaacauuaguaacaguaucaagc

SEQ ID NO: 46692 - RNA, 336 nt, Artificial Sequence
  derived and/or modified sequence opt6 from Tefibazumab_LightChain1
gacauaguaaugacacaaucaccagacucacuagcaguaucacuaggagaacgaguaacaaugaacugcaaaucaucacaaucaguacuauacucaucaaaccaaaaaaacuaccuagcaugguaccaacaaaaaccaggacaaucaccaaaacuacuaauauacugggcaucaacaagagaaucaggaguaccagacagauucucaggaucaggaucaggaacagacuucacacuaacaauaucaucaguacaagcagaagaccuagcaguauacuacugccaccaauaccuaucaucauacacauucggaggaggaacaaaacuagaaauaaaa

SEQ ID NO: 46693 - RNA, 1368 nt, Artificial Sequence
  derived and/or modified sequence opt6 from Tenatumomab_HeavyChain1
gaaauucaacuacaacaaucaggaccagaacuagucaaaccaggagcuuccguaaaaguaucauguaaagcaucaggauacgcauuuacaucauauaacauguacugggucaaacaaucucacggcaaaucacuagaauggauaggauacaucgacccauacaaugguguaaccucauauaaccaaaaauucaaaggaaaagccacacuaacaguagacaaaucuuccucuacagcauauaugcacuuaaauagccuaacaucugaagacucagcaguauacuacugcgcaagaggaggaggaucaaucuacuaugcaauggacuacuggggacaaggaaccucugucacaguauccuccgccaaaacaacacccccuucaguauacccacuagcacccggaugcggagacacuacaggcucaucugucacauuagguugccucguaaaagguuacuucccagaaaguguuacaguaacauggaacucaggauccuuaucaucuuccguacacacauucccagcccuauuacaaucaggacuauacacuaugucaucaucaguaacaguaccauccucaacauggccaucacaaacagucacaugcucagucgcacacccagcuucaagcacaacaguagacaaaaaauuagaaccaucaggaccaauuucaacaauaaaucccuguccaccaugcaaagaaugccacaaaugcccagccccaaaccuagaaggaggaccaucaguauucauauucccaccaaauauaaaagacgucuuaaugauaucacuaacaccaaaaguaacaugcguaguaguugacguaucagaagacgacccagauguacaaauaucaugguucguaaauaacguagaaguacauacagcacaaacacaaacacacagagaagacuacaacucaacuauaagagucguaagcacacuaccuauccaacaucaagacuggaugucaggaaaagaauuuaaauguaaaguaaacaacaaagaucucccaucaccaauagaacgaacuauauccaaaauaaaaggacuaguacgagcuccacaaguauauauauuaccacccccagcugaacaauuaucuagaaaagacguaucacuaacaugccucguagucggauuuaacccaggcgacauaucagucgaauggacaucaaacggacacacagaagaaaacuauaaagacacagcccccguauuagacucugauggaucauacuuuauauauaguaaauuaaauaugaaaaccagcaaaugggaaaaaacagacuccuucucaugcaacgucagacacgaaggucuaaaaaacuauuacuuaaaaaaaacaauaucaagaucaccaggaaaa

SEQ ID NO: 46694 - RNA, 657 nt, Artificial Sequence
  derived and/or modified sequence opt6 from Tenatumomab_LightChain1
gacauaguaaugacacaagcagcaccaucaguaccaguaacaccaggagaaucaguaucaauaucaugcagaucaucuaaaucacuacuacacuccaacggaaacacauaccuauacugguuccuacaaagaccaggacaaucuccacaacuauuaauauacagaaugucaaaccuagcaucaggaguaccagacagauucucaggaucaggaucaggaacagcauucacacuaagaauaucaagaguagaagcagaagacguaggaguauacuauugcaugcaacaccuagaauauccauuaacuuucggagcaggaacaaaauuagaacuaaaaagagcagacgcagcaccaacaguaucaauauucccaccaucaagcgaacaacuaaccucaggaggagcaucagucguaugcuuuuuaaacaacuucuacccaaaagacauaaacguaaaauggaaaauagacggaucagaaagacaaaacggaguauuaaacucauggacagaccaagacucaaaagacucaaccuacucaaugucaucuacacuaacauuaacaaaagacgaauacgaaagacacaacucauacacaugcgaagcaacacacaaaacaucaacauccccaauaguaaaaucauucaacagaaacgaaugc

SEQ ID NO: 46695 - RNA, 1356 nt, Artificial Sequence
  derived and/or modified sequence opt6 from Teneliximab_HeavyChain1
caaauacaauuaguacaaucaggacccgaauuaaaaaaaccaggagaaacagucagaauaucauguaaagcauccggcuacgcauuuaccacaaccggaaugcaauggguacaagaaaugccaggaaaaggacuaaaauggauaggauggauaaacacacauucaggcguucccaaauacguagaagacuucaaaggaagauuugcauucucccuagaaacauccgcaaacacugcauaccuccaaauaucaaauuuaaaaaaugaagacacagcaacauauuucugcguaagaucaggaaauggaaauuacgaccuagcauauuuugccuacuggggacaaggaacacuaguaacaguaucagcagccucaacaaaagguccaucaguauuuccccucgccccaucauccaaaucaacaucaggagguacugcagcacucggcugccuagucaaagacuacuuccccgaacccguaaccguaucuuggaacaguggagcacuaacaucaggaguacacacauucccagcaguccuacaaucuucuggauuauacucauuaucaucaguaguaacaguacccagcaguucacuaggaacccaaaccuacauaugcaauguuaaccacaaaccauccaauaccaaaguagacaaaaaaguagaaccaaaaucaugcgacaaaacacauacaugcccaccaugucccgcacccgaauuacucggaggaccauccguuuuccuauucccaccaaaaccaaaagauaccuuaaugauaucaagaacaccagaaguaacaugcguuguaguagacgucucacacgaggacccugaaguaaaauuuaacugguacgucgacggaguagaaguccauaacgcaaaaacuaaaccaagagaagaacaauauaacuccacauauagaguuguuuccguuuuaacgguacuacaucaagacugguuaaacggcaaagaauacaaaugcaaaguuucaaauaaagcauuacccgcacccaucgaaaaaacaaucucuaaagcuaaaggccaaccaagagaaccacaagucuacacacuaccaccaucacgcgacgaacucacaaaaaaccaaguuucuuuaacaugccuaguaaaaggcuucuaccccucagacauagcugucgaaugggaaucaaacggacaacccgaaaacaacuacaaaaccacaccaccaguccuagacucagacggaucuuuuuuccuauacucuaaauuaacaguagauaaaucaagauggcaacaagguaacgucuucucuuguucuguaaugcaugaagcuuuacacaaccacuacacacaaaaaucauuaucauuaucucccggcaaa

SEQ ID NO: 46696 - RNA, 642 nt, Artificial Sequence
  derived and/or modified sequence opt6 from Teneliximab_LightChain1
gacauaguacuaacacaaucaccagccacauuaucaguaacaccuggcgacagaguaucacuaucaugcagagcaucacaaucaauaucagacuacuuacacugguaccaacaaaaaucccacgaaucaccaagacuacuaauaaaauaugcaucccacuccauaucaggaauaccaagcagauucucaggaucaggaucaggaucagacuucacacuaagcauaaacucaguagaaccagaagacguaggaauauacuacugccaacacggacacucauuuccauggacauucggaggaggaacaaaacucgaaauaaaacgaacaguagcagcaccaagcguauucauauucccaccaucagacgaacaauuaaaaucuggaacagccucaguaguaugccuacuaaacaacuucuacccaagagaagcaaaaguacaauggaaaguagacaacgcacuacaauccggaaacucacaagaaucaguaacagaacaagacucaaaagacucaacauauucauuaucaucaacacuaacauuaagcaaagcagacuacgaaaaacacaaaguauacgcaugcgaaguaacacaccaaggacuaucaucaccaguaaccaaaucauucaacagaggcgaaugc

SEQ ID NO: 46697 - RNA, 1347 nt, Artificial Sequence
  derived and/or modified sequence opt6 from Teplizumab_HeavyChain1
caaguucaacuaguacaaucaggaggaggaguaguucaaccaggcagaucuuuaagacucucaugcaaagccucaggauacaccuucaccagauacacaaugcauuggguucgacaagcuccaggcaaaggacuugaauggauugguuacaucaacccaucucgaggauacacuaacuacaaucaaaaaguaaaagacagauucacuauaagcagagacaacuccaaaaacacagcuuuucuacaaauggacagucuaagaccagaagacaccggcguauacuucugugcaagauacuacgacgaucacuauugccuagacuacuggggacaaggaacccccguaacagucuccagcgccuccacaaaaggaccaucaguauucccacuagcaccaucuucuaaaucaaccucaggaggaacagcagcuuuaggaugccuaguaaaagauuacuuuccagaaccaguaacaguauccuggaauuccggagcucucacaucaggaguucacacauuccccgcaguucuacaaucuuccggacucuacagccucucaucaguaguaacaguaccuucuucuucuuuaggaacacaaacauacaucugcaauguaaaucacaaaccauccaacacaaaaguagacaaaaaaguagaacccaaauccugugacaaaacacauacaugcccaccuugcccagcaccagaagccgcaggaggaccaucaguauuucuauuccccccuaaaccaaaagauaccuuaaugauaucaagaaccccagaaguaaccugcguuguuguagauguaucacacgaagauccagaaguaaaauucaacugguauguagacggaguugaaguacauaacgcaaaaacaaaaccaagagaagaacaauacaauuccacauaucgaguaguaucaguucuuacagugcuccaucaagacuggcucaauggcaaagaauacaaaugcaaaguauccaacaaagcauuacccgcaccaauagaaaaaacaauaucgaaagcaaaaggccaaccacgagaaccacaaguuuacacacuuccaccaucaagagaugaauuaaccaaaaaccaaguaucacuaacaugcuuaguaaaaggauuuuacccaucagacauagcaguagaaugggaaucaaauggccaaccagaaaacaacuacaaaacaacaccaccaguauuagacucagacggaucauucuuuuuauauucaaaacuaacagucgacaaaaguagauggcaacaaggaaacguauuuucaugcucaguaaugcaugaagcauuacauaaccacuauacacaaaaaucacuauccuuaucaccaggaaaa

SEQ ID NO: 46698 - RNA, 639 nt, Artificial Sequence
  derived and/or modified sequence opt6 from Teplizumab_LightChain1
gacauacaaaugacccaaucaccauccucacuaucagccucaguaggagacagaguaacaauaacaugcucagcauccucaucaguaucauacaugaacugguaccaacaaacaccaggaaaagcaccaaaaagauggauauacgauacauccaaacucgcaucuggaguaccaucaagauucucaggauccggaucaggaacagacuacacauucacuauaucaucauuacaacccgaagacauagccacauauuacugccaacaauggucaucaaacccauucacauuuggacaaggaacaaaacuccaaauaacaagaacaguagccgcaccaucaguauucauauucccaccaucagacgaacaacuaaaaucaggaacagcaucaguaguaugccuauuaaacaacuucuacccaagagaagcaaaaguucaauggaaaguagacaacgcacuacaaucaggaaacucacaagaauccguaacagaacaagacucaaaagauucaacauacuccuuaucaucaacacuaacacuaucaaaagcagauuacgaaaaacacaaaguauacgcaugcgaaguaacacaucaaggacuaucaucaccaguaacaaaauccuucaauagaggagaaugc

SEQ ID NO: 46699 - RNA, 1344 nt, Artificial Sequence
  derived and/or modified sequence opt6 from Teprotumumab_HeavyChain1
caaguagaacuaguagaaucaggaggaggagucguacaaccuggccgcucacaaagacuaaguugugcagcaucaggauuuaccuuuucaucuuacggaaugcacuggguacgacaagcaccaggaaaaggauuagaauggguagcaauaauaugguuugacggauccucaaccuacuaugcagacucuguaagaggcagauuuacaaucaguagagacaacucuaaaaauacucuuuaccuccaaaugaacucauuaagagccgaagacacagcagucuauuuuugcgcacgugaacuagguagacgauacuucgaccuauggggacgaggaacacuaguauccgucaguucagccucuacaaaaggaccaucaguauucccccuagcaccaucaucaaaaaguacaucaggaggaaccgccgccuuaggaugucuaguaaaagacuauuuccccgaaccaguaaccgucucauggaacucaggcgcacuaacuucaggcguacacacauuuccagcaguccuacaaucuucaggacuauauucauuaagcucaguaguaacaguaccaucaucuucucuaggaacucaaacauauauaugcaaugucaaccacaaaccauccaacacaaaaguagacaaaaaaguagaaccaaaaucaugcgauaaaacccacacaugcccuccaugcccagcaccggaauuauuaggaggacccucaguauucuuauucccacccaaacccaaagacacuuuaaugauaucaagaacacccgaaguaacaugcguaguaguagaugucagccaugaggacccugaaguaaaauucaacugguauguagacggcgucgaaguacacaaugcaaaaacaaaacccagagaagaacaauacaauucaacuuauagaguuguauccguucuuacuguacuacaccaagacuggcuaaaugguaaagaauauaaaugcaaaguaucaaauaaagcauuacccgcuccaauugaaaaaacaauuucaaaagccaaaggucaaccaagagaaccacaaguauacacacucccacccucaagagacgaacuaacaaaaaaccaaguaucauuaacaugcuuaguaaaaggauuuuauccaucagauaucgcaguagaaugggaauccaauggccaaccagaaaacaauuacaaaacaacaccaccaguauuagauuccgacggaaguuuuuuuuuauacucaaaauuaacuguagauaaaucaagauggcaacaaggaaauguuuucucuuguucaguaaugcacgaagcacuacauaaucacuauacacaaaaaucuuuauccuuaucacccggaaaa

SEQ ID NO: 46700 - RNA, 645 nt, Artificial Sequence
  derived and/or modified sequence opt6 from Teprotumumab_LightChain1
gaaauaguacuaacacaaucaccagcaacauuaucacucuccccaggagaaagagcaacacuaucaugcagagcaucacaaucuguaucaucauaccuagcaugguaccaacaaaaaccaggacaagcaccaagacuacuaauauacgacgcaucaaaaagagcaacaggaauaccagcacgauucucaggaucaggaucaggcacagacuucacauuaacaauaucaucacuagaaccagaagacuucgcaguauacuacugccaacaaagaucaaaauggccaccauggacauucggacaaggaacaaaaguagaaucaaaaagaacaguagcagcaccauccguauucauauucccaccaucagacgaacaacucaaaucaggaacagcaucaguagucugccuacuaaacaacuucuacccaagagaagcaaaaguacaauggaaaguagacaacgcccuacaaucaggaaacucacaagaaucagucacagaacaagacuccaaagacucaacauacucacuaucaucaacauuaacacuaucaaaagcagacuacgaaaaacacaaaguauacgcaugugaaguaacacaccaaggacuaucaucaccaguaacaaaaucauucaacagaggagaaugc

SEQ ID NO: 46701 - RNA, 1338 nt, Artificial Sequence
  derived and/or modified sequence opt6 from Tesidolumab_HeavyChain1
gaaguccaacuaguucaaucaggcgcagaaguaaaaaaaccaggaucaucaguaaaagucucaugcaaagccuccggaggaacauucaguucauacgcuauaucauggguaagacaagcaccaggacaaggccuagaauggauggguggaauaggaccauucuucggaacagcaaacuaugcucaaaaauuccaaggaagggucacaauaacagccgacgaaucaacaaguacagccuacauggaauuaucaucacuaagaucagaagacacagcaguauauuacugcgcaagagauacaccauacuucgacuacuggggacaaggcacauuaguaacugucucaucagcaaguacaaaaggaccaucuguauuuccacuagcuccauccucaaaaucaacgucaggaggaacagcagcccuaggaugccuaguaaaagauuacuucccagagccaguaacaguaaguuggaauucaggagcauuaaccuccggaguucauaccuuuccagcaguauuacaaagcucaggacuauacagcuuaucaagcguaguaaccgucccuuccucaucucuaggaacacaaacauauauuugcaacguaaaccacaaaccuaguaauacgaaaguagacaaaagaguagaaccaaaaucaugugauaaaacccacacauguccaccaugcccagccccagaagcagcaggaggaccaagugucuucuuauucccuccuaaaccaaaagacacacuaaugauaucacgaacaccagaaguuacauguguaguaguagauguaagucaugaagauccagaaguaaaauuuaacugguacgucgauggaguagaaguucacaacgcaaaaaccaaaccaagagaagaacaauauaauucaacauauagaguaguauccgucuuaacaguacuacaccaagacuggcuaaauggaaaagaauacaaaugcaaaguaucaaacaaagcauuaccagcaccaauagaaaaaacaauaaguaaagcaaaaggccaaccaagagaaccacaaguauacacauuaccaccaaguagagaagaaaugacaaaaaaccaaguaucauuaacauguuuaguaaaaggauuuuacccaagugacauagccguagaaugggaaucaaacggucaaccagaaaacaauuacaaaacaacaccaccaguacuagacucagaugguuccuucuuccuauauaguaaacuuacaguagacaaaucaagauggcaacaaggaaacgucuucucuugcucuguaaugcaugaagcccuacauaaccacuauacacaaaaaucacuuucauuaucaccagguaaa

SEQ ID NO: 46702 - RNA, 642 nt, Artificial Sequence
  derived and/or modified sequence opt6 from Tesidolumab_LightChain1
ucauacgaauuaacacaaccacuaucaguauccguagcacuaggacaaacagcaagaauaacaugcucuggagacuccauaccaaacuacuacguauauugguaccaacaaaaaccaggacaagcaccaguccuaguaauauacgacgacucaaacagaccaucaggaauaccagaaagauucucaggaagcaacucaggaaacacagccacacuaacaauaucaagagcacaagcaggagacgaagcagacuacuacugucaaucauucgacagcucacuaaacgccgaaguuuucggaggaggaacaaaauuaacaguacuaggacaaccaaaagcagcaccaucaguaacuuuauucccaccaucaucagaagaacuacaagcaaacaaagcaacacuaguaugccuaauauccgacuucuacccaggcgcaguaacaguagcauggaaagcagacucaucaccagucaaagcaggcgucgaaacaacaacaccaucaaaacaaucaaacaacaaauacgcagccucaucauaccuaucacuaacaccagaacaauggaaaucacacagaucauauucaugccaagucacacacgaaggaucaacaguagaaaaaaccguagcaccaacagaaugcuca

SEQ ID NO: 46703 - RNA, 1344 nt, Artificial Sequence
  derived and/or modified sequence opt6 from Tezepelumab_HeavyChain1
caaaugcaauuaguagaaucggguggcggaguaguacaacccggccgaucacuuagacuaagcugcgcagcaucaggcuuuaccuucagaacauacggaaugcauuggguaagacaagccccaggaaaaggauuagaauggguagccguaauaugguaugacggaucaaacaaacacuaugcagacucuguaaaaggaagauuuacuauaacaagagacaacucaaaaaauacacuuaacuuacaaaugaacucauuaagagcagaagauacugcaguauacuacugcgcaagagcuccacaaugggaacuuguacacgaagcauucgacauauggggacaaggaacaaugguaacaguaucaucugcauccacaaaaggaccuucagucuuucccuuagcuccaugcucacgaucaacaucagaaucaacagcagcuuuaggaugucuaguaaaagauuacuuucccgaacccguaacagucagcuggaacaguggagcacuaacuucaggcguacauacauuuccagccgucuuacaaucaucuggacuauacucacugucaucugucguaaccguuccaucuucaaauuucggaacccaaaccuacacaugcaauguugaucacaaaccaucaaauacaaaaguagauaaaacaguagaaagaaaaugcuguguugaaugcccaccuuguccugcaccuccaguagcaggaccauccgucuuccuauuuccaccaaaacccaaagauacauuaaugauaucaagaacaccagaaguaacauguguuguuguagacguaucacacgaagauccugaaguacaauucaacugguacguagacggaguagaaguacauaaugcaaaaacaaaaccaagagaagaacaauucaacucaacauuuagaguaguuucaguauuaacaguaguccaccaagacuggcuaaacggaaaagaauauaaaugcaaagucucaaacaaaggauuaccagcaccaauagaaaaaacaauaucgaaaacaaaaggacaaccaagagaaccccaaguauacacacuaccaccuucacgcgaagaaaugacaaaaaaucaaguuucccuaacauguuuaguaaaaggauucuauccaucagacaucgcaguagaaugggaaucaaauggacaaccagaaaacaauuauaaaaccacaccaccaauguuagauucggacggaagcuuuuucuuauacucaaaacuuacagucgauaaaucaagauggcaacaaggaaacguauucucaugcucaguaaugcacgaagcauuacacaaucacuacacucaaaaaucuuuaucuuuaagcccaggaaaa

SEQ ID NO: 46704 - RNA, 642 nt, Artificial Sequence
  derived and/or modified sequence opt6 from Tezepelumab_LightChain1
ucauauguacuaacacaaccaccaucaguaucaguugcaccuggacaaaccgcaagaaucacaugcggaggaaacaacuuaggaucaaaaucaguacauugguaccaacaaaaaccaggacaagcaccaguacuaguagucuacgaugacucagacaggccaucauggauaccagaaagauucucaggaucaaacucaggaaacacagcaacacuaacaauaucaagaggagaagcaggagacgaagcagacuacuacugccaaguaugggacucaucaagugaccacguaguauucggaggcggaacaaaacuaacaguauuaggacaaccaaaagcagcaccaagcguaacacuauucccaccaucaagcgaagaauuacaagcaaacaaagcaacacuaguaugccuaauaagcgacuucuacccaggagcaguaacaguagcauggaaagcagacucaucaccaguaaaagcaggaguagaaacaacaacaccaucaaaacaaaguaauaacaaauacgcagcaucuucauacuuaucauuaacaccagaacaauggaaaucacacagaucauacucaugccaaguaacacacgaaggaucaacaguagaaaaaacaguagcaccaacagaaugcuca

SEQ ID NO: 46705 - RNA, 1338 nt, Artificial Sequence
  derived and/or modified sequence opt6 from ThioMAb-chMA79b-HC(A118C)_HeavyChain
gaaguacaacuacaacaauccggagcagaacuaaugaaaccaggagcauccguaaaaauaucuugcaaagcaacaggauacacuuucucaucauacuggauagaauggguaaaacaaagacccggucacggacuagaauggauaggagaaaucuuaccaggagguggcgacacaaacuacaacgaaauauucaaaggaaaagcaacauucacagcagacacauccucuaacaccgcauauaugcagcuaucaucucuaacaucagaagauuccgccguuuacuacuguaccagaagaguaccagucuacuucgacuacuggggacaaggaacaucaguaacaguaucaucguguucaacaaaaggcccaucagucuucccacucgccccuuccucaaaauccacaucaggaggaacagcagcacuaggaugccuaguaaaagacuauuucccagaaccaguaacaguaagcuggaacucaggagcucuaacaucagguguacauacauucccagcaguauuacaaucaaguggauuauacucacuaucauccguaguaacaguacccucaucaaguuugggcacacaaacauacauaugcaacguaaaccauaaaccaaguaacacaaaaguagauaaaaaagucgaaccuaaaucaugcgauaaaacccauaccugucccccaugcccagcaccagaauuacuaggaggaccaucaguauuuuuauucccaccaaaacccaaagacaccuuaaugaucucacguacaccagaaguaacaugcgucguaguagacguaucccacgaagacccagaagucaaauucaauugguauguagauggagucgaaguacacaaugccaaaacaaaaccccgagaagaacaauauaacucaacauauagaguaguauccguuuuaacaguacuacaccaagacuggcuaaacgguaaagaauauaaaugcaaaguauccaacaaagccuuacccgcaccaauagaaaaaacaauaucaaaagcaaaaggucaaccaagagaaccacaaguauacacucuaccacccucaagagaagaaaugacaaaaaaccaaguaucauuaaccuguuuaguaaaaggauucuauccuuccgacaucgccguagaaugggaaucuaacggucaaccagaaaacaacuacaaaaccacaccaccaguccuagacucagauggauccuucuuccuuuacuccaaauuaacaguagacaaaucuagguggcaacaaggaaauguauuuucaugcucaguaaugcacgaagcauuacacaaccacuacacacaaaaaucauuaagccucucacccgga

SEQ ID NO: 46706 - RNA, 1347 nt, Artificial Sequence
  derived and/or modified sequence opt6 from ThioMab-hu10A8.v1-HC(A118C)_HeavyChain
gaaguacaacucguagaauccggaggaggauuaguacaaccagguggaucauuaagauuaucuugcgcagcaucaggcuucacauucucauccuacgcagucaguuggguaagacaagcaccaggcaaaggauuagaauggguagcaacaauaucauccggcggcucacuaacauuuuaccuugacucaguuagaggucgauucacaauauccagagacaacucaaaaaauacauuauaccuucaaaugaacuccuuaagagcagaagauacugcaguauauuacugcgcacgacccaucccagacuauuaugcucuagauuacuggggacaaggaacacuaguuaccguuucauccugcuccaccaaaggcccaaguguauucccucuagcaccaucauccaaauccacaucuggcggcacugccgcuuuaggcugcuuaguaaaagauuauuuccccgaaccaguaacugucucauggaauuccggugcauuaacaucaggaguucacacauuccccgcaguacuccaaagcucaggacuauauucauuaucauccgucguaacaguuccuuccucuucccuaggaacacaaacuuauauaugcaaugucaaccacaaaccaucaaacacaaaagucgauaaaaaaguagaaccaaaauccugugacaaaacacacacauguccaccauguccagcaccagaauuacuaggagguccauccgucuuuuuauuuccaccaaaaccaaaagauacccucaugauaucuagaacaccagaagucacaugcguaguaguagacguaucucacgaagauccugaaguuaaauuuaacugguauguugacggaguagaaguacauaaugcaaaaacaaaaccaagagaagaacaauauaauagcacauaucgaguaguuucagucuuaacaguuuuacaccaagacuggcuaaacggaaaagaauacaaauguaaaguaucaaacaaagcauuaccugcaccuauagagaaaacaauaucaaaagccaaaggucaaccuagagaaccucaaguauauacacuuccaccauccagagaagagaugacaaaaaaccaaguaucacuuacauguuuaguaaaaggcuucuaccccucagauauugcagucgaaugggaaucaaacggccaaccagaaaacaacuauaaaacaacaccaccaguauuagauuccgauggaucauucuuucuauacucuaaauuaacaguagacaaaucaagauggcaacagggcaaugucuucucauguucagugaugcacgaagcacuacauaaccauuacacacaaaaaucauuaucauuaucaccaggaaaa

SEQ ID NO: 46707 - RNA, 1347 nt, Artificial Sequence
  derived and/or modified sequence opt6 from ThioMab-hu10A8.v1-HC(V205C)_HeavyChain
gaaguacaauuaguugaaucaggaggaggccucguccaaccaggcggaucacuaagauuaucaugcgcagcuaguggauucacauuuucaucauacgccguaaguuggguacgucaagcaccaggaaaaggacuugaauggguugcaacaauaucauccgguggcucauuaacuuucuacuuagauaguguaagaggacgcuuuacuauuucaagagauaauucaaaaaauacauuauaccuacaaaugaauucacuaagagcagaagacacagcuguuuauuauugcgcaagaccaauaccagacuacuaugccuuagacuacuggggacaaggcacacuuguuacaguaucuagugcaucaacaaaaggaccaucaguuuucccacucgcuccaucaucaaaaaguacauccggaggaacagcagcauuaggcuguuuaguaaaagacuacuuuccagaacccgucacuguuucauggaauucaggagcauuaacauccggaguacacacauuuccagcaguacuacaaagcucaggucuauacucauuaucaucaguagugacaguaccaucaagcaguuuaggaacccaaaccuacaucuguaacguaaaucacaaaccauccaacacaaaaguugacaaaaaaguugaaccaaaauccugcgacaaaacacacacaugccccccauguccugcaccagaacuauuaggaggcccaagcguuuucuuauucccaccaaaaccaaaagacacacuaaugauaucacgcacaccagaaguaacauguguagucgucgauguuucacacgaagacccagaaguaaaauuuaauugguauguugacggagucgaaguacacaacgcaaaaacaaagcccagagaagaacaauauaacaguacauaucgcguugucucaguacuaacaguauuacaccaagauuggcuaaauggcaaagaauauaaaugcaaaguaucuaacaaagcacuaccagcaccaauagaaaaaaccauaucuaaagcuaaaggacaaccuagagaaccacaagucuauacacuaccuccuucacgcgaagaaaugacaaaaaaccaaguaucauuaacaugcuuaguaaaaggauucuaccccagcgauauagcaguagaaugggaaucaaacggucaaccagaaaacaacuacaaaaccacaccaccagucuuagacagugacggaucauuuuucuuauauagcaaacuaacaguugacaaaucuagauggcaacaaggaaauguauucucaugcucaguaaugcacgaagcauuacauaaucacuauacacaaaaaucauuaucacuaucacccggaaaa

SEQ ID NO: 46708 - RNA, 642 nt, Artificial Sequence
  derived and/or modified sequence opt6 from ThioMab-hu10A8.v1-LC(A118C)_LightChain
gacauacaaaugacacaaucaccuuccucauuaucagcaucaguaggcgacagaguaacaauaacauguaaagcaucacaagacguauccacagcaguagcaugguaccaacaaaaaccaggaaaagcaccaaaacuauuaauauacucagcaucauacagauacacaggaguaccaucaagauucucaggaucaggcucaggaacagacuucacccuaaccauauccucacuacaaccagaagacuucgcaacauacuacugccaacaacacuucucaagcccaagaacauucggacaaggaacaaaagucgaaauaaaaagaacaguagcagcaccaucaguauucauauucccaccaucagacgaacaacuaaaaucaggaacagcaucagucguaugccuauuaaacaacuucuacccaagagaagcaaaaguacaauggaaaguagauaacgcacuacaaucaggaaacucacaagaaucaguaacagaacaagacucaaaagacucaacauacucccuaucaucaacccuaacccuaucaaaagcagacuacgaaaaacacaaaguauacgcaugcgaaguaacacaccaaggcuuaucaucaccaguaacaaaaucuuucaacagaggagaaugc

SEQ ID NO: 46709 - RNA, 642 nt, Artificial Sequence
  derived and/or modified sequence opt6 from ThioMab-hu10A8.v1-LC(V205C)_LightChain
gacauacaaaugacacaaucaccaucaucacuauccgccucaguaggagacagaguaacaauaacuugcaaagcaucacaagacguaucaacagcaguagcaugguaccaacaaaaaccaggaaaagcaccaaaacuacuaaucuacucagcaucauacagauacaccggaguaccaucaagauucuccggaucaggaucagguacagacuucacauuaacaauaucaucacuacaaccagaagacuucgccacauauuacugccaacaacacuuuuccuccccacgaacauucggacaaggaacaaaaguagaaauaaaaagaacaguagcagcaccaucaguauuuauauucccaccaucagacgaacaacuaaaaucaggcacagccucaguaguaugcuuauuaaacaacuuuuacccacgagaagccaaaguacaauggaaaguagacaacgcacuacaaucaggaaacucacaagaaucaguaacagaacaagauuccaaagauucaacauacucauuauccucaacacuaacacuaucaaaagcagacuacgaaaaacacaaaguauacgcaugcgaagucacacaccaaggauuaucaucaccaugcacaaaaucuuucaacagaggagaaugc

SEQ ID NO: 46710 - RNA, 1338 nt, Artificial Sequence
  derived and/or modified sequence opt6 from ThioMAb-huMA79b.v17-HC(A118C)_HeavyChain
gaaguccaacuaguagaaucaggaggaggccuaguacaacccgguggaucacucagacuaucgugcgcagcaucuggauacacuuucaguucauacuggauagaauggguacgacaagcaccaggaaaaggauuagaauggaucggagaaauacuaccaggaggaggugauacuaauuacaacgaaauuuucaaaggacgagcaacuuucucagcugacacaagcaaaaauacagcauacuuacaaaugaacucauuaagagcagaggacacagcaguuuacuacugcacaagaagaguaccaguauacuucgauuacuggggacaaggaacauuaguuacaguuucaucauguucaacaaaaggaccaagcguauucccacuagcucccaguucaaaaucaacauccggaggaacagcagcacuaggaugucuuguaaaagauuauuucccagaaccaguuacugucucauggaacucaggugcacucacaucaggaguucacacauucccagcaguauuacaaucaucaggacuauacucacuaucaucaguaguaacaguaccaucauccucguuaggaacacaaaccuauaucugcaauguaaaucacaaaccaucaaacacaaaaguagacaaaaaaguagaacccaaaucaugcgauaaaacacacacaugcccaccauguccagcaccagaguuauuaggagguccaucaguuuuccuauucccaccaaaaccaaaagauaccuuaaugauaucaagaacaccagaaguaacaugcguagucguagauguaucacacgaagauccagaaguaaaauucaauugguacguagacggcguagaaguccauaaugcaaaaacaaaaccaagagaagaacaauacaauucaacauacaggguaguaucaguccuaacaguacuucaucaagauuggcucaacggaaaagaauacaaaugcaaaguaucaaauaaagcauuaccugccccaauugaaaaaacuauaucuaaagcaaaaggacaaccaagagaaccacaaguauacaccuuaccaccuucacgagaagaaaugacaaaaaaucaaguaucauuaacaugccuaguaaaaggauucuacccaucagacauagccgucgaaugggaaucuaacggacaacccgaaaacaauuauaaaacaacuccaccaguccuagacagcgaugguucauucuuccuuuacagcaaauuaacaguagauaaaucgagauggcaacaaggaaacguauuuucauguucagucaugcaugaagccuuacacaaccacuauacacaaaaaucauuaagcuuaagcccagga

SEQ ID NO: 46711 - RNA, 654 nt, Artificial Sequence
  derived and/or modified sequence opt6 from ThioMAb-huMA79b.v17-HC(A118C)_LightChain
gacauacaacuaacacaaucaccaucaucacuaagugcaucaguaggagaccgaguaaccauaacaugcaaagcaucccaaucaguagacuaugauggcgacucauucuuaaacugguaccaacaaaaaccaggaaaagcaccaaaacuauuaauauacgcagcaucaaaccuagaaucaggaguaccaucaagauucucaggaucaggauccggaacagacuucacacuaaccauaucaucacuacaaccagaagacuucgcaacauacuacugccaacaaucaaacgaagacccacuaacauuuggacaaggaacaaaaguagaaauaaaaagaacagucgcagcaccauccguauucauauucccaccaucugacgaacaacuaaaaucaggaacagcaucaguaguaugccuauuaaacaacuucuacccacgagaagcaaaaguacaauggaaaguagacaacgcacuacaauccggaaacucacaagaauccguaacagaacaagacucaaaagacuccaccuauucauuauccuccacccuaacacuaucaaaagccgacuacgaaaaacacaaaguauacgcaugcgaaguaacacaccaaggacuauccucaccagucacaaaaucauucaaccgaggagaaugc

SEQ ID NO: 46712 - RNA, 1338 nt, Artificial Sequence
  derived and/or modified sequence opt6 from ThioMAb-huMA79b.v18-HC(A118C)_HeavyChain
gaaguacaauuaguagaauccggcgguggauuaguucaaccaggagguucacuaagacuaucuugcgcagcauccgguuacacuuucagcucuuauuggauagaauggguacgacaagcaccagguaaaggacuagaauggauaggcgaaauacuaccaggagguggagacacuaacuauaacgaaauauuuaaaggaagagcaacauuuuccgcugacacuaguaaaaauacagcauaccuacaaaugaacagucuccgagccgaagauacagcaguauacuacuguacaagaagaguaccaaucagauuagauuauuggggacaaggaacacuaguaacaguaucgucauguaguacaaaaggaccuaguguauuuccacuagcaccuucaucaaaaucuacaucaggaggaacagcagcacuaggaugcuuaguaaaagacuacuuuccagaacccguaacaguuucauggaacucaggagcacucacaucaggaguacauacauucccagcuguauuacaaucuucaggccuuuauucacuaaguucuguaguaacaguuccuucaucuagucucggaacucaaacuuauauaugcaauguaaaccauaaaccaucaaacacaaaaguagauaaaaaaguagaaccaaaaaguugugacaaaacacauacauguccaccaugcccagcaccugaacucuuaggaggaccaaguguauuuuuauucccaccaaaaccaaaagacacuuuaaugauaucaagaacaccugaaguaacaugcguaguaguagaugucucacaugaagacccugaagucaaauucaauugguauguagauggaguugaaguacacaacgcaaaaacaaaaccccgagaggaacaauauaacucaacauaucgcgucguuucaguauuaacaguucuccaucaagauugguuaaauggaaaagaauauaaaugcaaaguaucaaauaaagcacuacccgcaccaauagaaaaaacaauuuccaaagcuaaaggucaaccucgcgaaccacaaguauacacacuuccaccaagcagagaagaaaugacaaaaaaccaaguuucucuaacauguuuaguaaaagguuuuuacccaucagauauagcaguagaaugggaaucaaacggacaacccgaaaacaacuauaagacaaccccaccaguacuagauucagacggaucauuuuucuuauacucuaaacuuacaguagacaaaagcagguggcaacaagguaacguuuucucauguucaguaaugcaugaagcauuacacaaucauuacacccaaaaaagcuuaucacuaucaccugga

SEQ ID NO: 46713 - RNA, 654 nt, Artificial Sequence
  derived and/or modified sequence opt6 from ThioMAb-huMA79b.v28-HC(A118C)_LightChain
gacauacaacuaacacaaucacccucaucacuaucagcaucagucggagaccgaguaacaauaacaugcaaagcaucccaaucaguagacuacgaaggagacucauucuuaaacugguaucaacaaaaaccaggaaaagcaccaaaacuacuaauauacgcagcaucaaacuuagaaucaggaguaccuucaagauucucaggaucaggaucaggaacagacuucacacuaaccauaucaucacuucaaccagaagacuucgccacauauuacugccaacaaucaaacgaagacccacuaacauucggacaaggaacaaaaguagaaauaaaaagaacaguagcagcaccaucaguauucauauuuccaccaucagacgaacaacuaaaaucaggaacagcauccgucguaugccuacuaaacaacuucuacccacgagaagcaaaaguacaauggaaaguagacaacgcacuacaaucaggaaacucacaagaaucaguaacagaacaagacucaaaagacucaacauauagcuuaucauccacacuaacacuauccaaagccgacuacgaaaaacauaaaguauacgcaugcgaaguaacacaccaaggacuaucaucaccaguaacuaaauccuucaauagaggagaaugc

SEQ ID NO: 46714 - RNA, 654 nt, Artificial Sequence
  derived and/or modified sequence opt6 from ThioMAb-huMA79b.v28-LC(V205C)_LightChain
gacauaguacucacacaaucaccagcaucacuagcaguaucacuaggccaaagagcaacaauaucaugcaaagcaucccaaucaguagacuacgacggagacucauuccuaaacugguaccaacaaaaaccaggccaaccaccaaaacucuuuauauacgcagcaucaaacuuagaaucaggaauaccagcaagauucucaggaucaggaucaggaacagacuucacacuaaacauacacccaguagaagaagaagacgccgccacauacuacugccaacaaucaaacgaagacccccuaacauuuggcgcaggaacagaauuagaacuaaaacgaacaguagcagcaccaagcguauucauauucccaccaucagacgaacaacuaaaaucaggaacagcaucaguaguaugcuuacuaaacaacuucuauccaagagaagcaaaaguacaauggaaaguagacaacgcacuacaaucaggaaacucacaagaaucaguaaccgaacaagacagcaaagacucaacauacucucuaucaucaacauuaacacuauccaaagcagacuacgaaaaacacaaagucuacgcaugugaaguaacacaccaaggauuaucaucaccaugcacaaaaucauucaacagaggagaaugc

SEQ ID NO: 46715 - RNA, 1332 nt, Artificial Sequence
  derived and/or modified sequence opt6 from Ticiliuab_HeavyChain1
caaguacaacucguagaaucaggaggaggaguuguacaaccaggaagaucucuaagauuaucaugcgcagcaucaggauuuacauuuagcucauauggacacuggguaagacaagcuccaggaaaaggauuagaauggguagcaguaaucugguacgauggaucuaacaaauauuaugcagacagcguaaaaggaagauuuaccauaucaagagacaauuccaaaaacacacuauaucuacaaaacuccuuaagagccgaagacacagcaguuuacuauugcgcucgcgauccaagaggggcaacucuauacuauuacuauuacggugauguauggggucaaggaacaacaguaacaguaucaucugcuucaacaaaaggaccaaguguauuuccacuagccccaugcucaagaucaacaucugaaucuacagccgcauuaggaugucuaguaaaagauuacuuuccagaaccaguaacaguuagcuggaacuccggagcacuaaccucaggaguccauacauucccugcaguacuacaaucaucaggucuauacagcuuauccucagucguaacaguuccuucaucaaacuuuggaacacaaacauauacaugcaauguagaucauaaaccuuccaauacuaagguagauaaaacagucgagagaaaaugcuguguagaauguccaccauguccagcaccuccuguagcaggaccuucaguauucuuauucccaccaaaaccaaaagacacacuuauuucaagaaccccggaaguaacaugcguaguaguagacguaagccaugaagacccugaaguacaauucaacugguacguagacggaguagaaguacacaacgcaaaaacuaaaccacgagaagaacaauuuaauagcacauucagaguaguaagcguucuaacaguaguacaccaagacuggcuaaacggaaaagaauauaaaugcaaaguauccaauaaaggauuaccagcaccaauugagaaaacuauaucaaaaacaaaaggacaaccacgagaaccacaaguauacacauuaccaccaucaagagaagaaacuaaaaaccaaguaucauuaacaugccuaguaaaaggauuuuacccaucagauaucgcuguagaaugggaaucaaauggacaaccugaaaacaauuacaaaacaacaccaccacucgacucagauggaucauucuuccuauauucaaaauuaacaguagauaaauccagauggcaacaaggcaauguauuuuccuguagcguccacgaagcauuacauaaucauuauacucaaaaaucucucucauuaucuccugguaaa

SEQ ID NO: 46716 - RNA, 639 nt, Artificial Sequence
  derived and/or modified sequence opt6 from Ticiliuab_LightChain1
gacauacaaacccaaucaccaucaucacucucagcaucaguaggagacagaguaacaauaacaugcagagcaucacaaucaauaaauucauacuuagacugguaccaacaaaaaccaggaaaagcaccaaaacuauuaaucuacgcugcauccucacuacaaucaggaguaccaagcagauucucaggcuccggaucaggaacagacuuuacucuaaccauaucaucacuucaaccagaagauuucgcaacauacuacugccaacaauacuacucaacaccauucacauucggaccaggaacaaaagucgaaaucaaaagaacagucgcagcaccaucaguauuuauauucccaccuucagacgaacaacuaaaaucaggaacagcaucaguaguaugccuacuaaacaacuucuacccacgagaagcaaaaguacaauggaaaguagacaacgcacuacaaucaggaaacucacaagaaucaguaacagaacaagacuccaaagacucaacauacucacuaucaucaacacuaacacuauccaaagcagacuacgaaaaacauaaaguauacgcaugcgaaguaacacaccaaggacuaucaucaccaguaacaaaaucauucaacagaggcgaaugc

SEQ ID NO: 46717 - RNA, 1347 nt, Artificial Sequence
  derived and/or modified sequence opt6 from Tigatuzumab_HeavyChain1
gaaguacagcuaguagaaucaggaggugguuuaguacaaccaggcggaagccuaagacuaucaugcgcagcaucaggauucacauucagcucauacguaaugucauggguacgucaagcacccggaaaaggacuagaauggguagccacaaucuccucaggcggaucauauacauauuauccagacucaguaaaagguagauucacaauauccagagacaaugcaaaaaauacacuauaccuacaaaugaauucacuaagagcagaagauacagcaguauauuacugugcaagaagaggcgacucaaugauaacaacagacuauuggggacaaggaacccuagucacagucaguucagcaucaacuaaaggaccauccguauuccccuuagcaccuucaucaaaaucaacaucaggaggaacagcugcauuaggaugucuagucaaagauuauuucccagaacccguaaccgucucuuggaauuccggcgcccuaacaagcgguguccauaccuuuccagcuguuuuacaaucaucaggacuauacagccuauccucaguaguuacaguaccaucaucauccuuagguacacaaacauacauaugcaauguaaaucacaaaccauccaauacaaaaguagacaaaagaguagaaccaaaaucuugcgacaaaacacauaccugccccccaugcccagcuccagaacuauuaggaggccccuccguuuuuuuauuuccaccaaaaccaaaagauacuuuaaugauaucacgaacccccgaaguaacaugcguagucguagacguaucacaugaagauccagaaguaaaauucaacugguacguagauggagucgaaguccacaaugcaaaaacaaaaccacgagaagaacaauacaauuccacuuacagaguaguuucaguacuaacaguccuacaccaagacuggcuuaacggaaaagaauacaaaugcaaaguaucaaauaaagcauuacccgcacccauagaaaaaacaauaaguaaagccaaaggccaaccacgugaaccacaaguauacacauuaccuccaucuagagaagaaaugaccaaaaaucaaguauccuuaacaugccucguaaaaggauucuacccuucagacauagcaguagaaugggaaaguaacggacaacccgaaaauaacuacaaaacaacaccucccguauuagauuccgacgguaguuucuuccuuuauucuaaauuaacaguagacaaaucaagauggcaacaaggaaacguauucucaugcucaguaaugcacgaagcauuacacaaccauuacacacaaaaaucacuaucccuaucuccaggaaaa

SEQ ID NO: 46718 - RNA, 1347 nt, Artificial Sequence
  derived and/or modified sequence opt6 from Tigatuzumab_HeavyChain
gaaguacaacuaguagaaucgggcggaggacuaguacaaccaggaggaucacuaagacuuucaugcgcagcaucaggauucacauuuaguucauauguaaugucauggguuagacaagcacccggaaaaggauuagaauggguagcaaccauuucaucagggggaucauacaccuauuauccagauagugugaaaggaagauuuacaauuuccagggauaacgcaaaaaacacauuauaucuacaaaugaacucacuaagagcagaagacacagccguauauuacugugcaagaagaggugacagcaugauaacaacugacuacuggggacaaggaacccuaguaacaguaucaagugcaagcacaaaaggcccaucaguauucccauuagccccuuccucaaaaucaacauccgguggaacagccgccuuaggaugccuagucaaagauuacuucccggaaccaguaacaguaucauggaauaguggcgcuuuaacuaguggaguacauacauuuccagcaguauuacaauccucaggauuauacucauuaucaucaguaguaacaguaccaucaagcucccuagguacacaaacauacauaugcaacguaaaccauaaaccuucaaauacaaaaguagauaaaagaguagaaccaaaaagcugugacaaaacacacaccuguccaccauguccagcaccagaacuccuaggaggccccucaguauuccuuuucccuccaaaacccaaagauacacuaaugauaucaagaacacccgaaguaacaugcguaguagucgacguaucacacgaagaccccgaaguaaaauucaacugguauguagacggaguagaaguacacaacgcaaaaacaaaaccaagagaagaacaguacaacucaacauauagagucguaucuguauuaacaguuuuacaucaagauuggcuuaacggcaaagaauacaaguguaaaguaucaaacaaagcauuaccugcaccaauagaaaaaacaaucuccaaagcaaaaggacaaccaagagaaccucaaguauacacacuaccaccaucuagagaagaaaugacaaaaaaucaaguaucauuaacaugccuuguaaaaggauuuuacccaucagacaucgcaguagaaugggaaucaaauggacaaccagaaaacaauuauaaaacaacuccuccuguauuagacucagacggaucuuuuuucuuauacucuaaacucaccguagauaaaucacguuggcaacaaggaaacguauucagcuguucaguuaugcaugaagcucuacauaaccacuacacacaaaagucacuaucacuauccccagguaaa

SEQ ID NO: 46719 - RNA, 639 nt, Artificial Sequence
  derived and/or modified sequence opt6 from Tigatuzumab_LightChain1
gauauacaaaugacacaaucacccucaucacuaucagcaucaguaggagacagaguaacaauaacauguaaagcaucacaagauguaggaaccgcaguagcaugguaccaacaaaaacccggaaaagcaccaaaacuacuaaucuacugggcaucaacaagacacacaggaguaccaucaagauucagcggaucaggaucaggaacagacuucacacuaacaauaucaucacuacaaccagaagacuucgcaacauauuacugccaacaauacucaagcuaccgaacauucggacaaggaacaaaaguagaaaucaaaagaacaguagcggcaccaucaguauucauauucccaccaucagacgaacaauuaaaaucaggaacagcaucaguaguaugccucuuaaacaacuucuaccccagagaagccaaaguacaauggaaaguagacaacgcacuacaaucaggaaacucacaagaaucaguaaccgaacaagacagcaaagacucaacauacucacuaucaucaacauuaacauuaaguaaagcagacuacgaaaaacacaaaguauacgcaugcgaagucacacaccaaggacuaagcucaccaguaacaaaaucauucaacagaggcgaaugc

SEQ ID NO: 46720 - RNA, 639 nt, Artificial Sequence
  derived and/or modified sequence opt6 from Tigatuzumab_LightChain
gacauacaaaugacacaaucaccaucaucccuaucagcaucuguaggagacagaguaacaauaacaugcaaagcaucacaagacguaggaacagcagucgcaugguaccaacaaaaaccaggcaaagcaccaaaauuacuaauauacugggcaucaacaagacacacaggaguaccaucaagauucucaggaucaggaucaggaaccgacuucacacuaacaauaucaucauuacaacccgaagauuucgcaacauacuacugccaacaauacucaucauacagaacauucggacaaggaacaaaaguagaaauaaaacgaacaguagcagcaccauccguauuuauauucccaccaucagacgaacaauuaaaaucaggcacagcaucaguaguaugccuacuaaacaacuucuacccaagagaagcaaaaguacaauggaaaguagacaacgcauuacaaucaggaaacucacaagaaucaguaacugaacaagacucaaaagacucaacauacucacuaucaucaacauuaacccuaucaaaagccgacuacgaaaaacauaaaguauacgcaugcgaaguaacacaccaaggacuaucaucaccaguaacaaaaagcuucaacagaggagaaugc

SEQ ID NO: 46721 - RNA, 1338 nt, Artificial Sequence
  derived and/or modified sequence opt6 from Tildrakizumab_HeavyChain1
caaguccaacugguacaaucaggagcagaaguaaaaaaacccggcgcaucagucaaaguaagcugcaaagcaucaggauacaucuuuauaacauauuggaugacuuggguaagacaagccccaggacaagggcuagaauggaugggccaaauauucccagccucaggaucagccgauuacaacgaaaaauuugaagguagaguaacaaugacaacagacacaucaacuuccacagcauauauggaacuaagaucacuaagaucugaugacacagcaguuuacuacugugcaagagggggaggcggauucgcauacuggggccaagguacucuaguuacagucuccucagccucaacaaaaggcccaucaguauucccauuagcaccaucauccaaaucaacaaguggaggaaccgcagcauuaggcugccuuguaaaagacuauuuuccagaaccaguaacagucucauggaacucaggagcauuaacuuccggcguacacacauucccugcuguacuacaaucauccggacuuuacucuuuauccucuguuguaacagucccuagcucaucauuaggaacacaaaccuauauuuguaaugucaaccauaaaccaucaaacaccaaaguagacaaaaaagucgaaccaaaaucaugcgauaaaacacacacaugcccacccuguccagcacccgaacuauuaggcggaccaucaguauuucuauuccccccaaaaccaaaagacacauuaaugauaucaagaacuccagaaguaacauguguaguagucgacguaucacaugaagauccagaaguaaaauucaacugguacgucgauggaguugaaguacauaacgcaaaaacaaaaccaagagaagaacaauauaacucaaccuacagagucguauccguccuaaccguauuacaucaagacugguuaaaugguaaggaauauaaaugcaaaguaucaaacaaagcacuaccagccccaauagaaaaaaccauaucaaaagcaaaaggacaaccaagagaaccacaaguauacacauuaccaccaagucgcgaugaauuaacuaaaaaucaagucucacuaacaugucuugucaaaggcuucuaucccucagacauugcaguagaaugggaauccaauggacaacccgaaaauaacuauaaaacaacaccacccguacuugauucagacgguucauucuuccuauacucuaaacucacaguagacaaaucacgcuggcaacaaggaaacguauuuucuuguucaguaaugcaugaagcacuccacaaccauuacacacaaaaaucauuaucauuaagcccaggaaaa

SEQ ID NO: 46722 - RNA, 642 nt, Artificial Sequence
  derived and/or modified sequence opt6 from Tildrakizumab_LightChain1
gacauacaaaugacacaaucaccaucaucacuaucagcaucaguaggagacagaguaacaauaacaugcagaacaucagaaaacauauacucauaccuagcaugguaccaacaaaaacccggaaaagcaccaaaacuacuaauauacaacgcaaaaacacuagcagaaggaguaccaagcagauucucaggaucaggcucaggaacagacuucacauuaaccauaucaucacuacaaccagaagacuucgcaacauacuacugccaacaccacuacggaauaccauucacauucggacaaggaacaaaagucgaaauaaaacgaacaguagcagcaccaagcguauucauauucccaccaucagacgaacaacuaaaaucaggaacagcaucaguaguaugccuacuaaacaauuucuacccaagagaagcaaaaguacaauggaaaguagacaacgcacuacaaucuggaaacucacaagaaucaguaacagaacaagacagcaaagacuccacauacucacuaucaucaacacuaacacuaucaaaagcagacuacgaaaaacauaaaguauacgcaugcgaaguaacccaccaaggacuaucaucaccaguaacaaaaagcuucaacagaggagaaugc

SEQ ID NO: 46723 - RNA, 1344 nt, Artificial Sequence
  derived and/or modified sequence opt6 from Tisotumab_vedotin_HeavyChain1
gaaguacaacuauuagaauccggaggaggacuaguucaaccaggaggcucacuacguuuaagcugugcagcaucaggauuuacauucagcaauuacgcuaugucauggguaagacaagcaccaggaaaaggacuagaauggguuucaaguaucucugguuccggcgauuacacauacuauaccgacaguguaaaaggaagauucacuaucucacgagauaauucaaaaaacaccuuauaucuccaaaugaacucauuaagagcagaagacacagcaguauacuacugugcacgaucaccuuggggauauuacuuagacucuuggggacaaggaacacuaguaaccguuagcagcgcuucuaccaagggaccaucaguauuuccacucgcuccuucaucuaaaucaacuucaggaggaacagcagcacuaggaugucuaguaaaagauuacuuuccagaaccaguaacaguaucauggaacucaggagcacuaaccucaggcguccauacauucccagcaguauuacaaucaucaggcuuauauuccuuaucaagugucguaaccguaccaucaucaucacuaggaacacaaaccuauauaugcaacguaaaucauaaaccaucuaauacaaaaguagacaaacgcgucgaaccaaaaucaugcgacaaaacccacacaugcccaccaugcccagcaccagaacuacuaggaggaccaucaguauuccuuuuuccaccaaaacccaaagacacauuaaugauaucccguacaccagagguaaccugcguuguaguagacguaagccacgaagacccagaaguaaaauuuaacugguauguagacggagucgaaguacacaacgcaaaaacaaaaccacgagaagaacaauacaacucuacauacagaguaguuuccguccuaacaguuuuacaccaagacuggcuaaacggaaaagaauauaaaugcaaaguaaguaacaaagcacuaccagccccaauagaaaaaacaauaagcaaagcuaaaggacaaccacgagaaccacaaguuuauacacuuccaccuucaagagaagaaaugacuaaaaaucaaguaucauuaaccugcuuaguaaaaggauuuuauccaucagacauagcuguagaaugggaaucuaacggacaaccagaaaacaacuauaaaacaacucccccuguacucgacucagauggaaguuucuuuuuauauuccaaacuuaccguagauaaaucaagauggcaacaaggaaacguuuucucaugcaguguaaugcaugaagcauuacacaaccacuacacacaaaaaucccuaucuuuaucaccaggaaaa

SEQ ID NO: 46724 - RNA, 642 nt, Artificial Sequence
  derived and/or modified sequence opt6 from Tisotumab_vedotin_LightChain1
gacauacaaaugacacaaucaccaccaucacuauccgccucagcuggagaccgaguaacaauaacaugccgagcaucacaaggaauaucaucaagacuagcaugguaccaacaaaaaccagaaaaagcaccaaaaucacuaaucuacgccgccucaucacuacaauccggaguaccaucaagauucucugguucaggaucaggaacagacuucacauuaacaauaucaucacuccaaccagaagacuucgcaacauauuacugccaacaauacaacucauacccauacacauucggacaaggaacaaaacucgaaaucaaacgaacaguagcagcaccaucaguauucaucuucccaccaucagaugaacaacuaaaaucaggaacagccuccguagucugccuacuaaacaacuucuaccccagagaagccaaaguacaauggaaaguagauaacgcacuccaaucaggaaacucacaagaaucaguaacagaacaagacucaaaagacucaacauacucacuauccucaacacuaacauuaucaaaagcagacuacgaaaaacacaaaguauaugcaugcgaaguaacacaccaaggauuaucaucacccguaacaaaaucauucaacagaggagaaugc

SEQ ID NO: 46725 - RNA, 1341 nt, Artificial Sequence
  derived and/or modified sequence opt6 from Tocilizumab_HeavyChain1
guccaauuacaagaaucagguccaggacucguaagaccaucacaaacauuaucauuaaccuguacaguaucaggauacucaauaacuucugaccacgccuggucauggguaagacagccacccggacguggccuagaauggauagguuauauaucauacucaggaauaaccacauacaacccaucauuaaaaucuagaguuacaaugcuacgagauacauccaaaaaucaauucucauuaagacuaucuucaguaaccgccgcagacaccgccgucuauuacugcgcacgaucgcuagcacgaacaacugcaauggacuacuggggucaaggaucacuaguuacagucuccucagcaucaacaaaaggaccaucaguauucccauuagcccccuccucaaaaucaaccucaggcggaaccgccgcauuaggauguuuaguaaaagacuauuuccccgaaccaguaacaguaucauggaacucuggagcauuaacaucuggcguucauacauuuccugcaguacuucaaucaucaggacuauacuccuuaucaucuguaguaacaguucccuccucaucacuaggaacacaaacauacaucuguaacguaaaccauaaaccaucuaauacaaaaguugacaaaaaaguagaaccaaaaucuugcgacaaaacacacaccuguccacccuguccagcaccagaauuacuaggaggacccucaguauuuuuauucccaccaaaaccaaaagauacacuaaugauaaguagaaccccagaaguaacaugcgucguagucgacguuucacaugaagacccugaaguaaaauucaacugguaugucgacggaguugaaguccacaacgcaaaaaccaaaccaagagaagaacaauacaauucaaccuaccgaguagucucuguacucacuguacuacaucaagauuggcuaaacggaaaagaauacaaaugcaaaguaagcaauaaagcacuaccugcaccaaucgaaaaaacuauauccaaagcaaaaggacaaccacgagaaccacaaguuuacacacucccaccuagcagagacgaacuaacaaaaaaucaaguaucacuuacuugccuaguaaaaggauucuacccuucagauauagcaguagaaugggaaucaaacggucaaccagaaaauaacuacaaaacaacaccaccaguccuagacucagacggaucuuuuuuccuauauucuaaacuuacugucgauaaaucaagauggcaacaagguaacgucuuuucaugcucaguuaugcacgaagcacuacacaaccacuacacacaaaaaagcuuaucacuaucaccagga

SEQ ID NO: 46726 - RNA, 642 nt, Artificial Sequence
  derived and/or modified sequence opt6 from Tocilizumab_LightChain1
gacauacaaaugacacaaucaccuucaucacuaucagcauccguaggagaccgaguaacaauaaccugccgagcaucccaagacauaucaucauacuuaaacugguaccaacaaaaaccaggaaaagcaccaaaacuacuaauauauuacacauccagacuccacucaggaguuccaucaagauucucaggaucaggaucaggaacagacuucacauucacaauaucaucacuacaaccagaagacauagcaacauacuacugccaacaaggaaauacacuaccauacacauucggacaaggaacaaaagucgaaauaaaaagaacaguagcagccccaucaguauucauauucccaccaucagacgaacaacuaaaaucaggaacagccucagucguaugccuacuaaacaacuucuacccuagagaagcaaaaguacaauggaaaguagacaacgcacuacaaucaggaaacucccaagaaucaguaacagaacaagacuccaaagacucaacauacucccuaucaucaacacuaacccuaucaaaagcagacuacgaaaaacacaaaguauacgcaugcgaaguaacacaccaaggacuaucaucaccaguaacaaaaucauucaaccgaggagaaugc

SEQ ID NO: 46727 - RNA, 1353 nt, Artificial Sequence
  derived and/or modified sequence opt6 from Tosatoxumab_HeavyChain1
gaaguacaaaugguacaaucaggagcagaagucaaaaaaccaggagaaccauuaaaaauaagcugcaaaggaucaggauacaaauuuggaacacacuggauagguuggguaagacaaagaccaggcaaaggacuagaauggaugggaauaauccacccagccgauagugaaaccaaauacucuccaucauuccaaggacaaguaucauuuucagcagauaaaucaucaaacacugccuaucuucauuggaguacacuuagagcaucagauacugcaauguauuacugcgcaagaagaucaggaucaucaagcugguaugcucuagacuucuggggacaggguacaaugguaacaguaaguucagcuucaaccaaaggaccaucaguauuuccccuagcuccaucaucuaagucuacaucaggaggaacagcagcauuaggaugcuuaguaaaagacuauuucccagaaccagucacaguaagcuggaauaguggagcuuuaacuucaggaguacauacauuuccagcuguauuacaaucaucuggacuauauucccuaucaucaguagucacaguaccuucauccucacugggcacacaaacauacauaugcaauguaaaccacaaacccucuaauacaaaagucgacaaacguguagaacccaaaucaugcgauaaaacacacacaugucccccaugcccagcaccugaacuccuaggaggaccaucaguuuuucuauucccaccuaaaccaaaagauacacuaaugauaucucgaaccccagaaguaacaugcguuguaguagacguaucacacgaagacccagaagucaaauucaacugguauguagacgguguagaaguccauaacgcaaaaacuaaaccaagagaagaacaauauaacaguacauacagaguaguuucaguuuuaacuguacuacaucaagacuggcuaaacggaaaagaauacaaauguaaaguuucaaauaaagccuuaccugcucccauagaaaaaacaauaaguaaagcaaaaggacaaccaagagaaccacaaguauauaccuugccaccuucacgagaagaaaugacaaaaaaucaagucagcuuaaccugcuuaguaaaaggauucuauccaucagacauagcaguagaaugggaaagcaacggucaaccagaaaauaacuauaaaacaacuccaccuguauuagacucagauggauccuucuucuuauacucaaaacuaaccguggauaaaucacgauggcaacaaggaaacguauucucauguucaguuaugcacgaagcacuacauaaccauuacacccaaaaaagcuuaucacuaucaccaggaaaa

SEQ ID NO: 46728 - RNA, 651 nt, Artificial Sequence
  derived and/or modified sequence opt6 from Tosatoxumab_LightChain1
caaucaguacuaacacaaucaccauccgcaucaggaacaccaggacaaagaguaacaauauccugcucaggaggaagcucaaacauaggaucaaacacaguaaacugguaccaacaauuuccaggagcagccccaaaacuacuaauauacacaaacaaccaaagaccauccggaguaccagacagauucucaggaucuaaaucaggaacaucagcaucacuagcaauaucaggacuacaaucagaagacgaagcagacuacuacugcgcaacaugggaugacucacuaaacggacuauacgucuucggaacaggaacaaaaguaacaguacuaggacaaccaaaagcaaacccaacaguaacccuauucccaccaucaucagaagaacuacaagcaaacaaagccacacuaguaugcuuaauaucagacuucuacccaggagcaguaacaguagcauggaaagccgacggaucaccaguaaaagcaggaguagaaacaacaaaaccauccaaacaaucaaacaauaaauacgcagcuucaucauacuuaucauuaaccccagaacaauggaaaucacaccgaucauacucaugccaagucacacacgaaggauccacagucgaaaaaacaguagcaccaacagaaugcuca

SEQ ID NO: 46729 - RNA, 1341 nt, Artificial Sequence
  derived and/or modified sequence opt6 from Tositumomab_HeavyChain
caagcauaccuacaacaaucaggugcugaauuaguaagaccaggcgcaucagucaaaaugucauguaaagcuucaggauauacauuuacuucuuacaacaugcauuggguaaaacaaaccccccgacaaggacucgaauggaucggagcaauauacccaggaaacggagacacaucauauaaccaaaaauucaaaggaaaagcaaccuuaacaguugacaaaucauccuccacagccuauaugcaauuaucaucacuaacaucagaagauucagccgucuauuuuugugccagaguaguauauuacuccaauucauauugguacuucgauguauggggcacaggaacaacaguaacagucucaggacccucaguauuuccacuagcaccuuccucuaaaucuacauccggaggcacagccgccuuaggaugcuuaguuaaagacuauuuucccgaacccguuacagucuccuggaacucaggagcacucacuaguggaguacauacauucccugcaguacuacaaucuuccggacuuuauucauuaucaucaguagucacaguaccaucuagcucccuaggaacccaaaccuacauaugcaacguaaaccacaaaccaucaaacacaaaaguagauaaaaaagcugaaccaaaaucaugcgauaaaacacacacuuguccaccaugccccgcacccgaauuacuaggaggaccaucaguauuuuuauuuccaccaaaaccaaaagacacacuaaugauauccagaaccccagaaguaaccugcguagucgucgauguaucccacgaagauccagaagucaaauucaacugguaugucgaugguguugaaguccacaaugcaaaaaccaaaccaagagaagaacaauacaacucaaccuaucgaguagucucuguauuaaccguucuacaccaagacuggcuuaacggcaaagaauacaaaugcaaaguaaguaacaaagcuuuaccagcaccaaucgaaaaaacaauuucaaaagcaaaaggacaaccaagagaaccacaaguauacacauuaccuccaucaagagacgaacuaacaaaaaaccaagucucauuaacaugucucguaaaaggcuucuacccaucagauauagcagucgaaugggaauccaacggacaaccagaaaauaacuacaaaaccacaccacccguauuagacucagacgguucauucuucuuauacucaaaauuaaccguagacaaaagcagauggcaacaaggaaacgucuucucaugcucaguuaugcacgaagcccuucacaaccacuacacacaaaaaucauuaucacuaucaccuggcaaa

SEQ ID NO: 46730 - RNA, 630 nt, Artificial Sequence
  derived and/or modified sequence opt6 from Tositumomab_LightChain
caaauaguacuaucacaaucaccagcaauacuaucagcaucaccuggcgaaaaaguaacaaugacaugcagagcaucuucaucaguaucauacaugcacugguaccaacaaaaaccuggaucuucaccaaaaccauggauauacgcaccauccaacuuagcaucaggaguaccagcaagauucucaggauccggaucaggaacaucauacucacuaacaauaucacgagucgaagcagaagacgcagcaacauacuacugccaacaaugguccuucaacccaccaacauucggagcaggaacaaaacuagaacuaaaacgaacaguagcagcaccaucaguauucauauucccaccaucagaugaacaacuaaaaucaggaaccgcaucaguaguaugccuacucaacaacuucuacccccgcgaagcaaaaguacaauggaaaguagacaacgcauuacaaucaggaaacucacaagaaucuguaacagaacaagacucaaaagacucaacauacucacuaucaucaacauuaacauuauccaaagcagacuaugaaaaacacaaaguauacgcaugcgaaguaacacaccaaggacuauccucacccguaacaaaaucauucaacaga

SEQ ID NO: 46731 - RNA, 1338 nt, Artificial Sequence
  derived and/or modified sequence opt6 from Tovetumab_HeavyChain1
caaguacaauuaguugaaucaggaggaggauuagucaaacccggaggaucuuuaagacuaucuugugcagcuucuggguuuacauucucagauuauuacaugaauuggauaagacaagcaccaggcaaagguuuagaauggguaucauacauuucaaguucaggaucuauuaucuauuacgcagacucugucaaaggcagauucacaauaucaagagauaaugcaaaaaauuccuuauacuuacaaaugaacucacuaagagcugaagauacagcaguuuauuauugcgcaagagaaggaagaauugcagcacgaggaauggacguauggggacaaggaacaacuguaacuguauccucagccagcacaaaaggacccucaguauuuccauuagcacccugcucaagaucuacaagugaaucaacugcagcauuaggcugccuaguaaaagacuacuucccagaaccaguaaccgucaguuggaacucaggagcauuaacaucagguguacauacuuucccugcaguacuacaaagcucagguuuauauucauuaucaucaguagucacaguaccauccucaaauuucgggacccaaaccuauacauguaauguugaccauaaaccauccaauacuaaagucgauaaaacaguugaaagaaaauguuguguagaaugcccuccaugucccgcacccccaguugcaggcccaucaguauuuuuguucccaccaaaaccaaaagacacuuuaaugauaucaagaacaccagaaguaacauguguaguaguagacgugucucacgaagacccagaaguucaauuuaauugguacguagauggaguagaaguucauaacgccaaaacaaaaccaagagaagaacaauuuaauucaacauucagaguaguaucuguccuuacugugguacaucaagacugguuaaauggaaaagaauacaaaugcaaaguaucaaauaaaggauuaccagccccaauugaaaaaaccauaucaaaaacuaaaggucaaccacgagaaccucaaguauacacacuaccaccaucucgcgaagaaaugacaaaaaaucaagucucacucacuugcuuaguuaaaggcuuuuauccaucagacauugcaguagaaugggaaagcaacggacaacccgaaaauaauuauaaaaccacuccaccaaugcuagauucagacggaaguuuuuucuuauacagcaaacuaacuguagacaaaucaagauggcaacaaggaaacguuuuuucuugcucagucaugcacgaagcauuacacaaucauuauacacaaaaaaguuuaucauuaucaccaggaaaa

SEQ ID NO: 46732 - RNA, 645 nt, Artificial Sequence
  derived and/or modified sequence opt6 from Tovetumab_LightChain1
gacauccaaaugacacaaucaccaucaucacuuucagcaucaguaggagacagaguauccaucacaugcagacccucacaaucauucucaagauacauaaacugguaccaacaaaaacccggaaaagcaccaaaacuacuaauacaugcagcaucaucacuaguaggcggaguaccaucaagauucucaggaucaggaucaggaacagacuucacacuaacaauaucaucccuccaaccagaagacuucgcaacauacuacugccaacaaacauacucaaaccccccaauaacauucggacaaggaacaagacuagaaaugaaaagaacaguagccgcaccaucagucuucauauucccaccaucagacgaacaacuaaaaucagguacagcaucaguaguaugccuauuaaauaacuucuacccaagagaagcaaaaguccaauggaaaguagacaacgcauuacaaucaggcaacucacaagaaucaguaacagaacaagacucaaaagacuccacauacucacuaucaucaacacuaacacuaucaaaagcagacuaugaaaaacacaaaguauacgcaugcgaaguaacacaucaaggacuauccucaccaguaacaaaauccuucaaccgaggagaaugc

SEQ ID NO: 46733 - RNA, 1347 nt, Artificial Sequence
  derived and/or modified sequence opt6 from Tralokinumab_HeavyChain1
caaguacaauuaguucaaucuggcgcugaaguaaaaaaaccaggugcaucaguuaaagucuccuguaaagccucaggauauacauucacaaauuacggccuaucauggguaagacaagcaccaggacaaggacuagaauggauggguuggauaucagcaaacaauggcgacacaaauuauggacaagaauuucaaggaagagucaccaugacuacagacacaucaacaucaacagcauacauggaauuaagaucauuaaggucagaugacacugcaguuuacuacugcgcaagagauuccucuucauccugggcaagaugguucuucgacuuauggggaagaggaacauuaguaacaguaucaucagcauccacuaaaggaccaucaguuuuuccacuugcuccuugcucaagaucaacaagcgaaucuacagcugcuuuagguuguuuaguaaaagauuauuuucccgaaccagucaccguauccuggaacucuggagcacucacaagcggaguucauaccuuuccagcuguucuacaaagcuccggucuauauucacucucaucuguaguaacaguucccucaucaucucuaggcacaaaaaccuauacauguaacguagaccauaaaccaucuaauacaaaaguagauaaacguguagaaucaaaauacggaccacccugcccauccuguccagcaccagaauuucuaggaggacccagcguauuuuuauuuccaccaaaaccaaaagacacuuugaugaucucaagaacaccugaaguaacuugugucguagucgauguaucacaggaagacccagaaguacaauucaacugguacguugauggaguagaaguacauaaugcaaaaacgaaaccaagagaagaacaauuuaauucuacauacagaguaguaucaguacuaacaguauuacaucaagacugguuaaauggaaaagaauauaaauguaaaguauccaauaaaggacuucccucaucuauagaaaaaaccauuucaaaagccaaaggccaaccaagagaaccccaaguauauacuuuaccaccaucacaagaagaaaugacaaaaaaucaaguaucauuaacaugcuuaguaaaaggauuuuauccaucagacauagcaguagaaugggaaucaaacggccaaccagaaaauaauuacaaaacuacaccaccaguacuagauucagauggauccuucuuuuuauauucaagacuaacaguagauaaaucaagauggcaagaaggaaacguauuuuccuguagcguaaugcaugaagccuuacauaaccauuacacacaaaaaucacuaucauuauccuuaggcaaa

SEQ ID NO: 46734 - RNA, 642 nt, Artificial Sequence
  derived and/or modified sequence opt6 from Tralokinumab_LightChain1
ucauacguauuaacucaaccaccaagcguauccguagcaccaggaaaaacagcaagaauaacaugcgguggaaauauaauaggaucaaaacucguacacugguaccaacaaaaaccaggacaagcaccaguauuaguaauauacgacgacggcgacagaccaagcggaauaccagaaagauucucaggaucaaacagcggaaacaccgcaaccuuaacaauaucaagagucgaagcaggagacgaagcagacuacuauugccaaguaugggacacagguucagacccaguaguauucggaggaggaacaaaauuaacaguacuaggacaaccaaaagcagcaccaucaguaacacuauucccaccaucaucagaagaacuacaagcaaacaaagcaacacuagucugccuaauaucagacuucuacccaggagccguaaccguagcauggaaagcagacucaagcccaguaaaagcaggaguagaaacaacaacaccaaguaaacaaucaaauaacaaauacgcagcaucaucauaccuaucauuaacaccagaacaauggaaaucccacagaucauacucaugccaaguaacacacgaaggcucaacagucgaaaaaacaguagcaccaacagaaugcuca

SEQ ID NO: 46735 - RNA, 1332 nt, Artificial Sequence
  derived and/or modified sequence opt6 from Trastuzuab_HeavyChain1
gaaguucaauuagucgaaucaggaggaggcuuaguacaacccggaggaucucuaagacuaucaugcgccgcaucaggauucaauauaaaagauacauacauucacuggguaagacaagcaccaggaaaaggacuagaauggguagccagaauuuaucccaccaacggauacacuagauacgccgacuccguaaaaggaagauucacuauaucagcagauacaucaaaaaacacagcauacuuacaaaacucacuaagagcagaagauacagcaguauacuauuguagccgcugggguggagacggcuucuacgccgacuacuggggccaaggaacucucguaacuguaucaagcgcaucuacaaaagguccaucaguuuuuccacuagcaccaaguuccaaauccacaucuggagguacagcagcacuaggcugcuuaguaaaagacuauuuuccagaaccuguaacaguaucuuggaauuccggcgcacuaacuucuggaguacacacauuuccagcaguacuacaaucauccggucuauauucauuauccucuguaguaacaguacccucuucaucacuaggaacacaaaccuauaucugcaacguaaaucauaaaccaucaaacacaaaaguagacaagaaaguagaacccaaaucaugugauaaaacccauacaugcccaccauguccagcucccgaauuacuaggaggcccaaguguauuccuauucccaccaaaacccaaagacacucuaauaucacgcacaccagaaguaacaugcguaguagucgacguaucucacgaagacccagaaguaaaauucaauugguauguagacggcgucgaaguucauaaugcaaaaacaaaaccaagagaagaacaauacaauucuacuuacagaguagucucaguauuaacaguacuucaucaagacugguuaaauggaaaagaauacaaaugcaaaguaucaaauaaagcauuaccagcaccaaucgaaaaaacaauaucaaaagcaaaaggacaaccuagagaaccgcaaguauauacacuaccaccaucaagagaagaaacaaaaaaucaagucucucuaacuugcuuaguaaaagguuucuauccuucagacauagcaguagaaugggaaaguaauggacaaccagaaaacaauuauaaaacaacaccaccaguauuagauucagacggauccuucuuccuauacucuaaauuaacugucgacaaaucaagauggcaacaaggaaacguauucuccuguucuguucacgaagcacuacacaaccauuauacucaaaaaucccuaucccuaucaccagga

SEQ ID NO: 46736 - RNA, 639 nt, Artificial Sequence
  derived and/or modified sequence opt6 from Trastuzuab_LightChain1
gacauacaaacacaaucccccucaucauuaucagcauccguaggagauagaguaacaauaaccugcagagcaucacaagacguaaacacagcaguagcaugguaccaacaaaaaccaggaaaagcaccaaaacuacuaaucuacucagcauccuuccuauacucaggaguaccauccagauucucaggaucacgaucaggaacagacuucacauuaaccauaucaucauuacaaccagaagacuucgccacauacuacugccaacaacacuacacaaccccacccacauucggacaaggaacuaaaguagaaauaaaaagaacaguagcagcaccaucaguauucaucuuccccccaucagacgaacaauuaaaaucaggcacagcaucaguaguaugccuacuaaacaacuucuacccaagagaagccaaaguccaauggaaaguagacaacgcacuacaaucaggaaacucacaagaaucaguaacagaacaagacuccaaagacucaacauauuccuuaucaucaacacuaacacuaucaaaagcagacuacgaaaaacacaaaguauaugcaugcgaagucacacaccaaggacuaucuucacccguaacaaaaucuuucaacagaggagaaugc

SEQ ID NO: 46737 - RNA, 1347 nt, Artificial Sequence
  derived and/or modified sequence opt6 from Trastuzumab_emtansine_HeavyChain1
gaaguucaacuaguagaaucaggaggaggacuaguacaaccaggcggaucauuacgccuaucaugugcagccuccggauucaacauaaaagacacauacauccacuggguaagacaagcaccaggaaaaggccuagaauggguagcaagaauauaucccacaaauggauacacacgcuaugccgacucaguaaaagguagauucacuauaagcgccgauacauccaaaaauacagcauaucuccaaaugaacucuuuaagagccgaagauacugcaguuuacuacugcucacgauggggaggcgauggcuuuuacgcaauggacuacuggggacaaggaacccuuguaaccguuaguucugcauccacaaaaggcccaucaguauucccauuagcaccauccucaaaaucaaccucaggcgguacagcagcccuaggaugucucgucaaagauuacuuuccagaaccagucacagucuccuggaauucuggugcccuaacauccggaguucacacauucccagcaguauuacaaucaucaggacuauauucacuaucaucuguaguaacaguaccaucuucaucauuaggaacacaaacauauauaugcaaugucaaccauaaacccucuaauaccaaaguagauaaaaaagucgaacccaaaucaugcgacaaaacccacacaugcccaccauguccagccccagaacuacuugguggaccaucagucuuccuauuuccaccaaaaccaaaagacacacuaaugauuucaagaacaccagaaguaacauguguaguaguagacguaucacaugaagacccugaaguaaaauucaacugguacguagauggagucgaaguucacaacgcaaaaacuaaaccaagagaagaacaauacaacaguacauaccgaguaguaucaguauuaacagucuuacaccaagauuggcuaaacgguaaagaauacaaaugcaaaguuuccaacaaagcacuaccagcaccaauagaaaaaacgauaucuaaagcaaaaggacaaccaagagaaccacaaguauacacacuaccaccuucaagagaagaaaugacaaaaaaucaaguauccuuaacuugcuuaguaaaaggauucuauccuucagacauagcaguagaaugggaaucuaacggacaaccagaaaacaacuauaaaacaacaccaccaguacuagacucagacggaucauuuuucuuauacucaaaauuaacagucgauaaaucaagauggcaacaaggcaauguauucucaugcucaguaaugcacgaagcauuacacaaccacuacacacaaaaaucauuaagccuaagccccgga

SEQ ID NO: 46738 - RNA, 642 nt, Artificial Sequence
  derived and/or modified sequence opt6 from Trastuzumab_emtansine_LightChain1
gacauacaaaugacacaaucaccaucaagcuuaucagcaucaguaggagacagaguaaccauaacauguagagcaagccaagacguaaacacagcaguagccugguaccaacaaaaaccaggaaaagcaccaaaacuacuaauauacuccgccuccuuccuauacucuggaguaccaucaagauucucaggaucaagauccggcacagacuucacacuaacaauaucaucacuacaaccagaagauuuugcaacauacuauugccaacaacacuacacaacaccaccaacauucggacaaggaacaaaagucgaaauaaaaagaacaguagcagcaccaucaguauucauauucccaccaucagacgaacaacuaaaaucuggaacagcaucaguaguaugccuacuaaauaacuucuacccaagagaagccaaaguccaauggaaaguagacaaugcacuacaaucaggaaacucacaagaaucaguaacagaacaagacucaaaagacucaacauauucacuaucaucaacacuaacccuaucaaaagcagauuacgaaaaacacaaaguauacgcaugcgaaguaacccaccaaggccuaucaucaccaguaacaaaaucauucaaccgaggcgaaugc

SEQ ID NO: 46739 - RNA, 1347 nt, Artificial Sequence
  derived and/or modified sequence opt6 from Trastuzumab_HeavyChain1
gaaguacaacuaguagaaaguggcggaggacuaguacaaccaggagguaguuuaagacugucaugcgcagcauccgguuuuaauaucaaagacaccuacauacacuggguaagacaagcuccagguaaaggauuagaauggguugcccgaauauacccaacaaacggauauacaagauaugcagauaguguaaaagguagauucacaauaucagcagacacuagcaaaaauacagcauaccuacaaaugaauucauuacgagcagaagauacagcaguauacuauuguagucgauggggaggugacggauucuaugcaauggauuacuggggacaaggaacacuaguaaccguaucaucagcaucaacaaaaggcccaaguguauucccacuagcaccauccagcaaaagcacuagcggaggcacagcagcacuuggaugcuuaguaaaagacuacuucccagaaccaguaacaguuuccuggaauaguggagcauuaaccucuggaguucauacauucccagcaguacuucaaucauccggacuauacucauuaucuaguguaguuacaguaccuucuagcucauugggcacacaaacuuacauaugcaaugucaaucacaaacccucaaauacaaaaguagacaaaaaaguugaaccaaaaucaugcgauaaaacacacacauguccaccaugcccugcaccagaacuuuuaggaggaccaucaguauuucuauuuccaccuaaaccaaaagauacuuuaaugauauccaggacucccgaaguaacaugcguaguaguagacguuucacaugaagauccagaaguaaaauuuaacugguacguagacggaguagaaguacacaacgcaaaaacaaaaccaagagaagaacaauauaauucaacauaccguguuguaagcgugcuaacaguauuacaccaagacugguuaaacgguaaagaauacaaauguaaaguaucaaauaaagcacuaccagcaccaauugaaaaaacaauauccaaagcaaaaggacaaccaagagaaccacaaguauauacacuaccaccaucacgagaagaaaugacuaaaaaucaaguuucauuaacaugucuaguaaaaggauuuuauccaucugacauagccguugaaugggaaucgaacggccaaccagaaaauaacuauaaaacuacaccuccaguauuagauucagacggcucauuuuuuuuauauucaaaauuaacaguagauaaauccagauggcaacaaggaaaugucuuuagcuguaguguaaugcaugaagcacuacauaaucauuacacacaaaaaucgcuaagcuuaaguccagga

SEQ ID NO: 46740 - RNA, 1353 nt, Artificial Sequence
  derived and/or modified sequence opt6 from Trastuzumab_HeavyChain
gaaguacaacuaguagaaucaggagguggacuaguacaaccuggaggaucacuaagacuaucaugcgcagccucaggcuuuaacauaaaagauacauacauacacuggguccgacaagcaccuggaaaaggauuagaauggguagccagaauauauccaaccaauggauauacuagauaugcugacagcguaaaagguagauuuacaauaucugcagacacuaguaaaaacaccgcauaccuucaaaugaauagccuaagagcagaagauacagccguauacuacugcucaagauggggaggagacggauucuaugcaauggacuacuggggacaaggaacacuuguaacaguaucuuccgcaucaacuaaagguccaaguguauuuccacuugcaccuucauccaaaucaacaucaggaggcacagcagcacucggaugucuaguaaaagauuauuuuccagaaccaguaacaguauccuggaauucaggagcacuaaccucagguguccauacauuucccgccguccuacaaucauccggucuauacucacuaucaucaguuguaacaguuccauccucaucacuagguacacaaacauauauuugcaacguuaaccauaaaccaucuaauaccaaaguagauaaaaaaguagaaccaccuaaaucaugugauaaaacacacacauguccucccuguccagcuccagaauuauuaggaggaccaucugucuucuuauuuccaccaaaaccaaaagauacauuaaugaucucacgaacacccgaaguaacuuguguaguaguagauguaucacaugaagacccagaaguaaaauuuaacugguacguugaugguguagaaguacacaaugccaaaacuaaaccacgagaagaacaauauaacuccaccuacagaguaguaucaguacuaacaguauuacaccaagauugguuaaacggaaaagaauauaaauguaaaguuucuaauaaagcccuaccagcaccaauagaaaaaacaauaucaaaggcaaagggacaaccuagagaaccccaaguauauacacuaccaccaucaagagaugaacuaacaaaaaaucaaguaucauuaacaugucuaguaaaaggguuuuauccauccgacauagccguugaaugggaaucuaacggucaacccgaaaauaacuauaaaacaacccccccagucuuagauucugauggaucuuuuuuucucuauucaaaacuaacaguagauaaaaguagauggcaacaaggaaauguauuuucaugcucaguaaugcaugaagcuuuacauaaccacuacacacaaaaaucacuaucauugucaccuggaaaa

SEQ ID NO: 46741 - RNA, 660 nt, Artificial Sequence
  derived and/or modified sequence opt6 from Trastuzumab_HeavyChain_variant_1n8z_B
gaaguacaacuaguagaaucaggaggaggacuaguacaaccaggaggaucauuaagacuauccugcgcagcaucaggauuuaacauaaaagauacauauauacauuggguuagacaagccccuggaaaaggauuagaauggguagcaagaauauacccaacaaauggcuauacaagauacgcugacaguguaaaaggaagauucacaauaucagcagacacaucaaaaaauacagccuacuuacaaaugaacagucuaagagcagaagacacagcaguauacuauugcucacgauggggaggagauggauucuaugcaauggacuauuggggacaaggaacauuaguaacaguaaguagugcaaguacuaaaggaccaucaguauucccauuagcaccuucaucaaaaucaacaucaggaggaacagcagcuuuaggaugucuaguaaaagauuauuuuccagaaccaguaacaguaucauggaacucaggagcauuaacaucuggaguacauacuuuuccagcaguauuacaaucaaguggauuauauucauuaucaucaguaguaacaguaccaucaucaucacuagguacacaaacauauauauguaacguuaaccauaaaccaucaaauacaaaaguagauaaaaaaguagaacca

SEQ ID NO: 46742 - RNA, 45 nt, Artificial Sequence
  derived and/or modified sequence opt6 from Trastuzumab_HeavyChain_variant_7637_H
gaaccaaaaucaugcgacaaaacacacacaugcccaccaugccca

SEQ ID NO: 46743 - RNA, 642 nt, Artificial Sequence
  derived and/or modified sequence opt6 from Trastuzumab_LightChain1
gacauacaaaugacacaaucaccaucaucacuaucagcaucaguaggagacagaguaaccauaacaugcagagcaagccaagacguaaacacagcaguagcaugguaccaacaaaaacccggaaaagcacccaaacuacuaauauacucagcaucauuccuauacucaggaguaccauccagauuuucaggaucaagaucaggcaccgacuucacucuaaccauaucaucacuacaaccagaagacuucgcaacauacuacugccaacaacacuacacaacaccaccaacauucggacaaggaacaaaaguagaaauaaaaagaacaguagcagcaccaucaguauucauauuccccccaucagacgaacaacuaaaaucaggaacagccucaguaguaugccuacuaaacaacuucuacccacgagaagcaaaaguacaauggaaagucgacaacgcacuccaaucaggaaacucacaagaauccguaacagaacaagacucaaaagacuccacauacucauuaucaucaacccuaacacuaucaaaagcagacuacgaaaaacacaaaguauacgcaugcgaaguaacacaucaaggacuaucaucaccaguaaccaaaucauucaacagaggagaaugc

SEQ ID NO: 46744 - RNA, 642 nt, Artificial Sequence
  derived and/or modified sequence opt6 from Trastuzumab_LightChain_variant_1n8z_A
gacauacaaaugacacaaucaccaucaucauuaucagcaucaguaggagacagaguaacaauaacaugcagagcaucacaagacguaaauaccgcaguagccugguaccaacaaaaaccaggaaaagcacccaaacuacuaauauacucagcauccuuccuauacucaggagucccauccagauucucaggaucaagaucaggaaccgacuucacauuaacaauaucaucacuccaaccagaagacuucgcaacauacuacugccaacaacacuacacaacaccaccaacauucggacaaggaacaaaaguagaaauaaaaagaacaguagcagcaccaagcguauucauauucccaccaucagacgaacaauuaaaaucaggaacagccucagucguaugccuacuaaacaacuucuacccaagagaagcaaaaguccaauggaaaguagacaacgcacuacaaucaggaaacucacaagaaucaguaaccgaacaagacagcaaagacucaacauacucauuaucaucaacauuaaccuuaucaaaagcagacuacgaaaaacacaaaguauacgcaugcgaaguaacacaccaaggacuaucuucacccguaacaaaauccuuuaacagaggagaaugc

SEQ ID NO: 46745 - RNA, 642 nt, Artificial Sequence
  derived and/or modified sequence opt6 from Trastuzumab_LightChain_variant_7637_L
gacauacaaaugacacaaucaccaucaucccuaucagcauccguaggagauagaguaaccauaacaugccgagcaucacaagacguaaacacagcaguagccugguaccaacaaaaaccaggaaaagcacccaaacuacuaauauauagugcaucauuccucuacucaggaguaccaucccgauucucaggaucaagaucaggcacagacuucacauuaacaauaucaucuuuacaaccagaagacuucgcaacauacuacugccaacaacacuacacuacuccaccaacauucggacaaggaaccaaaguagaaauaaaaagaacagucgcagccccaucaguauucauauucccacccucagacgaacaacuaaaaucagguacagccucagucguaugccuacucaacaacuucuaccccagagaagcaaaaguacaauggaaaguagacaacgcacuacaauccggaaacucacaagaaucaguaacagaacaagauucaaaagacucaacauacucacuaucaucaacauuaaccuuauccaaagccgacuacgaaaaacacaaaguauacgcaugcgaaguaacccaccaaggauuaucaucaccaguaacaaaaagcuucaacagaggagaaugc

SEQ ID NO: 46746 - RNA, 1344 nt, Artificial Sequence
  derived and/or modified sequence opt6 from TRC-105_HeavyChain1
gaaguaaaacuugaagaaucaggaggcggauuaguccaacccggagguucaaugaaauuaaguugcgcagcauccggcuucacauucuccgacgccuggauggauuggguaagacaaucaccugaaaaaggauuagaaugggucgcagaaauaagaucaaaagccucaaaccaugcaacauauuacgcagaaucaguaaaaggcagauuuacaauaucuagagacgacucaaaauccucagucuauuuacaaaugaauuccuuaagagccgaagauacaggaauauauuacugcacacgcuggcgacgauuuuucgacuccuggggacaaggaacaacacuaacaguaucaucagcaucaacaaaaggaccaucaguauucccacuagcuccaucauccaaaucuacaucaggaggaacugcagcacuuggaugcuuggucaaagacuauuuuccagaaccaguaacuguaucauggaacucaggcgcacuaacuucaggaguccacacauuccccgccguacuacaaucaaguggucuauauucccuaucaucaguagucacaguacccuccucaucauuaggaacacaaaccuacauauguaauguaaaccacaaaccaaguaacaccaaaguagauaaaaaaguagaaccgaaaucuugcgacaaaacacauacauguccacccuguccagcaccagaauuacucggaggaccaucaguauuccuauucccaccaaaaccaaaagauacauugaugauuucaagaacaccagaaguaacaugcguugucguagacguaucacacgaagacccagaaguuaaauuuaauugguacguagacggcguugaaguacacaacgcuaaaacaaaaccaagagaagaacaauacaauucaacuuauagaguuguauccguuuuaacaguucuccaccaagauuggcuaaacggaaaagaauacaaaugcaaagucucaaacaaagcccuacccgccccuauagaaaagacuauaucaaaagcaaaaggacaacccagagaaccucaaguauacacauuaccaccaucaagagacgaacuuaccaaaaaucaaguaucacuaacaugcuuaguaaaaggcuucuacccaucugacauagcaguagaaugggaaucuaacggacaaccagaaaauaacuacaaaacaacaccaccuguuuuagacucagacggaucauucuuucuauauucuaaacuaacaguagacaaaagcagauggcaacaaggaaacguauucucaugcucaguaaugcaugaagcacuacauaaccacuacacacaaaaaucacucucacuuucaccuggaaaa

SEQ ID NO: 46747 - RNA, 639 nt, Artificial Sequence
  derived and/or modified sequence opt6 from TRC-105_LightChain1
caaauaguacuaucacaauccccagcaauauuaucagcaucaccaggagaaaaaguaacaaugacaugcagagcaucaucaucaguaucauacaugcacugguaccaacaaaaaccaggaucaucaccaaaaccauggauauacgcaacauccaaccuagcaucuggaguaccaguaagauuuagcggaucaggaucaggaacaucauacucacuaacaauaucaagaguagaagcagaagacgcagcaacauacuacugccaacaauggaguagcaacccauuaacauucggagcaggaacaaaacuagaauuaaaaagaacaguagcagcaccaucaguauucauauucccaccaagcgacgaacaacuaaaaucaggaacagcaucaguaguaugccuauuaaacaacuuuuacccaagagaagcaaaaguacaauggaaaguagacaacgcacuacaaucaggaaacucacaagaaucaguaacagaacaagacucaaaagacucaaccuacucacuauccucaacacuaacacuaucaaaagcagacuaugaaaaacacaaaguauacgcaugcgaaguuacacaccaaggauuaaguucaccaguaacaaaaucauucaacagaggagaaugc

SEQ ID NO: 46748 - RNA, 1362 nt, Artificial Sequence
  derived and/or modified sequence opt6 from Tregalizumab_HeavyChain1
gaagaacaauuaguagaaagcggaggaggauuaguaaaaccaggaggaucacuuagacuaagcugugccgcaucuggauuuuccuucucagacuguagaauguacuggcuaagacaggcaccaggaaaaggccuagaauggauaggcguaauauccgucaaaucagaaaacuacggugcuaacuaugcagaaagcguaagaggaagauuuaccauaucaagagaugauagcaaaaacacaguauaccuacaaaugaacagcuuaaaaacagaagauacagcaguuuacuacuguucagcaucauauuacagauacgauguuggagccugguucgcauauuggggccaaggcacauuaguaacagucucaucagcaucaacaaaaggaccaagcguuuucccacuugccccuagcaguaaaucaacaucaggagguaccgcagcacuaggaugcuuagucaaggacuacuuuccagaaccaguaacuguaucuuggaauucaggugcacuaacaucaggaguacacacuuucccagccguacuacaaaguucaggauuauacaguuuaucaucuguaguaacaguuccuucaucaucucuagguacucaaacauauauauguaauguaaaucacaaaccaucaaacacaaaaguugacaaaaaaguagaaccuaaauccugcgauaaaacacauacauguccuccaugcccugcaccagaauuacuuggcggcccaucagucuuuuuauucccaccaaaaccaaaagauacauuaaugaucagcagaaccccagaagucacauguguaguuguagacguaucacaugaagacccugaaguuaaauucaacugguauguugacggaguagaaguacauaacgcaaaaacaaaacccagagaagaacaauauaacucaacuuaucgcguaguaucaguccuaacaguauuacaucaagacuggcuaaauggaaaagaauacaaaugcaaaguaucaaauaaagcauuaccagcccccauagaaaaaacaauaucaaaagcaaaaggucaaccaagagaaccacaaguauauacccuacccccaucacgagaugaauuaacaaaaaaucaaguaucauuaaccugccuaguuaaaggauucuaccccuccgacauagccguagaaugggaaucaaacggacaaccagaaaacaauuauaaaacaacaccaccaguauuagacucagauggaucauuuuuuuuauacucaaaacuaacaguagauaaaaguagauggcaacagggcaaugucuucucauguucaguuaugcacgaagcacuucauaaucacuauacccaaaaaucauuaaguuuaucaccaggcaaa

SEQ ID NO: 46749 - RNA, 654 nt, Artificial Sequence
  derived and/or modified sequence opt6 from Tregalizumab_LightChain1
gacauaguaaugacacaaucaccagacucauuagccguaaguuuaggagaaagagcaacaauaaacuguagagcaagcaaaagcguaaguacaagcggauacucauacauauacugguaccaacaaaaaccaggacaaccaccaaaacuacuaauauaucucgcaucaauacuagaaaguggaguaccagauagauucucaggaucagguucaggaacagacuuuaccuuaacaauaaguucacuacaagcagaagacguagcaguauacuacugccaacacucaagagaacuaccauggacauucggacaaggaacaaaaguagaaaucaaaagaacaguagcagcaccaagcguauucauauucccaccuucagacgaacaauuaaaaucaggaacagcaucaguaguaugcuuacuaaauaacuuuuacccgagagaagcaaaaguacaauggaaaguagauaacgcacuacaaagcggaaauucacaagaaaguguaacagaacaagacagcaaagacucaacauauucauuaaguucaacuuuaaccuuaagcaaagcagauuacgaaaaacauaaaguauacgcaugcgaaguaacacaccaaggcuuaagcucacccguaacaaaaucauuuaacagaggagaaugc

SEQ ID NO: 46750 - RNA, 1353 nt, Artificial Sequence
  derived and/or modified sequence opt6 from Tremelimumab_HeavyChain1
caagugcaauuaguagaaagcggagguggaguaguccaaccagguagaagcuuaagauuaucaugugcagcaucaggauuuacuuuuucaucauauggcaugcauuggguacgacaagcaccaggaaaagguuuagaauggguagcaguaauaugguacgacggcucaaauaaauauuaugccgauucaguaaaaggaagauuuacaauaagucgugauaacucaaaaaacacacuauaucuacaaaugaauucacuaagagcugaagacacagcaguuuauuacugugcacgagacccacguggagcaacauuauauuacuacuauuacggaauggacguauggggacaaggaacaacaguaacaguaucaagugcaucaaccaaaggcccaucaguauucccccuagccccaugcucucgaucaacuucugaaucaacagcagcauuaggaugccuaguaaaagauuacuuuccagaacccguaacuguuucauggaacaguggagcacuuacaucaggaguacauacuuuuccagcagucuuacaaucuagcgguuuauauagucuaucuucugucguaacaguaccuaguucaaacuuuggaacacaaacauacacuuguaacguagaccauaaaccaucaaacaccaaaguagauaaaacaguagaaagaaaauguugcgucgaaugcccaccaugcccugcaccaccuguagcaggcccaucaguauucuuauucccuccaaagccaaaagacacauuaaugauaucaagaacuccagaaguaacauguguaguaguagaugucucacacgaagaucccgaaguucaauucaauugguauguugauggaguagaaguacauaaugccaaaaccaaaccaagagaagaacaauuuaacucaaccuuucgaguagucuccguacuaacaguaguacaucaagauugguuaaauggaaaagaauacaaauguaaaguaucaaacaaaggacuaccagcacccaucgaaaaaacuauauccaaaacaaaaggucaaccuagagaaccacaaguauauacccuuccaccaucaagagaagaaaugacaaaaaaucaagucucacuaacaugcuuaguaaaaggauuuuacccaucagacauagcaguugaaugggaaucaaauggacaacccgagaacaauuauaaaacaacaccaccaauguuagacagugaugguagcuuuuuuuuauacucaaaauuaaccguagacaaaaguagauggcaacaaggaaacguauucaguugcucaguaaugcaugaggcauuacacaaucacuauacacaaaaaucacucucuuuaucuccaggaaaa

SEQ ID NO: 46751 - RNA, 642 nt, Artificial Sequence
  derived and/or modified sequence opt6 from Tremelimumab_LightChain1
gacauacaaaugacacaaucaccaucaucuuuaucagcaucaguaggagacagaguaaccauaacaugcagagcaucucaaucaauaaauuccuaccuagacugguaccaacaaaaacccggaaaagcaccaaaacucuuaauauacgcagcaucaucacuccaaucaggaguaccaucaagauucucaggaucaggauccggaacagacuucacauuaaccauauccucacuccaaccagaagacuucgcaacauacuacugccaacaauacuacucaacuccauucacauucggaccaggaacaaaaguagaaauaaaaagaacaguagcagcaccauccguauucauauuuccacccucagacgaacaacuaaaaucaggaacagccucaguaguaugcuuacucaacaacuucuacccacgagaagcaaaaguacaauggaaaguagacaacgcacuccaauccggaaacucacaagaaucaguaacagaacaagauuccaaagacucaacauacucacuaucaucaacacuaacacuaucaaaagcagacuacgaaaaacacaaaguauacgcaugcgaaguaacacaccaaggacuaucaucaccaguaaccaaaucauucaacagaggagaaugc

SEQ ID NO: 46752 - RNA, 1341 nt, Artificial Sequence
  derived and/or modified sequence opt6 from Trevogrumab_HeavyChain1
gaaguacaaguauuagaaucaggaggugauuuaguacaaccuggagguucacuacgacuaucaugugcugcauccgguuucacauuuagugcauacgccaugaccuggguaagacaagcuccuggaaaaggacuagaaugggucuccgcuauaucaggaucaggaggaagcgcauauuacgcagauucaguaaaaggaagauucacuauaucuagagauaacaguaaaaauacaguauaccuacaaaugaacucacuacgugcagaagauacggcaguauauuauugugcuaaagauggagcauggaaaaugucaggauuagacguauggggucaaggcacuacaguuauaguuucaucagcauccacaaaaggaccuuccguauuuccauuagcaccauguuccagaucaacaagcgaaucaacagcagcacuaggaugucucguaaaagacuacuuuccagaacccguaaccguaucauggaacucaggagcucuaacaucaggaguacauacauuuccugcaguacuucaaagcucaggacuauauucauuaucaucaguaguuacaguacccucauccuccuuaggcacaaaaacauauacauguaacguagaccauaaaccaucaaacacaaaaguagauaaacgaguagaaucaaaauacgguccaccauguccaccauguccagcuccggaauucuuaggaggacccucuguauuuuuauuuccaccaaaacccaaagauacuuuaaugauuaguagaacaccagaaguaacuuguguaguuguagauguaucucaagaagacccagaaguacaauuuaacugguauguagacggaguagaaguccacaacgcaaaaacuaaaccaagagaagaacaauucaauagcacauaucgaguaguaucaguuuuaacgguauuacaucaagauugguuaaacggaaaagaauacaaauguaaaguuaguaauaaaggacuuccaucaucaauagaaaaaacaauuuccaaagcaaaaggacaaccuagagaaccacaaguauauacccuucccccaucucaagaagaaaugacaaaaaaucaaguuucauuaaccuguuuaguaaaaggauuuuauccaucagacauagcaguugaaugggaaucaaacggccaaccagaaaauaauuauaaaacaacaccaccaguacuagauuccgauggaucuuucuuuuuauauagucgauuaacaguagauaaaucucgauggcaagaaggaaacguauuuagcuguucaguaaugcaugaagcccuacacaaccacuacacccaaaaaucauuaucacuuucacucggaaaa

SEQ ID NO: 46753 - RNA, 642 nt, Artificial Sequence
  derived and/or modified sequence opt6 from Trevogrumab_LightChain1
gacauacaaaugacccaaucaccagcaucacuaucagcaucaguaggcgacagaguaaccauaaccugcagagcaucacaagauauaucagacuacuuagcuugguaccaacaaaaaccaggaaaaauaccccgauuauuaauauacacaacauccacacuacaauccggagucccaucaagauucagaggaucuggcuccggaacagacuucacacuaacaauaaguucacuccaaccagaagacguagcaacauacuacugccaaaaauacgacucagcaccacuaacauucggaggaggaacaaaaguagaaauaaaacgaacaguagcagcaccaucaguauucauauucccaccaucagacgaacaauuaaaaucaggaacagcaucaguaguaugccuauuaaacaacuucuauccaagagaagcaaaaguacaauggaaaguagauaacgcauuacaauccggaaacucacaagaaucaguaacagaacaagacucaaaagacucaacauacucacuaucaucaacacuaacacuaucaaaagcagacuacgaaaaacacaaaguauacgcaugcgaaguaacacaccaaggacuaucaucacccguaacaaaaucauucaacagaggagaaugc

SEQ ID NO: 46754 - RNA, 1737 nt, Artificial Sequence
  derived and/or modified sequence opt6 from Tucotuzumab_celmoleukin_HeavyChain1
caaauccaacuaguucaaucaggugccgaaguaaaaaaaccuggagaaaccgucaaaauuucaugcaaagcaucaggauacacuuucacaaacuacggaaugaauugggucaaacaaacaccaggaaaaggacuaaaauggaugggauggaucaacaccuacaccggagaaccaacauacgcagacgacuucaaaggacgcuucgcauucucacucgaaacaucaacaagcacagccuuccuacaaauaaacaaccuacgcuccgaagacacugcuaccuacuuuuguguaagauuuaucucaaaaggagacuacuggggacaaggcacgucugucacaguauccagcgccucaacaaaaggacccuccguauucccacuagcucccucaucaaaauccaccuccgguggaacugccgcccucggaugcuuaguuaaagauuacuuuccugaaccuguaaccgucucauggaacucuggugcacuaacuuccggaguacauacauucccagcuguauuacaauccucaggacuauacucacuaucauccgucguaacaguaccauccuccucauuaggaacacaaaccuauauaugcaauguaaaucacaagcccuccaacaccaaaguagauaaaagaguagaaccuaaauccugcgacaaaacacauaccugccccccaugccccgcccccgaauuacuaggaggcccaucaguauuccuauucccaccaaaaccaaaagauacccuaaugaucucacgaacuccagaaguaacuugugucguaguagacguaucccacgaagaccccgaagucaaauuuaacugguauguagaugguguagagguacacaacgccaaaaccaaaccaagagaagaacaauacaacucuacauauagaguaguauccguacuaacagucuuacaucaagauugguuaaacggaaaagaauacaaaugcaaaguaucaaacaaagcauugcccgcacccauagaaaaaacaauaucuaaagcaaaaggucaaccaagagaaccacaaguuuacacauuaccaccaucaagagaagaaaugaccaaaaaccaaguaucccuaacaugucucguuaaaggauucuaccccuccgauauagcaguagaaugggaaucaaauggacaacccgaaaacaacuauaaaacaaccccacccguauuagacucggacggaucauucuucuuauacucaaaacuaacagucgauaaauccagauggcaacaaggcaaugucuuuucauguucaguaaugcacgaagcucuacacaaccacuacacacaaaaaucauuaucacuaucaccaggaaaagcaccaacaucauccucaacaaaaaaaacacaacuacaauuagaacauuuauuacuagaccuacaaaugauacucaacggaauaaacaauuauaaaaaccccaaauuaacacgcaugcuaacuuuuaaauuuuacaugcccaaaaaagccacagaauuaaaacaccuacaaugucuagaagaagaacuaaaaccucuagaagaaguacucaaucucgcucaaucaaaaaauuuccaccucagaccacgcgaccuaauuucaaacauaaacgucauagucuuagaacucaaaggaucagaaaccacauucaugugugaauaugcagacgaaacugcaacaauaguagaauuccuaaauagauggauaaccuucugccaaucaaucauaucaacauuaacc

SEQ ID NO: 46755 - RNA, 639 nt, Artificial Sequence
  derived and/or modified sequence opt6 from Tucotuzumab_celmoleukin_LightChain1
gaaauaguccuaacacaauccccagcaacauuaucacuauccccaggcgaaagagucacauuaacaugcucagcaucaucaucaguaucauacaugcuaugguaccaacaaaaaccaggaucaucaccaaaaccauggauauuugacacaucaaaccuagcaucaggauuuccagcaagauucucgggaucaggaucugguacaagcuacucucuuauaauaucaucaauggaagcagaagacgcagcaacauacuacugucaucaaagaucaggauacccauacacauucggaggaggaacaaaacuagaaauaaaaagaacaguagcagccccaucaguauuuauauucccacccucagacgaacaauuaaaaucaggaacagcaucaguaguuugccuacucaacaacuucuacccaagagaagccaaaguacaauggaaaguagacaacgcacuucaaucaggaaacucacaagaauccguaacagaacaagacucaaaagacucaacauacucacuaucaucaacacuaacauuaucaaaagcagauuacgaaaaacacaaaguauacgcaugcgaagucacacaccaaggcuuaucaucaccaguaacaaaaucauucaacagaggagaaugc

SEQ ID NO: 46756 - RNA, 1344 nt, Artificial Sequence
  derived and/or modified sequence opt6 from Ublituximab_HeavyChain1
caagcauaucuacaacaaagcggagcagaacuaguacgaccaggagccucugucaaaaugucaugcaaagcuucaggcuacacauucacaucauacaacaugcacugggucaaacaaacaccccgacaaggauuagaauggaucggaggaauauacccugguaacggagacacauccuacaaucaaaaauuuaaaggcaaagcaacacuaacuguaggaaaaucgucaucaacagcauacaugcaauuaucuuccuuaacaucagaagacucagcagucuauuucugcgcacgauaugacuauaacuaugcuauggauuacuggggccaaggaacaucaguaacaguaucaucagccuccacaaaaggcccaucaguauuuccacuagcaccaucaucaaaguccaccagcggaggaacagcagcauuaggaugccuaguuaaagacuacuucccugaacccguaacaguaagcuggaauucaggagcacuaacuucagguguacacacauucccagcuguccuacaaucaaguggauuauacucuuuaucaucaguaguaaccguaccaucuuccucacuaggaacacaaacauacauaugcaacguaaaucacaaaccaagcaacacuaaagucgauaaaaaaguagaacccaaauccugcgauaaaacacauacuugcccaccaugcccagcacccgaacuacuaggcggacccucaguauucuuauuccccccaaaaccaaaagacacauuaaugauauccagaaccccugaaguaacaugcguaguuguagacguaucacacgaagauccagaaguuaaauucaauugguacguagauggaguagaaguacacaacgccaaaacaaaaccaagagaagaacaauacaacucaacauacagaguagucuccguucucacaguacuacaucaagauugguuaaauggaaaagaauauaaaugcaaaguauccaauaaagcacuaccagcaccaauagaaaaaaccauaucaaaagcaaagggacaaccuagagaaccacaaguauacacauuaccaccaucaagagaugaauuaacaaaaaaccaagucucauuaacaugucuaguaaaaggauucuauccauccgacauagccguugaaugggaauccaacggacaaccagaaaauaauuacaaaacaacaccaccaguccuagacucagacgguucuuucuuuuuauauucaaaauuaaccgucgacaaaagcagauggcaacaaggcaacguauucucaugcucaguaaugcacgaagcacuccauaaccauuacacucaaaaaucucucagccuuucacccggaaaa

SEQ ID NO: 46757 - RNA, 639 nt, Artificial Sequence
  derived and/or modified sequence opt6 from Ublituximab_LightChain1
caaauaguauuaagccaaucaccagcaauacuaucagcaucaccaggcgaaaaagucacaaugacaugcagagcaucaucaucaguaucauacaugcacugguaccaacaaaaaccaggaucuucaccuaaaccauggauauacgccaccucaaauuuagcaucaggaguaccagcaagauucuccggaucaggaucagguacaucauacagcuucacaauauccagaguagaagcagaagacgcagccacauacuacugccaacaauggacauucaacccaccaacauucggaggaggaaccagauuagaaauaaaaagaacaguagcagcaccauccguauucauauucccaccauccgacgaacaauuaaaaucaggaacagcaucaguaguaugccuccuaaacaacuucuacccacgagaagcaaaaguucaauggaaaguagacaacgcauuacaaucaggaaacucacaagaaucaguaaccgaacaagacucaaaagacucaacauacucacuaucaucuacacuaacauuaucaaaagcagacuacgaaaaacacaaaguauacgcaugcgaaguaacacaccaaggauuaagcucaccagucacaaaaucauucaacagaggagaaugc

SEQ ID NO: 46758 - RNA, 1353 nt, Artificial Sequence
  derived and/or modified sequence opt6 from Ulocuplumab_HeavyChain1
gaaguucaauuaguagaaucuggaggcggacugguccaaccuggaggaagccuuagauuaucaugcgcagcugcagguuuuacauucaguucauacuccaugaauuggguaagacaagcaccagguaaaggauuagaauggguaucauauauaagcucacguucaagaaccauauauuaugcugacucaguaaaaggaagauuuaccaucucacgcgacaaugccaaaaauucgcuauauuuacaaaugaauucacucagagaugaagauacagcagucuacuacugugcccgagacuauggaggacaaccuccuuauuauuauuacuauggaauggauguauggggacaaggaacaacaguaacagucucaucagcaucaacaaaaggaccaucaguauuuccauuagcaccaugcucuagauccaccucagaaucaaccgcugcacuaggauguuuaguuaaagacuauuuuccagaacccguaacaguaucauggaauucaggcgcacuaacuucaggaguacauaccuucccagcaguacuccaaucaucaggauuauacucacuaucaucugucguaacaguaccaucaucaucacuagguacaaaaacauauacaugcaacguugaccauaaacccucaaauacaaaagucgauaaaagagucgaaucaaaauacgguccaccaugcccaccauguccagcaccugaauuccuaggaggaccaagcguuuuucuauuuccaccaaaaccuaaagauacacucaugauaucaagaacuccugaaguuacauguguaguaguagacguaucacaagaagacccugaaguucaauucaacugguacguagauggcguagaaguacauaaugcaaaaacaaaaccaagagaagaacaauucaauucaacauacagaguaguaucaguauuaacaguacuacaccaagacugguuaaacggaaaagaauacaaaugcaaaguaucaaacaaaggacuaccaucaucuauagaaaaaacaauaaguaaagcaaaaggacaaccucgagaaccacaagucuauacauuaccaccaagccaagaagaaaugacuaaaaaucaaguuucccuaacaugucuaguaaaaggauuuuauccaucugacauagcaguagaaugggaaucuaacggucaaccagaaaauaacuauaaaacuacaccacccguauuagacucagauggcuccuucuuucuauauagcagacuaaccguagauaaaucaagauggcaagaagguaacguuuucuccuguucaguaaugcaugaagcacuacauaaccauuacacccagaaaaguuuaucauuaucauuggga

SEQ ID NO: 46759 - RNA, 642 nt, Artificial Sequence
  derived and/or modified sequence opt6 from Ulocuplumab_LightChain1
gacauacaaaugacacaaucacccucaucauuaucagcaucaguaggagaccgaguaacaauaacaugcagagcaucacaaggaauaucaucauggcuagcaugguaccaacaaaaacccgaaaaagcaccaaaaucacuaauauacgccgcaucaucacuccaaucaggaguaccaucaagauucucaggaucaggcucaggcacagacuucacacuaacaauaucaucacuacaaccagaagacuucguaacauacuacugccaacaauacaacucauacccaagaacauucggacaaggaaccaaaguagaaauaaaaagaacaguagcagccccaucaguauucauauucccaccaucagacgaacaacuaaaauccggaacagccucagucguaugccuauuaaacaacuucuacccaagagaagcaaaaguacaauggaaaguagacaacgcacuacaaucaggaaacucacaagaaucaguaacagaacaagacagcaaagacucaacauacuccuuauccucaacauuaacauuaucaaaagcagacuacgaaaaacacaaaguauacgcaugcgaaguaacacaccaaggacuaagcuccccaguaaccaaaucauucaacagaggagaaugc

SEQ ID NO: 46760 - RNA, 1344 nt, Artificial Sequence
  derived and/or modified sequence opt6 from Urelumab_HeavyChain1
caaguacaauuacaacaauggggagccgguuuauuaaaaccaagcgaaacacucucacuaacaugcgcaguauauggcggaucauuuucaggauauuauuggaguuggauaagacaaucacccgaaaaaggauuagaauggauaggcgaaauuaaucauggcggauauguaacauacaauccaucucuagaaucacgagucaccauaucagucgauacaucaaaaaaucaauuuucacuuaaauuaucuuccguaacagcagcagauaccgcaguauacuauugcgcucgcgacuauggacccgguaacuaugauugguacuuugacuuauggggcagaggcacauuaguaacaguaucaucagcaucuacaaaaggaccaucuguuuuuccauuagcuccauguucaagaucuacaucagaaaguacagcagcauuaggaugcuuaguaaaagauuacuuuccagaaccaguaacagucucauggaacucaggagcauuaaccucugguguacacacauuucccgcaguauuacaaaguucaggucuauacucauuaucaagcguaguaacaguaccaucaucauccuuaggcacuaaaacauauacauguaauguagaucauaaaccaucaaauacaaaaguugauaaacgaguagaauccaaauauggaccaccaugcccaccaugcccagcccccgaauuccucggaggccccucaguuuuuuuauuuccaccaaaaccuaaagacacacuuaugaucuccagaacaccagaaguaacauguguaguaguagauguaucacaagaagauccagaaguucaauuuaacugguauguugauggagucgaaguacacaaugcaaaaacuaaaccaagagaagaacaauucaacucaacuuacagagucguaagcguacuaacaguacuacaucaagacugguuaaacggaaaagaauauaaauguaaaguaucaaacaaaggcuuaccauccucaauagaaaaaacaauaucaaaagcaaaaggacaaccaagagaaccacaaguauauacauuaccuccaucacaagaagaaaugaccaaaaaucaaguaucacuuaccuguuuaguuaaaggauuuuauccuagcgacauugcaguagaaugggaaucaaacggacaaccugaaaacaauuacaaaacaaccccuccagucuuagauucagauggaucuuuuuuucuauacucaagacuaaccgucgauaaauccagauggcaagaaggaaacgucuucucaugcaguguaaugcaugaagcacuacauaaccacuacacacaaaaaucauuaucgcuaucccuagggaaa

SEQ ID NO: 46761 - RNA, 648 nt, Artificial Sequence
  derived and/or modified sequence opt6 from Urelumab_LightChain1
gaaauaguacucacacaaucaccagcaacacuaucacuaagcccaggcgaaagagcaacacuaucauguagagcaagccaaucaguaucaucauaccuagcaugguaccaacaaaaacccggacaagccccaagacuacuaauauacgacgcaucaaauagagcaacaggaauaccagcaagauucucuggaucagguucaggcacagacuucacccuaacaaucagcucauuagaaccagaagacuucgcuguauacuacugccaacaaagaucaaacuggccaccagcacuaacauucugcggcggaacaaaaguagaaauaaaaagaacaguagcagcaccaucaguauuuauauucccaccaucagacgaacaauuaaaaucaggaacagcaucaguaguaugccuacucaacaacuucuacccacgcgaagcaaaaguccaauggaaaguagacaacgcacuacaaucaggaaacucacaagaauccguaacagaacaagacucaaaagacucaacauauucauuaucaucaacacuaacacuaucaaaagcagauuacgaaaaacauaaagucuaugcaugcgaaguaacacaccaaggccucucaucaccaguaacaaaaucauucaacagaggagaaugc

SEQ ID NO: 46762 - RNA, 1347 nt, Artificial Sequence
  derived and/or modified sequence opt6 from Urtoxazumab_HeavyChain1
gaaguacaauuaguagaaucaggcggaggacuaguccaaccaggaggaucccuaagacuauccugugcagcaucaggauuuacauucucaucauacggaauguccuggguaagacaagcaccaggaaaaggcuuagaauggguugcaacaauaucaaccggaggaucuuacaccuacuaucccgacucuguaaaaggaagauucacaauuuccagagauaacgcaaaaaauacacuauauuuacaaaugaacucauuaagagcagaagauacagcuguuuauuauugugcacgacgaggcgacgcauggggcaacuuagacuacuggggacaaggaacacuaguaacaguaucaucagccucaacaaaaggaccauccguauuuccacuagcucccucaucuaaaucaaccucaggaggaaccgcagcacuaggaugcuuagucaaagacuacuuuccagaaccuguaacaguaucauggaacucaggagcacuaacuuccggaguacacacauucccagcaguacuacaaaguucaggucuauacucauuaucauccguaguaacaguaccaucgucuucacuuggaacacaaacauauauauguaacguaaaccauaaaccgucaaacacaaaaguagacaaaaaaguagaaccaaaaagcugugacaaaacccacacaugcccaccaugcccagcaccagaacuucuaggcggaccuucaguuuucuuauuuccuccaaaaccaaaagacacccuaaugauuucacgaacaccugaaguaacaugcguaguuguagacgucagccaugaagacccagaaguuaaauucaauugguacgucgacggaguagaaguccacaaugccaaaaccaaacccagagaagaacaauacaacucuacauaccgcguaguaucaguacuuacaguccuacaucaagacuggcuaaauggaaaagaauacaaauguaaaguaucaaacaaagcccucccagccccaauagaaaaaacaauuagcaaagcaaaaggccaaccaagagaaccacaaguauacacuuuaccucccucaagagaugaacuuacaaaaaaccaaguaucauuaacaugccuaguaaaaggauucuacccaagcgauauagcaguagaaugggaaucaaacggacaaccagaaaacaauuacaaaacaacaccaccaguacuugacucagacggaucauucuuccuauacucaaaacucacaguagauaaaucaagauggcaacaagguaacguauucaguugcucagucaugcaugaagcacuacauaaucacuauacacaaaaaucacucucacugucuccaggaaaa

SEQ ID NO: 46763 - RNA, 642 nt, Artificial Sequence
  derived and/or modified sequence opt6 from Urtoxazumab_LightChain1
gaaauaguacuaacacaaucaccagcaacauuaucuguaucaccaggagaaagagcaacucuaucaugcagagcaucacaaacaauaucaaacaacuuacacugguaucaacaaaaacccggacaagcaccaagacuauuaauaaaaucagcaucacaaucaauaucaggaauaccagcacgauucucaggaucuggaucaggaacagacuucacacuaacaauaucaucucuagaaucagaagacuuugcaguauacuacugccaacaaucauacucauggccacuaacauucggacaaggaacaaaaguagaaauaaaaagaacagucgcagcaccauccguauucauauucccaccaucagacgaacaacuaaaaucaggaacagcaagcguuguaugccuacucaacaacuuuuacccaagagaagcaaaaguacaauggaaaguagacaacgcacuacaaucaggaaacucacaagaaucaguaacagaacaagacucaaaagacucaacauacucacuauccucaacauuaacacuaucaaaagcagacuacgaaaaacacaaaguauacgcaugcgaaguaacacaccaaggccuaucaucaccaguaacaaaauccuucaacagaggagaaugc

SEQ ID NO: 46764 - RNA, 1347 nt, Artificial Sequence
  derived and/or modified sequence opt6 from Ustekinumab_HeavyChain1
gaaguacaacuuguacaaucaggugccgaaguaaaaaaaccaggagaaucacuaaaaauauccugcaaaggaucaggauacucauucaccacauacugguuaggauggguccgacaaaugccagguaaaggacucgacuggaucggaauaaugucuccaguagacucagacauaagauacucaccaucauuucaaggccaaguaacaaugagcguagacaaaucaaucacaaccgcauaccuacaauggaauucauuaaaagcaucagauaccgcaauguauuauugugccagacgaagaccaggacaaggauacuuugacuucuggggacaaggaacacucguaacaguaucaucuucuucaacuaaaggcccaaguguauucccuuuagccccaucaucaaaaucuacaagcggaggaacagcagcccuaggaugucuaguaaaagauuauuuuccagaaccaguaacagucucauggaacucaggcgcucuaaccucaggaguacacacauuuccagcaguacuccaauccucuggacuauauucacuaucaucaguaguaacaguuccaucaucaucacuaggaacacaaacauacaucugcaacguaaaccacaaaccauccaacacaaaaguagacaaaagaguagaacccaaaucaugugacaaaacacauaccugcccuccaugccccgcucccgaacuacuagguggacccucaguauuccuauucccaccaaaaccaaaagacacccuaaugauaucaagaacacccgaagucacaugcgucguagucgauguaucacacgaagauccugaaguuaaguucaacugguauguagaugguguagaaguccauaaugcaaaaaccaaaccacgagaagaacaauauaacucaaccuaccgaguaguaucuguacuaacaguauuacaucaagauuggcuaaacggaaaagaauauaaauguaaaguaucuaacaaagcacuaccagcaccuauagaaaaaacaauaucaaaagcuaaaggacaaccaagagaaccccaaguuuacacucuaccuccauccagagacgaauuaacaaaaaaccaaguuucacuaacauguuuaguaaaaggauucuacccuucagacauagcaguagaaugggaaucuaacggucagccagaaaauaacuauaaaacuacgccucccguauuagauucagacggauccuucuuccuauauucaaaauuaacuguagacaaaucaagauggcaacaaggaaacgucuucagcugcucaguaaugcacgaagcccuucacaaccacuacacacaaaaaagcuuaucucuaucaccuggaaaa

SEQ ID NO: 46765 - RNA, 642 nt, Artificial Sequence
  derived and/or modified sequence opt6 from Ustekinumab_LightChain1
gacauacaaaugacacaaucaccaucaucauuaucagcauccguaggagacagaguaacaauaacaugcagagcaucacaaggaauaucaucaugguuagcaugguaccaacaaaaaccagaaaaagcacccaaaucacuaauuuacgcagcaucaucauuacaaucaggaguaccauccagguucucaggaucaggaucaggaacagacuuuacacuaacaaucuccucacuacaaccagaagacuucgcaacauacuacugccaacaauacaacauauacccauacacauucggacaaggaacaaaacucgaaauaaaacgaaccgucgcagcuccaucaguauucauauucccacccucagacgaacaacuaaaaucaggaacagcaucagucguaugcuuacucaacaacuucuacccaagagaagcaaaaguccaauggaaaguagacaacgcacuacaaucaggaaauucacaagaauccguuaccgaacaagacucaaaagacucaacauauucauuauccucaacacuaacauuaagcaaagcugacuacgaaaaacacaaaguauacgcaugcgaaguaacacaccaaggccuaucaucaccaguaacaaaaucauucaacagaggagaaugc

SEQ ID NO: 46766 - RNA, 1341 nt, Artificial Sequence
  derived and/or modified sequence opt6 from Vadastuximab_talirine_HeavyChain1
caaguucaacuuguccaaucaggagcagaaguuaaaaaaccuggugccucaguaaaaguaucauguaaagcaucaggauacacauuuacaaacuaugauaucaacuggguaagacaagcaccaggacaagguuuagaauggaucggauggauauacccaggagacggaucaaccaaauauaaugaaaaauucaaagcaaaagcaacauuaaccgcagacacaucaacuagcacagcauacauggaauuaagaucccuccgaucagacgauacagccguauacuacugcgccucaggauaugaagacgcaauggauuacuggggacaaggaacaacaguaacaguaucaucagcuucaacaaaaggaccaucuguauuuccacuagcaccaucaucaaaaucuacaucaggaggaaccgcagcacuaggaugcuuaguaaaagacuauuuuccagaaccagucaccguuucauggaauagcggagcauuaacaucaggcguacauacauuuccagcaguucuacaaagcucuggacuauacucccuaucaucaguagucaccguaccaucaucaagccuaggaacacaaacauacaucuguaacgucaaucacaaaccuucaaacacaaaaguagacaaaaaaguagaacccaaaucaugcgauaaaacacauacaugcccaccaugcccagcucccgaacuacuaggaggaccauguguauuuuuauucccuccaaaaccaaaagacacacuaaugauaucacgaacaccagaagucaccugcguaguaguagacguaucccaugaagacccagaaguaaaauucaacugguaugucgacggcguagaaguacauaacgcaaaaaccaaaccaagagaagaacaguauaacucuacuuauagaguaguaucagucuuaacaguacuacaucaagauuggcuaaacgguaaagaauacaaauguaaaguaagcaauaaagcauuacccgcaccaauugaaaaaacaauaucaaaagcaaaaggacaaccaagagaaccccaaguauacaccuuacccccaucuagagacgaacuaacaaaaaaucaagucucauuaacauguuuaguaaaaggauucuaccccucagauauagcaguagaaugggaauccaauggccaaccagaaaacaauuacaaaacaacaccgcccguucuagauucagacggaaguuucuuuuuauacuccaaacucacaguagacaaaucacgauggcaacaaggcaacguauucucaugcucaguaaugcaugaagccuuacacaaccauuauacacaaaaaucauuaucccuaucaccaggaaaa

SEQ ID NO: 46767 - RNA, 642 nt, Artificial Sequence
  derived and/or modified sequence opt6 from Vadastuximab_talirine_LightChain1
gacauacaaaugacacaaucaccaucaucauuauccgcaucaguaggagauagaguaacaauaaauugcaaagcaucacaagacauaaacucauaccuauccugguuccaacaaaaaccaggaaaagcacccaaaacauuaauauacagagccaacagacucguagacggagucccauccagguuuuccggaucaggaucaggacaagacuacacacuaacaauaagcucacuacaacccgaagacuuugcaacauacuacugccuacaauacgacgaauucccacuaacauucggaggcggaacaaaaguagaaauaaaaagaacaguagcagcaccaucaguauucauauucccaccaucagacgaacaacuaaaaucaggaacagcaucagucguaugccuauuaaacaacuuuuauccaagagaagcaaaaguacaauggaaaguagacaaugcacuacaaucaggaaacucacaagaaucaguaacagaacaagacucaaaagacucaacauacucauuaucaucaacauuaacauuaucaaaagcagacuacgaaaaacacaaaguauacgcaugcgaaguaacacaccaaggacuaucaucaccaguaacaaaauccuucaacaggggagaaugc

SEQ ID NO: 46768 - RNA, 1362 nt, Artificial Sequence
  derived and/or modified sequence opt6 from Vandortuzumab_vedotin_HeavyChain1
gaaguccaacuaguagaaucugguggaggacucguacaaccaggcgguucuuuaagacuaucgugugcaguuucuggauacaguauaaccucagacuacgcauggaacuggguaagacaagcaccaggaaaaggacucgaauggguuggauacauauccaauucaggauccacuuccuacaauccaucacuaaaaucaagauucacaauauccagagauacaaguaaaaauacauuauaccuacaaaugaacucucucagagccgaagauacagcagucuacuauugcgcacgagaaagaaacuacgauuacgacgauuacuauuacgcaauggacuacuggggucaaggcacauuaguaaccguaucaucagccucuaccaaaggcccaucaguauuuccauuagcaccaaguucaaaauccaccucagguggaacagcagcccuaggcugcuuaguaaaagacuacuuuccagaaccagugacuguaucuuggaauucaggagcccuaacaucaggaguucacacauucccagcaguacuccaaucaucaggauuauauucauuaaguucaguaguaacaguaccuuccucaagccuagguacacaaacauauaucugcaacguaaaccacaaaccauccaauacuaaaguagacaaaaaaguagaaccaaaaucuugcgauaaaacccauacaugcccacccugcccagcaccagaauuauuaggcgguccauccguauucuuauuuccaccaaaaccaaaagauacuuuaaugauauccagaacaccagaaguaacauguguugucguugauguaucucaugaagacccagaaguaaaauucaauugguaugucgacggaguugaaguacauaacgcaaaaacaaaaccccgagaagaacaauacaauucaacauacagaguaguauccguuuuaacaguacuacaccaagacuggcuuaacggaaaagaauauaaaugcaaaguauccaauaaagcacuaccugcaccaauagaaaaaacuaucuccaaagccaaaggacaacccagagaaccacaaguuuacacuuuaccaccaucucgcgaagaaaugacaaaaaaccaaguuucauuaacauguuuagucaaaggauucuacccauccgacauagcagucgaaugggaaucaaacggccaaccagaaaacaauuauaaaacaaccccaccuguacuagacucagacggauccuuuuuuuuauacucuaaacuaacaguagacaaaucaagauggcaacaaggcaacguauucucaugcucaguaaugcacgaagcacuacacaaucauuacacacaaaaaucauuaucacuaucaccagguaaa

SEQ ID NO: 46769 - RNA, 660 nt, Artificial Sequence
  derived and/or modified sequence opt6 from Vandortuzumab_vedotin_LightChain1
gacauccaaaugacacaaucaccaucaucacuaucagcaagcguaggagacagaguaacaauaacaugcaaaucaucccaaagcuuacuauacagaucaaaccaaaaaaacuaccuagcaugguaccaacaaaaacccggaaaagcaccaaaacuccuaauauacugggcaucaacaagagaauccgguguaccaucaagauucucaggaucaggaucaggaacagacuucacacuaacaauauccucacuacaacccgaagacuucgcaacauacuacugccaacaauacuacaauuacccccgcacauucggacaaggaacaaaaguagaaauaaaaagaacaguagcagcaccaucaguauucauauucccaccaucagacgaacaacuaaaaucaggaacagcaucagucguaugccuacuaaacaacuucuacccaagagaagcaaaaguccaauggaaagucgacaacgcacuacaauccggaaacucacaagaauccguaacagaacaagacucaaaagacucaacauacucccuaucaucaacauuaacauuauccaaagcagacuacgaaaaacacaaaguauacgcaugcgaaguaacacaccaaggcuuaucauccccaguaacaaaauccuucaacagaggagaaugc

SEQ ID NO: 46770 - RNA, 1329 nt, Artificial Sequence
  derived and/or modified sequence opt6 from Vantictumab_HeavyChain1
gaaguacaauuaguugaaucaggcggaggauuaguacaacccggcggaucauuacgccuaucaugugcagcaucaggauuuacauucucacauuauacacuaucauggguccgucaagcaccaggcaaaggauuagaauggguuucugucaucucaggagauggaucuuacacauacuacgcagauuccguaaaaggaagauucacaauaucaucugacaacucaaaaaacacauuauacuuacaaaugaacucauuaagagcagaagacacagccguauacuacugcgcaagaaauuucauaaaauacguuuucgcaaacuggggacaaggaacauuaguaacaguuuccucagcaucaacaaaaggaccaucaguauuccccuuagccccauguucaagaucaacuucagaaucaaccgcugcucuaggaugucuuguaaaagacuacuucccagaaccaguaacagucuccuggaacuccggagcauuaacauccggaguucacacauucccagcaguauuacaaucaucaggacuauacucucuaucuucaguuguaacaguuccaucuucaaauuucggaacacaaacauacacaugcaacguagaccacaaaccauccaauacaaaaguagacaaaaccguagaacgaaaauguugcguagaaugcccaccaugccccgcaccaccagucgccggaccauccguauuccuauucccacccaaacccaaagauacauuaaugaucucccgaacuccagaaguuacauguguaguaguugauguuucucacgaggacccugaaguucaauucaacugguauguagacggcguugaaguucacaacgcaaaaaccaaaccaagagaagaacaauucaacucaacauucagagucgucucaguacuaacaguaguccaucaagacuggcuaaauggcaaagaauauaaauguaaagucuccaacaaaggacuaccagcaccaauagaaaaaacaaucucaaaaacaaaaggccaaccacgagaaccccaaguauacacacuuccgccaucccgcgaagaaaugacaaaaaaucaaguaucacuaacaugccuaguaaaaggauucuacccuucagacauagcagucgaaugggaaucuaacggacaaccagaaaacaacuacaaaacuacaccaccaaugcuagacucagauggaucauuuuuccuauauuccaaauuaacaguagauaaaaguagauggcaacaagguaacguuuucucaugcuccguaaugcacgaagcauuacauaaccacuauacacaaaaaucacuauccuuaucacccgga

SEQ ID NO: 46771 - RNA, 639 nt, Artificial Sequence
  derived and/or modified sequence opt6 from Vantictumab_LightChain1
gacauagaauuaacacaaccaccaucaguaucaguagcaccaggacaaacagcaagaaucucaugcucaggcgacaacauaggaucauucuacguacacugguaccaacaaaaaccaggacaagcaccaguauuaguaauauaugacaaauccaacagaccaucaggaauaccagaaagauucucaggaucaaacucaggaaacaccgcaacacuaacaaucuccggaacacaagcagaagacgaagcagacuacuacugccaaucauacgcaaauacacuaucauuaguauucggaggaggaacaaaacuaacaguacuaggacaaccaaaagcagcaccaucaguaacacuauucccaccaucaucagaagaauuacaagcaaacaaagccacccucguaugcuuaauaucagauuucuauccaggagcaguaacaguagcauggaaagccgacucaucaccaguaaaagcaggcguagaaacaaccacaccaucaaaacaauccaacaacaaauacgcagcaucaucauaccucucccuaacaccagaacaauggaaaucacacagauccuacucaugccaaguaacacacgaaggaucaacagucgaaaaaacaguagcaccaacagaaugcuca

SEQ ID NO: 46772 - RNA, 1389 nt, Artificial Sequence
  derived and/or modified sequence opt6 from Vanucizumab_HeavyChain1
caaguccaacuuguacaaucaggcgcagaaguaaaaaaaccaggagccucaguaaaaguaagcugcaaagcaucaggauacaccuuuacaggauauuacaugcauuggguaagacaagcaccaggccaaggacuagaauggaugggauggauaaaccccaacagcggaggaacaaauuacgcacaaaaauuucaaggacgaguaacaaugaccagagacacaucaauaucaacagcauacauggaauuaucacgacuucgauccgaugacacagcaguauacuacugcgcaagaucccccaacccauacuacuaugacucaucuggauauuacuauccaggagcauucgacauauggggacaaggcacaaugguaaccguaucaucagcauccguagccgcaccaucagucuucauauucccaccuagcgacgaacaacuaaaaagcggaacagcaucaguaguaugcuuauuaaauaacuucuacccacgagaagcaaaaguacaauggaaaguagacaacgcucuacaaucaggaaacucacaagaaucaguaacagaacaggacucaaaagacucuacuuauucacuauccucaacccucacacuaucaaaagcagacuacgaaaaacauaaagucuacgcaugugaaguaacacaccaaggccuaucaucaccagugacaaaaucauucaacagaggugaaugugacaaaacacauacauguccaccaugcccugcuccagaauuauuaggcggaccauccguuuuccuauuuccaccaaaaccuaaagacacauuaaugaucaguagaacuccagaaguuaccugcguuguuguagauguaucacaugaagacccagaaguaaaauucaacugguacguagaugguguugaaguacacaacgcaaaaacaaaaccuagagaagaacaauacaacucuacauacagaguaguaucaguacuaaccguauuacaucaagacugguuaaaugguaaagaauacaaaugcaaagucucaaauaaagcacuaccagcaccuauagaaaaaacaauauccaaagcaaaaggacaaccaagggaaccacaaguauguacacuaccaccaucaagagacgaacuaacaaaaaaucaaguaucuuuaucaugcgcagucaaaggauuuuacccaucagauauagcaguagaaugggaaucaaacggacaacccgaaaauaacuauaaaacaacaccaccaguauuagacucagauggaucauuuuuuuuaguaucaaaacugaccgucgauaaaucacgauggcaacaaggcaacguguucucaugcucagucaugcacgaagcauuacauaaccacuacacacaaaaaucauuaucauuauccccaggaaaa

SEQ ID NO: 46773 - RNA, 1359 nt, Artificial Sequence
  derived and/or modified sequence opt6 from Vanucizumab_HeavyChain2
gaaguacaacuaguagaauccggaggaggauuaguacaaccuggcgguucccuuagauuaucaugugcagcaucagguuauacauuuacuaauuauggaaugaacuggguccgacaagccccaggaaaaggauuagaguggguaggauggauaaacacauauacaggagaaccaacauacgccgccgacuuuaaacgcagauuuacuuucucuuuagacacaucaaaauccacagcauaccuucaaaugaauucacuaagagcagaagacacagcaguauauuacugcgcaaaauauccacacuacuacggauccucacacugguacuucgacguuuggggacaaggcacauuaguaacaguaagcucagccucaacuaaaggaccaucaguauuccccuuagcaccuucaucaaaauccacauccggagguacagcugcccuaggauguuuagucaaagauuacuuccccgaaccaguaacaguaucauggaauucaggcgcacuaacaucuggaguccauacauuucccgcagucuuacaaucuucaggacuauauucccuaucaucaguaguuaccguacccucaucaucauuaggaacacaaacauacauaugcaauguaaaucauaaaccaucaaacacaaaaguagacaaaaaaguagaaccaaaauccugugauaaaacucauacauguccaccaugccccgcaccagaauuacuaggaggaccuucagucuucuuauucccacccaaaccaaaagauacauuaaugauauccagaacaccagaaguaacaugcguaguaguagacgucagucacgaagacccagaagucaaauuuaacugguauguagauggugucgaaguucacaaugcaaaaacaaaaccccgagaagaacaauauaacucuacauacagaguaguaucaguauuaacaguauuacaccaagacuggcucaacggaaaagaauacaaaugcaaaguaucaaacaaagcacuaccagcaccaauagaaaaaacaauaucaaaagcaaaaggacaacccagagaaccacaaguauauacacuuccacccugcagagaugaauuaacuaaaaaccagguaucuuuauggugucuaguuaaaggauucuacccaucagacauagcuguagaaugggaaucaaacggacaaccugaaaacaacuacaaaaccacacccccuguccuugacuccgacggaucauuuuuccuauacucaaaauuaacaguugacaaaucacgauggcaacaaggaaauguauucaguuguucuguaaugcacgaagcauuacauaaucauuauacucaaaaaucacucucuuuaucacccggaaaa

SEQ ID NO: 46774 - RNA, 639 nt, Artificial Sequence
  derived and/or modified sequence opt6 from Vanucizumab_LightChain1
caaccaggacuaacucaaccaccaucaguaucaguagcaccaggacaaacagcaagaauaacaugcggaggaaacaacauaggaucaaaaucaguacacugguaccaacaaaaaccaggacaagcuccaguacuaguaguauacgacgacuccgacagacccucaggaauacccgaaagauucucaggaucaaauucaggaaacacagcaacauuaacaauaucuagaguagaagcaggagacgaagcagacuacuacugucaagucugggauucaucaucagaccacuacguauucgguacaggaacaaaagucacaguacuaucaucagcaucaacaaaaggaccaucaguauuuccauuagcaccaucauccaaaucaacaucaggaggcacagcagcacuaggaugccuaguaaaagacuacuuuccagaaccaguaacaguaucauggaacucaggagcauuaacauccggaguacacacauuuccagccguauuacaaucaucaggauuauacucauuaucuucaguaguaaccguaccaucaucaucacuaggcacccaaacauacauauguaacguaaaccacaaaccaucaaacacaaaaguagacaaaaaaguagaaccaaaaucaugc

SEQ ID NO: 46775 - RNA, 642 nt, Artificial Sequence
  derived and/or modified sequence opt6 from Vanucizumab_LightChain2
gauauacaaaugacacaaucaccaucaucacuaucagcaucaguaggagacagaguaacaauaacaugcucagcaucacaagacauaucaaacuacuuaaacugguaucaacaaaaaccaggaaaagcacccaaaguacuaauauacuucacauccucacuacacucaggaguaccaucaagauucucaggaucaggcucaggaacagacuucacacuaacaauauccucucuacaaccagaagacuucgcaacauacuacugccaacaauacucaacaguaccauggacauuuggacaaggaacaaaagucgaaauaaaaagaacaguagcagccccaucuguauucauauucccaccaucagacgaacaauuaaaaucaggaacagcaucaguaguaugccuacuaaacaacuucuacccacgcgaagcaaaaguacaauggaaaguagacaacgcacuccaauccggaaacucacaagaauccguaacagaacaagacucaaaagacucaacauauucacuaucaucaacacuaacacuaucaaaagcagacuacgaaaaacacaaaguauacgcaugcgaaguaacacaccaaggacuaucaucaccaguaaccaaaucauucaaccgaggagaaugc

SEQ ID NO: 46776 - RNA, 1356 nt, Artificial Sequence
  derived and/or modified sequence opt6 from Varlilumab_HeavyChain1
caaguacaacuaguagaaucagguggaggcguaguccaaccaggaagaaguuuaagacuaaguugugcugcaucaggauucacuuuuucaucuuacgacaugcacuggguaagacaagcaccaggaaaaggacuagaauggguagcaguaaucugguacgacggaucuaacaaauauuacgcagacucagucaaaggaagauucaccaucucaagagauaauucaaaaaauacuuuauaccuccaaaugaacagccuaagagcagaagacacagcaguuuauuauugcgcaagaggcucaggcaacuggggauucuucgauuacuggggacaaggaacacuaguaacaguaucuuccgcaucaacaaaaggcccaagcgucuuuccauuagcccccucaaguaaaucuacaucuggcggaacagcagcauuaggaugccuaguaaaagacuauuucccagaaccaguaacugucucauggaacucaggagcauuaacaucaggaguacacacauuuccugcaguacuacaaagcaguggccuauauucauuaucaucaguagucacaguuccaaguucaucacuugguacacaaacauacaucuguaauguaaaccauaaaccaucaaacacaaaaguugauaaaaaaguagaaccaaaaaguugcgauaaaacacauacuuguccccccugcccagcacccgaauuauugggaggaccaucaguuuuccuauuccccccaaaaccaaaagauaccuuaaugauaaguagaacacccgaaguaacaugcguugucgucgacguaucacaugaagacccagaaguuaaauuuaacugguacguagacggaguagaaguccacaacgcaaaaacaaaaccaagagaagaacaauacaacucaacauacagaguaguuagcguauuaacagucuuacaucaagacugguuaaacggaaaagaauacaaaugcaaaguuagcaacaaagcauuaccagccccaauugaaaaaacaauaucaaaagcaaaaggacaaccacgagaaccacaaguauauacacuaccaccgucaagagaugaacucaccaaaaaccaaguaaguuuaacaugucuaguaaaaggauuuuauccaucagacauagcagucgaaugggaaucaaacggacaaccagaaaacaacuacaaaacuacaccaccaguauuagacucagacgguucauucuuccuauauaguaaacuuacaguagacaaaucacgauggcaacaagguaacguauucaguuguucuguaaugcacgaagcauuacacaaccauuauacacaaaaaucauuaucacuaaguccaggaaaaggaucauca

SEQ ID NO: 46777 - RNA, 642 nt, Artificial Sequence
  derived and/or modified sequence opt6 from Varlilumab_LightChain1
gacauacaaaugacacaaucuccaucaagccuaucagcaucaguaggagacagaguaacaauaacaugcagagcaucacaaggaauaucaagauggcuagcaugguaccaacaaaaaccagaaaaagcaccaaaauccuuaauauacgcagcaucaucacuacaauccggcguaccaucaagauucucaggaucaggaucaggaacagacuucacacuaacaaucuccucacuacaaccagaagacuucgccacauacuacugccaacaauacaacacauauccacgcacauucggacaaggaacaaaaguagaaauaaaaagaacaguagcagcaccaucaguauucauauucccacccucagacgaacaacuaaaaucaggaacagcaucaguaguaugccuacuaaacaacuucuacccacgagaagcaaaaguacaauggaaaguagacaacgcauuacaaagcggaaacucacaagaauccguaacagaacaagacucaaaagacucaacauacucacuaucaucaacauuaacacuaucaaaagcagacuacgaaaaacacaaaguauacgcaugcgaaguaacacaccaaggacuaucaucaccaguaacaaaaucauucaacagaggagaaugc

SEQ ID NO: 46778 - RNA, 1338 nt, Artificial Sequence
  derived and/or modified sequence opt6 from Vatelizumab_HeavyChain1
caaguacaauuacaagaauccggaccaggacuagucaaaccaucagaaacacuuucacuaacauguacagucuccggcuucucacuaaccaauuacggaauacacuggauaagacaaccaccaggaaaaggacuagaauggcuuggaguaauaugggcacgaggauuuacaaauuacaacucagccuuaauguccagauuaacaaucaguaaagauaacucaaaaaaucaaguaucacuaaaacucaguucaguaacugcagcagacacagccgucuauuauugcgcacgagcuaacgauggcguauacuacgcaauggauuauuggggccaaggaacacuaguaacaguaucauccgccucaacuaaaggaccaucaguauucccuuuagcaccauguuccagaucaacauccgaaucuaccgcugcccuuggauguuuaguaaaagacuacuucccagaaccaguaacaguaucuuggaacagcggcgcauuaacaucaggaguucacacauucccagcaguccuacaaucuucuggacuauauuccuuaucaucaguaguaacaguucccagcucaucacuaggaaccaaaacuuauacaugcaacguagaccacaaaccauccaauacaaaagucgauaaaagaguagaaucaaaauacggaccaccaugcccaucuugucccgcuccagaauuuuuaggcggcccaucagucuuuuuauuuccaccaaaaccaaaagauacccuaaugauauccagaacaccagaagucacauguguaguaguagacguaucucaagaagacccggaaguucaauucaacugguacguagauggaguagaaguccauaacgcaaaaacaaaaccaagagaagaacaauucaauucaaccuaccgagucguaucaguauuaacaguauuacaccaagacuggcuuaauggaaaagaauauaaauguaaaguaucaaauaaaggauuaccuagcuccauagaaaaaacuaucaguaaagcaaaaggacaaccacgagaaccacaaguuuauacacuaccaccaucacaagaagaaaugacaaaaaaccaaguuuccuuaacaugccucgucaaaggauucuaucccucugacauagccguagaaugggaaucaaacggccaaccagaaaauaauuacaaaacuacaccaccaguacucgauucugacggaucuuucuuccuauauucuagacuaacuguagacaaaucaagauggcaagaaggaaaugucuuuuccuguucaguaaugcaugaagcauuacacaaccauuacacacaaaaaucucuuucacucucauuaggaaaa

SEQ ID NO: 46779 - RNA, 639 nt, Artificial Sequence
  derived and/or modified sequence opt6 from Vatelizumab_LightChain1
gacuucguaaugacacaaucaccagcauucuuaucaguaacaccaggagaaaaaguaacaauaacaugcucagcacaaucauccguaaacuacauacauugguaccaacaaaaaccagaccaagcaccaaaaaaauuaauauacgacacauccaaauuagcaucaggaguaccaucaagauucucaggcucaggaucaggaacagacuacaccuuuacaauaucaucauuagaagcagaagacgcagcaacauacuacugccaacaauggacaacaaacccacuaacauuuggacaaggaacaaaaguagaaauaaaaagaacaguagcagcacccucuguauuuauauucccaccaucagacgaacaacuaaaauccggcacagcaucaguaguaugccuauuaaacaacuucuacccacgagaagcaaaaguacaauggaaaguagacaacgcacuacaauccggaaacucacaagaaucuguaacagaacaagacucaaaagacucaacauacucacuaucaucaacauuaacacuaucaaaagcagacuacgaaaaacauaaaguauacgcaugcgaaguaacacaccaaggccuaucauccccaguaaccaaauccuucaaccgaggagaaugc

SEQ ID NO: 46780 - RNA, 1353 nt, Artificial Sequence
  derived and/or modified sequence opt6 from Vedolizumab_HeavyChain1
caaguccagcuaguccaaucaggagcugaagucaaaaaacccggagcaucaguaaaaguaucuuguaaaggaucaggauacacauucacaucauauuggaugcacuggguaagacaagcaccaggacaaagacucgaauggauaggagaaauagauccaucagaaucaaauacaaacuacaaccaaaaauuuaaagguagaguaacacuaacaguagacauaagugcuucuacagcauacauggaauuaucaucauuaagaucagaggacacagcaguauacuacugugcaagaggcggcuaugacggaugggacuacgcaauagacuauuggggucaaggaacucucguaaccguaucaucagcaucuacaaaaggaccauccgucuucccccuggcaccaucaucaaaaucuacaucaggugguaccgcagcacuaggaugcuuaguaaaagacuacuuucccgaaccugucacaguaucauggaacucuggagcauuaacaucaggaguacacacauucccagcaguucuacaaucaucaggacuuuauucacuuucaagcgucguaacaguacccucuucaucacuuggcacacaaacuuacauaugcaacguaaaccacaaaccuucaaauacuaaaguagauaaaaaaguagaaccaaaaucaugcgauaaaacacauaccuguccaccauguccagcaccagaacuagcuggagcaccaucaguauuucuauucccacccaaaccaaaagacacacuaaugauaagccgaacaccagaaguaacaugcguaguaguagauguaucucacgaagacccagaaguaaaauuuaacugguacguagacggagucgaaguacauaaugcaaaaaccaaaccuagagaagaacaauacaacucaacauacagaguaguauccguacuaacaguacuacaccaagacugguuaaacggaaaagaauauaaaugcaaagucucaaacaaagcacuaccagcaccaauagaaaaaaccauaucaaaagccaaaggacaaccccgagaaccacaagucuacacucuaccaccaucacgcgaugaacuaacaaaaaaucaaguaucauuaacuuguuuaguaaaaggauucuacccaucagacauugcuguagaaugggaauccaauggucaacccgaaaacaacuacaaaacaacuccaccaguuuuagauucagacggaucuuuuuuccuauacucaaaacuaacaguagacaaaucaagauggcaacaaggaaacgucuuuucguguucaguaaugcaugaagcacuacauaaccacuacacacaaaaaucacuuucucuaucaccaggaaaa

SEQ ID NO: 46781 - RNA, 657 nt, Artificial Sequence
  derived and/or modified sequence opt6 from Vedolizumab_LightChain1
gacgucguaaugacccaauccccacuaucacuaccuguaacaccaggagaaccagcaucaauaucaugcagaucaucacaaucacuagcaaaaucauauggaaacacauaccuaucaugguaccuacaaaaaccaggacaaucaccacaacucuuaauauacggaauaucaaacagauucucaggagucccagacagauucucaggaucaggaucaggaacagacuucacauuaaaaauaagcagaguagaagcagaagacguaggcguauacuacugccuacaaggaacacaccaaccauacacauucggacaaggaaccaaaguagaaauaaaaagaacaguagcagcaccaucaguauucauauuuccaccaagcgacgaacaacuaaaaucaggaacagcaucaguaguauguuuacuaaacaacuucuacccaagagaagcaaaaguccaauggaaaguagacaacgcacuacaaucagguaacucucaagaaucaguaacagaacaagacucaaaagacucaacuuacucacuaucaucaacauuaaccuuauccaaagccgacuacgaaaaacacaaaguauacgcuugugaaguaacacaccaaggauuaucaucaccaguaacaaaauccuucaacagaggagaaugc

SEQ ID NO: 46782 - RNA, 1353 nt, Artificial Sequence
  derived and/or modified sequence opt6 from Veltuzumab_HeavyChain1
caagugcaauuacaacaaucaggcgcagaaguaaaaaaaccaggaucaucgguaaaagucucaugcaaagccucaggauacacauuuaccucuuacaacaugcacuggguuaaacaagcaccaggacaaggacucgaauggauaggcgcaauauaccccggcaugggagauacauccuacaaucaaaaauuuaaaggaaaagcaacccuuacagcagacgaauccacaaauacagcuuauauggaauuaucauccuuaagaucagaagacacagcauucuacuauugugcaagauccacauacuacggaggagauugguauuucgacguauggggacaaggaacaacuguaacaguaucaucugcaucaacaaaagguccuucagucuucccacuagcaccaucaucaaaaucuacaucaggaggaacagccgcccuagggugcuuagucaaagacuacuuuccagaaccaguaacagucucauggaacucaggagcacuaacaucaggaguccacacauuuccagcaguacuacaaucaucuggauuauacucacuaucaucaguaguaacaguaccuucaucuucauuaggaacacaaaccuauauaugcaauguaaaccacaaaccaucaaauacaaaaguagauaaaagaguagaaccaaaauccugcgacaaaacacacacauguccaccaugcccagcuccagaacuacuaggcggaccaucaguauuccuauuccccccaaaaccaaaagacacuuuaaugaucucacgaacaccagaaguaacaugcguugucgucgacgucucucacgaagacccagaaguaaaauucaacugguacguugacggaguagaaguacauaaugcuaaaacaaaaccacgugaagaacaauacaauuccacauacagaguagucucuguccuuacaguauuacaccaagacuggcucaacggaaaagaauacaaaugcaaaguuucaaauaaagcauuaccagcuccaauagaaaaaacaaucuccaaagccaaaggacaaccuagagaaccccaaguauacaccuuaccacccucacgagaagaaaugaccaaaaaccaaguaucacuaacaugucuaguaaaaggauucuaucccucagauauagcaguagaaugggaaucaaauggacaacccgaaaauaacuacaaaacaacuccaccaguucuugacucugacgguucauuuuucuuauauucuaaacuaacagucgacaaaucaagauggcaacaaggaaacguauuuuccugcucaguaaugcaugaagcauuacacaaccacuacacacaaaaaucacuaucacuaucacccggaaaa

SEQ ID NO: 46783 - RNA, 639 nt, Artificial Sequence
  derived and/or modified sequence opt6 from Veltuzumab_LightChain1
gacauacaauuaacacaaucaccaucuucucuaucagcaucagucggagaccgcguaacaaugacaugcagagcaucaucaucaguaucauacauccauugguuccaacaaaaaccaggaaaagccccaaaaccauggauauacgcaacaucaaaucuagcaucaggaguaccaguaagauucucaggaucaggcucaggaacagacuacacauucacaauaucaucacuacaaccagaagauauagcaacauacuacugccaacaauggacaucaaauccaccaacauucggaggaggaaccaaacuagaaauaaaaagaacaguagcagcaccaucaguauucauauucccacccucagacgaacaacuaaaaucaggcacagcauccguagucugucuacuaaacaacuucuacccaagagaagccaaaguccaauggaaaguagacaacgcacuacaaucaggaaauucacaagaaucuguaacagaacaagacucaaaagacucaacauacagccuaucauccacacuaacacuauccaaagcagacuaugaaaaacacaaaguauacgccugcgaaguaacacaccaaggauuaucaucaccaguaacaaaaucauucaauagaggcgaaugc

SEQ ID NO: 46784 - RNA, 1359 nt, Artificial Sequence
  derived and/or modified sequence opt6 from Vesencumab_HeavyChain1
gaaguacaacuaguugaaucaggaggagguuuaguccaaccaggaggaucauuacgccucucaugcgcggcaucaggcuucaccuucucaucauacgcaaugucauggguacgacaagcaccaggaaaaggacuggaauggguaucacaaauauccccagccggaggauacacaaacuacgcagauucuguaaaaggaagauucacaauauccgccgauacuucaaaaaauacugcauaucuacaaaugaauucauuaagagcagaagacacugcuguauacuacugugcacgaggagagcucccuuacuacagaaugagcaaaguaauggacguauggggucaaggaacauuaguaacuguaucaucugcuuccacaaaaggaccaucaguuuuuccucuugcaccuucaucaaaaucaaccucaggcggcacagcagcccuagguugccuaguaaaagacuauuuuccagaaccaguuacaguaucauggaacagcggagcuuuaacauccggaguacacacauuuccugcaguauuacaaucaucaggccuauauucacuaucuucagucgucacaguacccucaucuucacucggaacccaaacauacauauguaacguaaaucauaaacccucaaauaccaaaguagacaaaaaaguagaacccaaaagcugugauaaaacacauacauguccaccaugcccagcaccagaacuacuaggaggucccucaguauucuuauuuccuccaaaaccaaaagacacauuaaugauaucaaggacacccgaaguaacuugcguagucguagacguaucacaugaagauccagaaguaaaauucaauugguacguagauggcguagaaguacauaaugcaaaaacaaaaccaagagaagaacaauacaacucuaccuaucgaguaguaucaguuuuaacaguacuacaccaagauuggcuuaacggaaaagaauauaaaugcaaaguaucaaacaaagcacuuccagcacccauagaaaaaacaaucucuaaagcaaaaggacaaccaagagaaccacaagucuauacacucccaccaucuagagaagaaaugacaaaaaaccaaguaucauuaacaugcuuaguuaaaggauucuauccuucagacaucgcaguugaaugggaaucaaacggacaacccgaaaauaacuauaaaacaacaccaccaguacucgacucagacggaagcuuuuuccuauacucaaaauuaacaguagauaaauccagauggcaacaaggaaacguauucuccuguuccguaaugcacgaagccuuacauaaccacuacacccaaaaaagccuaucacuaucaccaggaaaa

SEQ ID NO: 46785 - RNA, 642 nt, Artificial Sequence
  derived and/or modified sequence opt6 from Vesencumab_LightChain1
gacauacaaaugacacaaucaccaucaucacuaucagcaucaguaggagaccgcguaacaauaacaugucgcgcaucacaauacuucucaucauacuuagcaugguaccaacaaaaaccaggaaaagcaccaaaacuacuaauauacggagcaucaucccgagcaucaggaguaccaucaagauucucaggcucaggaucaggaacagacuucacauuaacaauaucaucauuacaaccagaagacuucgcaacauacuacugccaacaauaccuaggaucaccaccaacauucggacaaggaacaaaaguagaaauaaaaagaacaguagccgcaccaucaguauucaucuucccacccucagacgaacaacucaaaucaggcacagcaucaguaguaugcuuacuaaacaacuucuacccaagagaagcaaaaguacaauggaaaguagacaacgcauuacaauccggaaacucacaagaaucaguaacagaacaagacagcaaagacucaacauacucauuaucaucaacacuaacacuaucaaaagcagacuacgaaaaacacaaaguauacgcaugcgaaguaacacaccaaggacuauccucaccaguaaccaaauccuucaacagaggagaaugc

SEQ ID NO: 46786 - RNA, 1338 nt, Artificial Sequence
  derived and/or modified sequence opt6 from Visilizumab_HeavyChain1
caaguacaacuaguacaaucaggcgcagaaguaaaaaaaccaggagcaucaguaaaaguaucaugcaaagccucaggauacacuuucaucucauacacaaugcauuggguaagacaagcuccaggacaaggauuagaauggaugggauacauaaacccacgcucaggauauacccauuauaaccaaaaacuaaaagacaaagccacuuuaacagcagauaaaucagccucaacagcauacauggaauuaucaagucuaagaucagaagacacagcaguuuacuacugcgcuagauccgcauauuaugauuaugacggcuucgcauauuggggacaaggaacacuaguaacaguaucuucagcaagcaccaaaggaccaucaguauuccccuuagcaccaugcucaagaucaacaucagaaucaacagcagcauuaggaugccuaguuaaagacuauuuuccugaaccaguaacaguaucauggaauucuggagcauuaacaagcggaguucacaccuucccagcugucuuacaaucaagcggccuuuacucacucucaucaguaguaacaguaccauccagcaacuucggaacccaaacauacacaugcaacguagaccauaaaccaucaaacaccaaaguagacaaaacaguagaacgaaaaugcugcguagaaugcccuccaugcccagcaccaccagccgcagccccaucagucuuucuuuucccaccaaaacccaaagauacacuaaugauaucacgaaccccagaaguaacaugcguaguuguugacguaagucacgaagauccugaaguacaauucaacugguacgucgacgguguagaaguacacaacgcaaaaacaaaacccagagaagaacaauucaacuccacauuuagaguagucucuguacuuaccguaguacaucaagauugguuaaacgguaaagaauacaaaugcaaaguaucaaacaaaggacugccagcaccaauagaaaaaaccauaucuaaaacaaaaggucaaccacgagaaccacaaguauacacuuuaccacccucaagagaagaaaugacaaaaaaccaaguaucacuaacauguuuaguaaaaggauuuuauccauccgauauagcaguagaaugggaauccaacggacaacccgaaaacaacuauaaaaccacaccaccuauguuagacucugauggaucauucuuccuauacucaaaacucaccguagauaaaucuagauggcaacaaggaaauguauucucauguucaguaaugcaugaagcuuuacauaaucacuauacacagaaaucauuaucccuaucaccaucaaaa

SEQ ID NO: 46787 - RNA, 639 nt, Artificial Sequence
  derived and/or modified sequence opt6 from Visilizumab_LightChain1
gacauacaaaugacacaaucaccaucaucacuaucagccucaguaggagacagaguaacaauaacaugcuccgcaucaucaucaguaucauacaugaacugguaccaacaaaaaccaggaaaagcaccaaaacgacuaauauacgacacaucaaaacuagcaucaggaguaccaagccgauucuccggaucaggcucaggaacagacuucacacucacaauaucaucacuacaaccagaagacuuugcaacauacuacugccaacaauggucaucaaacccaccaacauucggaggaggaacaaaaguagaaauaaaaagaacaguagcagcaccaucaguauucauauucccaccaucagaugaacaacuaaaaucaggaacagcaucaguaguaugccuacuaaacaacuucuacccacgagaagcaaaaguacaauggaaaguagacaacgcacuccaaucaggaaacucacaagaaucaguaacagaacaagacucaaaagacucaacauacagccuaucaucaacauuaacacuaucaaaagcagacuacgaaaaacacaaaguauacgcaugcgaaguaacccaccaaggccuaucaucaccaguaacaaaaucauucaacagaggagaaugu

SEQ ID NO: 46788 - RNA, 1353 nt, Artificial Sequence
  derived and/or modified sequence opt6 from Volociximab_HeavyChain
caaguacaacuaaaagaaucaggaccaggacuaguagccccaucacaaucauuauccaucaccugcacaauaucuggauucucacuaacagacuacggaguacacugggucagacaacccccaggaaaaggucuagaauggcuaguaguaauauggucagauggcucuaguacauacaacucagcucucaaaucaagaaugacaauaagaaaagacaacucaaaaucacaaguauuccuaauuaugaauucauuacaaacagacgacucagcuauguauuacugugcccgucacggaacauacuauggcaugacaacaaccggagaugcucuugacuacuggggacaagguacaucaguaacaguaaguucagcauccacaaaaggaccaucuguauuuccauuagcuccaugcucucgaagcacauccgaaucaacagcugcacucggaugccuaguaaaagauuauuuuccagaaccaguaacagucucuuggaacucaggagcauuaacaucaggaguacauacuuucccagcaguccuacaaaguucaggucuauacucauuaucaaguguaguaacaguaccaucaucaagucuaggaaccaaaacauauacauguaaugucgaccacaaaccuucaaauacaaaagucgauaaaagaguagaaucaaaauacgguccaccuugcccaucaugucccgcccccgaauucuuaggaggaccaucaguauuucuauucccaccuaaaccaaaagauacauuaaugauaaguagaaccccggaaguaaccugugucgucguagauguaucucaagaagacccagaaguccaauucaacugguacguagacggaguagaaguacauaacgccaaaacaaaaccaagagaagaacaauucaacucaacauaccguguaguaucaguucuuaccguacuacaccaagacuggcuaaacggcaaagaauauaaaugcaaaguaucaaacaaagguuuaccuaguucaauagaaaaaacaauaucuaaagcaaaaggacaaccacgagaaccacaaguauacacauuaccacccagccaagaagaaaugacuaaaaaucaagucucauuaacaugccuaguaaaaggauuuuacccaucagauauagccguagaaugggaaucuaacggacaaccagaaaauaauuacaaaaccacaccuccagucuuagauucagacggauccuucuuucuauauucacgauuaacuguagauaaaucacgcuggcaagaaggaaauguauucaguuguucuguaaugcacgaagcccuacauaaccauuacacucaaaaaagucuaucacuaucucuuggaaaa

SEQ ID NO: 46789 - RNA, 645 nt, Artificial Sequence
  derived and/or modified sequence opt6 from Volociximab_LightChain
caaauaguauuaacacaauccccagcaauaaugucagcaucacuaggagaaagaguaacaaugacaugcacagcaucaucaucaguaucauccaacuaccuacacugguaccaacaaaaaccaggaucagcaccaaacuuauggauauacuccacaucaaaccuagcaucaggaguacccgcaagauucucaggaucaggauccggcacaucauacucacuaacaauaucauccauggaagcagaagacgcagcaacuuacuacugccaccaauaccuaagaucaccuccaacauucggagguggaacaaaacuagaaauaaaacgaacaguagcagcaccaucaguauucauauucccaccaucagaugaacaacucaaaucaggaacagcaucaguaguaugccuacuaaacaacuucuacccacgagaagcaaaaguacaauggaaaguagacaacgcacuacaaucaggaaacucacaagaaucaguaacagaacaagacucaaaagacucaacauacucauuaucaucaacauuaacauuaucaaaagcagacuacgaaaaacacaaagucuacgcaugcgaaguaacacaccaaggacuauccucaccaguaacaaaaucauucaacagaggagaaugu

SEQ ID NO: 46790 - RNA, 1344 nt, Artificial Sequence
  derived and/or modified sequence opt6 from Vorsetuzumab_HeavyChain1
caaguacaauuaguacaaagcggagcagaaguaaaaaaaccaggugcuuccguaaaagucuccugcaaagcaucaggauacaccuuuacuaacuauggaaugaacuggguuagacaagcaccaggacaaggacuaaaauggaugggauggauaaauacauacacaggugaaccaaccuacgcagacgcauucaaaggaagagucacaaugacaagagauacaucaauaucuacagcauacauggaacuaucacgacuaagaagugaugauaccgcaguauacuacugcgcaagagacuacggagauuauggaauggauuacuggggacaagguacaaccguaaccguuuccucagcaucaacaaaaggacccucaguauucccacuagcaccauccucaaaaucaacuucuggaggaacagcagcacuaggcuguuuaguaaaagacuauuuccccgaaccaguaacagucucauggaacaguggcgcacuaacaucaggaguacacaccuuccccgcaguauuacaauccagcggauuauacucauuaucuucugucguuacaguaccuucaaguucacuaggaacacaaaccuauauaugcaacguaaaccacaaaccuucuaacacgaaaguagacaaaaaaguagaaccaaaaucaugugacaaaacacauacaugcccaccuugcccagccccagaauuauuaggaggaccuuccguauuucucuuuccaccaaaaccaaaagacacacuaaugaucuccagaacacccgaaguuacaugugucgucguagacguaucacacgaagaccccgaaguuaaauuuaacugguauguagauggaguagaaguacacaaugcuaaaacuaaaccaagagaagaacaauacaacuccacauacagagucguaucaguacuuacaguacuccaccaagacuggcuaaacggaaaagaauauaaauguaaaguaucaaacaaagccuuaccugcccccauagaaaaaacaauuucaaaagccaaaggacaaccuagagaaccccaaguauauacacucccacccucacgagacgaacuaacaaaaaaccaagucucucuaacaugccucguaaaagguuucuacccaucagauauagcaguagaaugggaaucaaacggacaacccgaaaacaacuauaaaacaacaccaccaguauuagacagcgacggaucuuucuucuuauacucaaaacuaacaguugacaaauccagauggcaacaaggaaauguauucucaugcucuguaaugcacgaagcauuacacaaucacuacacacaaaaaucacuuucauuaucucccggcaaa

SEQ ID NO: 46791 - RNA, 654 nt, Artificial Sequence
  derived and/or modified sequence opt6 from Vorsetuzumab_LightChain1
gauauagugaugacacaaucaccagacagucuagcaguaaguuuaggagaaagagcaaccauaaacuguagagcaagcaaaagcguaagcacaagcggauacucauucaugcacugguaccaacaaaaaccaggacaaccaccaaaacuccuaauauacuuagcaucaaauuuagaaagcggaguaccagauagauucucaggaucaggcucaggcacagacuuuacauuaacaauaagcucacuacaagcagaagacguagcaguauacuauugccaacacucaagagaaguaccauggacauucggacaaggaacaaaaguagaaauaaaacgaacaguagcagcaccaagcguauucauauucccaccaucagacgaacaacuaaaaucaggcacagcaucaguaguaugcuuauuaaauaacuuuuacccaagagaagcaaaaguacaauggaaaguagauaacgcacuacaaagcggaaacucacaagaaagcguaacagaacaagauagcaaagacucaacauauagucuaagcucaacauuaacauuaagcaaagcugacuacgaaaaacauaaaguauacgcaugcgaaguaacacaccaaggauuaagcucaccuguaacaaaaagcuuuaacagaggagaaugc

SEQ ID NO: 46792 - RNA, 1344 nt, Artificial Sequence
  derived and/or modified sequence opt6 from Vorsetuzumab_mafodotin_HeavyChain1
caaguucaacuaguacaaucaggagcagaaguuaaaaaacccggagccagugucaaaguaucaugcaaagcaucaggauacacauuuacaaacuacggaaugaauuggguuagacaagcacccggacaaggacuaaaauggaugggauggauaaacacuuauacaggagaaccaacauacgccgaugcuuuuaaaggaagaguuacaaugacacgagacacaucaauaucaaccgcauacauggaauuaucuagacuaagaucagaugacacagcagucuauuacugugcaagagacuacggcgacuacggcauggacuacuggggacaaggaacaacagucacaguaucauccgcaucuacaaaaggucccucgguauucccauuagcuccauccucaaaaucuacaucaggcggaaccgcugcauuaggauguuuaguaaaagauuacuucccagaacccguaacaguaucauggaacuccggagcacuaacaucaggaguacacacauuuccagcaguacuacaaucaucaggcuuauacucacucucaucuguuguaacaguaccaucuucaucacuaggaacccaaaccuacauaugcaauguaaaccacaaaccaagcaacacaaaaguagauaaaaaaguugaacccaaaucaugugauaaaacacacaccugcccaccaugcccugcaccagaauuacucggaggaccaucugucuucuuauucccuccaaaaccaaaagauacuuuaaugauaucaagaacaccagaaguaacauguguuguagucgacguaucccacgaagauccagaaguaaaauuuaacugguacgucgauggaguagaaguucacaaugcaaaaacuaaaccaagagaagaacaauacaauucuacauaccgagucguaucaguacuaaccguacuccaucaagauuggcuaaacggaaaagaauacaaaugcaaaguaucuaauaaagcccuaccagcaccaauagaaaaaacaauaagcaaagcaaaaggacaaccacgagaaccacaaguauacacacucccacccuccagagaugaauuaacuaaaaaccaagucucacuaacaugccuagucaaaggauuuuauccaucagacauagcagucgaaugggaaucaaacggacaaccagaaaauaauuacaaaacaaccccaccaguuuuagacucugacggauccuucuuccuuuauucaaaauuaacaguagacaaaucaagauggcaacaaggaaacguauuuaguugcuccgucaugcacgaagcacuacauaaccacuacacacaaaaaucauuaucauuaucaccaggaaaa

SEQ ID NO: 46793 - RNA, 654 nt, Artificial Sequence
  derived and/or modified sequence opt6 from Vorsetuzumab_mafodotin_LightChain1
gauauaguaaugacacaaucaccagacucacuagcaguauccuuaggagaaagagcaacaauaaauugcagagcaucaaaaucaguaagcacaucaggauacucauucaugcacugguaccaacaaaaacccggacaaccaccaaaacuacuaauauaccuagcaaguaaccuagaauccggaguuccagacagauucucaggcucaggaucaggaacagacuucacacuaacaauaucaucauuacaagccgaagauguagcaguauacuauugccaacacucaagagaaguaccauggacauucggacaaggaacaaaaguagaaauaaaaagaacagucgcagcaccaucuguauucauauuuccaccaucagacgaacaacuaaaaucaggcacagcaucaguaguaugucuacuaaacaacuuuuacccaagagaagcaaaaguacaauggaaagucgacaacgcacuccaaucaggaaacucacaagaaucaguaacagaacaagacucaaaagacucaacauacagccuaucauccaccuuaacacuaucaaaagcagauuacgaaaaacacaaaguauacgcaugcgaaguaacacaccaaggauuaagcucaccaguaacaaaaucauucaacagaggagaaugc

SEQ ID NO: 46794 - RNA, 1347 nt, Artificial Sequence
  derived and/or modified sequence opt6 from Yttrium_(90Y)_clivatuzumab_tetraxetan_HeavyChain1
caaguacaauuacaacaauccggcgccgaaguuaaaaaacccggagcaucaguaaaaguaucaugcgaagcuuccggauauacauuucccuccuacguuuuacacuggguaaaacaagcaccaggacaaggauuagaauggauaggauauauaaauccauacaaugacggaacucaauauaacgaaaaauucaaaggcaaagcaacacuaacacgcgacacuucaauaaauacagcauacauggaacuaucuagacuuagaagugacgacacagcaguauauuauugcgcccgaggauucggaggaaguuauggauucgcauauuggggacaaggaacccuaguaacagucucaucagcaucaacaaaaggaccaucuguauucccacuagccccaucuucaaaaucaacaucaggaggcaccgcugcacuuggaugcuuaguaaaagauuacuucccagaaccaguaacaguuucauggaacucuggagcacuaacaagcgguguacauacauucccagcagucuuacaaucaucaggacuauauaguuuaagcucaguagucaccguaccuucaucuuccuuaggaacacaaacuuauauaugcaauguaaaccacaaaccaaguaacacaaaaguagacaaacgugucgaaccaaaaucaugcgacaaaacacacacaugcccaccaugcccugcaccagaacuauuaggaggaccaaguguauucuuauucccaccaaaaccaaaagacacauuaaugaucucucgaacaccagaaguaacaugcgucgucguagaugucucucacgaagacccagaaguaaaauucaauugguacgucgacggcguugaaguacacaaugcaaaaacaaaaccuagggaagaacaauauaauucaacauacagaguaguaucaguucuuacaguacuacaccaagauugguuaaauggaaaagaauacaaauguaaaguaucaaauaaagcacuaccagcaccaauagaaaaaacuauaucaaaagcaaaaggucaaccaagagaaccacaaguauacacccuaccacccucaagggaagaaaugacuaaaaaccaagucucccuuacaugucuaguuaaaggauucuacccaucagacaucgcaguagagugggaaucaaacggacaaccagaaaacaauuacaaaacaacaccaccagucuuagacucagauggcucauucuuccuauauucuaaacuaaccgucgacaaaucacgcuggcaacaaggaaaugucuucucaugcucuguuaugcacgaagcauuacauaaucauuauacacaaaaaucacuaucccuaucaccaggaaaa

SEQ ID NO: 46795 - RNA, 645 nt, Artificial Sequence
  derived and/or modified sequence opt6 from Yttrium_(90Y)_clivatuzumab_tetraxetan_LightChain1
gacauacaacuaacacaaucaccaucaucauuaucagcauccguaggagacagaguaacaaugacuugcucagcaucaucaucaguaucaucaucauacuuauauugguaucaacaaaaaccaggaaaagcaccaaaacuauggauauacucaacaucaaacuuagcaucaggaguaccagcaagauucucaggauccggaucaggaacagacuucacacuaacaauauccucauuacaaccagaagacucagcaucauacuucugccaccaauggaacagauacccauacacauucggaggaggaacaagacuagaaauaaaaagaacaguagcagcaccauccguauucauauucccaccaucagacgaacaacuaaaaucaggaacagccucaguaguaugccuauuaaacaacuucuacccaagagaagcaaaaguacaauggaaaguagacaacgcacuacaaucuggaaacucccaagaaucaguaacagaacaagacucaaaagacuccacauacucacuaucaucaacucuaacacuauccaaagcagacuacgaaaaacacaaaguauacgcaugcgaaguaacacaccaaggccuaucaucaccaguaacaaaaucauucaaccgaggagaaugu

SEQ ID NO: 46796 - RNA, 1338 nt, Artificial Sequence
  derived and/or modified sequence opt6 from Yttrium_Y_90_epratuzumab_tetraxetan_HeavyChain1
caaguucaauuaguacaaucaggcgcagaaguaaaaaaaccagguucaucuguaaaaguauccugcaaagccuccggauacacauucacaucauacugguugcacuggguaagacaagcaccuggccaaggacucgaauggauaggauauauaaaccccagaaaugacuacacagaauacaaccaaaauuucaaagacaaagcuacuauaacagcagaugaaaguacaaacacugcauacauggaacuaucuucucuaagaucagaagacacagcauuuuacuucugcgcucgccgagacauaaccacauuuuauuggggacaaggcaccaccguaacaguaucaucagcaucaacaaaaggucccucaguauuuccacuagcaccuucaucaaaaucaacaucaggaggaacagcagcauuagguugccuaguaaaagacuacuucccagaaccaguaacaguuucauggaacucaggcgccuuaacuucaggaguacauacauucccagcaguacuacaaucaucaggcuuauacucauuaucaucaguaguaaccguacccuccucaucucuaggaacacaaacauauauaugcaacguaaaccacaaaccaucaaauaccaaaguugacaaaagaguagaaccuaaaucaugcgauaaaacacauacaugcccaccaugcccagcacccgaacuacuuggaggcccaagcguauuccuauuucccccaaaacccaaagacacauuaaugaucucaagaacaccagaaguuacauguguaguaguagacguaucacacgaagacccagaaguuaaauucaacugguauguagacggaguagaaguacacaaugcaaaaacaaaaccaagagaagaacaauacaacucaacauacagagucguaucuguuuuaacaguacuacaccaagacuggcuaaauggcaaagaauacaaaugcaaaguaucaaacaaagcacuaccagcuccaauagaaaaaacaauaucuaaagcaaaaggacaaccccgagaaccacaaguuuacaccuuaccccccucucgagaagaaaugaccaaaaaccaagucucucuaacaugucuaguuaaaggauucuacccaucagacauugcaguagaaugggaaucaaauggacaaccugaaaacaauuacaaaacaacaccacccguacuugauuccgacggaucauucuuccucuacucaaaacuuacuguagacaaaucuagauggcaacaaggaaacguauucucuugcucuguaaugcaugaagcacuacacaaccacuacacacaaaaaucauuaucccugucaccaggaaaa

SEQ ID NO: 46797 - RNA, 657 nt, Artificial Sequence
  derived and/or modified sequence opt6 from Yttrium_Y_90_epratuzumab_tetraxetan_LightChain1
gacauacaacuaacacaaucaccaucaucacuaucagcauccguaggagacagaguaacaauguccugcaaaucaucccaaucaguauuauacucagcaaaccacaaaaacuaccuagcaugguaucaacaaaaaccaggaaaagcaccaaaauuacuaauauacugggcaucaacaagagaaucaggaguaccaucaagauucucaggauccggaucaggaacagacuucacauucacaauaucauccuuacaaccagaagacauagcaaccuacuacugccaccaauaccuaucaucauggacauucggaggaggaacaaaaguacaaauaaaaagaacaguagcagcuccaucaguauucauauucccccccucagacgaacaacuaaaaucaggaacagcaucaguagucugccuacuaaacaacuucuacccaagagaagcaaaaguacaauggaaaguagauaacgcacuacaaucaggaaacucacaagaaucaguaacagaacaagacucaaaagacucuacauacucccuaucaagcacacuaacacucucaaaagcagauuacgaaaaacacaaaguauacgcaugcgaaguaacacaccaagguuuaucaucacccguaacaaaaucauucaaccgaggagaaugc

SEQ ID NO: 46798 - RNA, 1326 nt, Artificial Sequence
  derived and/or modified sequence opt6 from Yttrium_Y_90_epratuzumab_HeavyChain1
caaguacaacucguccaaucaggagcagaaguaaaaaaaccaggaucaucaguaaaaguaucaugcaaagccucaggcuauaccuucacaucauauuggcuacacuggguacgacaagcacccggccaaggcuuagaauggauaggguacauaaacccaagaaacgacuacacagaauauaaccaaaacuuuaaagacaaagcuacaauaacagcagacgaauccacaaauacagcauaugaacuaucaucauuaagauccgaagacacagccuucuacuucugcgcaagacgagacauaacaacauuuuacuggggacaaggaaccacaguaacaguaucauccgcaucuaccaaagguccuucagucuucccuuuagccccaucaucaaaaagcacaucaggaggaaccgccgcacuuggaugcuuagucaaagacuacuuuccugaacccguaaccguaucauggaacucuggugcucuaacaucaggaguacacacauuuccagccguacuacaaucauccggcuuauacucauuaucaucaguaguaaccgucccauccucaucacuaggcacacaaacauacauaugcaacguaaaucauaaaccaucaaauaccaaaguugacaaacgugucgaaccaaaaucaugcgacaaaacacauacaugcccacccugcccagcaccagaauuacuaggugguccuuccgucuuccuauucccacccaaaccuaaagacacccuaauaucuagaacaccagaagucacuugcguagucguagacguaucacacgaagacccagaagucaaauuuaacugguacgucgacggaguagaaguucacaaugcaaaaacaaaacccagagaagaacaauauaacucuacauacagaguaguuuccguccuaacaguccuacaccaagacuggcucaauggaaaagaauacaaaugcaaaguaucaaacaaagcuuuaccagcaccaauagaaaaaacaauaucaaaagcaaaaggacaaccuagagaaccacaaguauacacccuaccuccaucaagagaagaaacaaaaaaccaaguuucauuaacaugcuuaguaaaagguuucuauccaucagacauugcaguagaaugggaauccaacggacaaccagaaaacaacuacaaaacuacaccaccaguuuuagacuccgacggaucauuuuuccuauacagcaaacuuacaguagacaaaucacgauggcaacaaggaaacguauuuucaugcuccguacacgaagcccuacacaaucacuauacccaaaaaucucucucucucucaccaggaaaa

SEQ ID NO: 46799 - RNA, 654 nt, Artificial Sequence
  derived and/or modified sequence opt6 from Yttrium_Y_90_epratuzumab_LightChain1
gacauacaacuaacacaaucaccaucuucacuauccgcaucaguaggcgacagaguaacaucaugcaaaucaucccaaucaguauuauacucagcaaaccacaaaaacuacuuagcaugguaccaacaaaaaccaggaaaagcaccaaaacuacuaauauacugggccuccacaagagaaucaggaguaccauccagauucuccggaucaggauccggaaccgacuucacauucacaauaucaucacuacaaccagaagacauagcaacauacuacugccaccaauacuuaucauccuggacauucggaggaggaacaaaaguacaaauaaaaagaacaguagcagcaccaucaguauuuauauucccaccaucagacgaacaauuaaaaucaggaacagcaucaguaguaugccuacuaaacaacuucuacccaagagaagcaaaaguacaauggaaaguagacaacgcccuacaaagcggaaacucacaagaaucaguaacagaacaagacucaaaagacucaacauacucacuaucaucaacccuaacacuaucaaaagccgacuacgaaaaacacaaaguauacgcaugugaaguaacacaccaaggauuauccucaccaguaacaaaaucauuuaacagaggagaaugc

SEQ ID NO: 46800 - RNA, 1365 nt, Artificial Sequence
  derived and/or modified sequence opt6 from Zalutumumab_HeavyChain1
caaguacaauuagucgaaucagguggaggaguaguacaaccugggagaucauuacgauuaucaugugcugcgucaggauuuacauuuaguacuuauggcaugcauuggguaagacaagcaccaggaaaaggacuagaauggguugcaguaaucugggaugauggcucauacaaauauuauggagauagcguaaaaggcagauuuacuauuucaagagauaauagcaaaaacacauuauacuuacaaaugaauagcuuaagagccgaagauacagcuguuuauuacugugcuagagacggaaucacaaugguaagaggaguaaugaaagacuauuuugauuacuggggacaaggaacacuaguuacgguaucaagugcuucaacaaaaggaccaucaguguuuccacuagcaccaucaucaaaaucaacaucuggaggaacugcagcauuaggaugucuugucaaagauuacuucccagaaccaguaaccguuucauggaauuccggcgcauuaacauccggaguacauacauuucccgccguauuacaaucaagcggauuauacagcuuaucaucaguaguuacuguaccaucaucaucucuagguacucaaacauacauauguaacguaaaccauaaaccaagcaauacuaaaguagauaaaagaguagaaccaaaaagcugcgacaaaacacauacauguccaccauguccagccccagaauuacuaggaggacccucaguauuuuuauucccaccaaaaccaaaagauacauuaaugauaaguagaacaccugaaguuacuuguguaguaguagacguaucacaugaagauccagaagucaaauucaauugguauguagauggaguagaaguacacaacgccaaaacaaaaccacgagaagaacaauauaacucaacuuauagaguaguaucaguacuaacaguacuccaucaagacugguuaaacggaaaagaauauaaauguaaaguaucaaacaaagcauuaccagcaccuauagaaaaaaccauuucaaaagcaaaaggacaaccucgagaaccacaaguauauacauuaccaccuaguagagaagaaaugacaaaaaaccaaguuucccuaacauguuugguaaaaggauuuuauccuucugauauagcaguagaaugggaauccaauggacaaccagaaaacaauuauaaaacaacacccccaguacuagacucagacggaucauuuuuucuguauucaaaauuaacaguagauaaaucaagauggcaacaaggaaauguauuuucaugcagcguaaugcaugaagccuugcauaaucacuauacacaaaaaagucucucauuaucaccuggcaaa

SEQ ID NO: 46801 - RNA, 642 nt, Artificial Sequence
  derived and/or modified sequence opt6 from Zalutumumab_LightChain1
gcaauacaacuaacacaaucaccaucaucacuaagugcaagcguaggagacagaguaacaauaaccugccgagcaucccaagacauauccucagcccuagucugguaccaacaaaaaccaggaaaagcaccaaaacuacuaauauacgacgcaucaucacuagaaucaggaguaccaucaagauuuucaggaucagaaucaggaacagacuucacacuaaccauauccucacuacaacccgaagacuucgcaacauacuacugccaacaauucaauucauacccacuaacauucggaggaggaacaaaaguagaaauaaaacguacaguagcagcaccaucaguauuuauauucccaccaucagacgaacaacuaaaaucaggaacagcaucaguaguaugcuuacucaacaacuucuacccaagagaagcuaaaguacaauggaaaguagacaacgcauuacaauccggaaacucacaagaaucaguaacagaacaagacucaaaagacucaacauacagccuaucaucaacacuaacacuaucaaaagcagacuacgaaaaacacaaaguauacgcaugcgaaguaacacaccaaggacuauccucaccaguaaccaaaucauucaacagaggagaaugc

SEQ ID NO: 46802 - RNA, 1332 nt, Artificial Sequence
  derived and/or modified sequence opt6 from Zanolimumab_H0_HeavyChain
caaguacaacuacaacaauggggagcaggcuuacuaaaaccauccgaaacuuuaucacuaacaugugcaguauacggcgguuccuuuucaggauacuacuggucauggauaagacaaccaccaggaaaaggccuagaauggauaggagaaauaaaccacucaggaucaacaaacuacaacccaucacuaaaaucaagaguaacuauauccguagauacaucaaaaaaccaauucucacuaaaacuuucaucugucacagcagcagacaccgcaguauacuacugcgcacguguaauaaacugguucgaccccuggggacaaggaacacugguuaccguaucuucagcgucuacaaagggcccaaguguauucccacuagcaccuucaucuaaaucaacaucaggaggaaccgccgcacuaggaugucuagucaaagacuacuuccccgaacccgucacaguuucauggaauuccggagcacuaacauccggaguacacacauucccagcaguauuacaauccucaggccuauacucacuaucaucauggacugucccauccucaucacuuggaacacaaacuuacauuugcaauguaaacuuuauaaaaccaucaaauaccaaaguugacaaaaaagucgaaccaaaaucaugcgacaaaacccacaccugcccacccuguccugcacccgaacuacuaggaggaccaucaguauuucuauuucccccaaaaccaaaagauaccuuaaugauaucuagaacaccagaagucacaugcguuugggacguaucucaugaagauccugaagugaaauucaacugguacguagauggcguagaaguccauaacgcaaaaacuaaaccaagagaagaacaauacaacucaacuuaccgagucguauccguacuaaccguccuacaccaagauugguuaaauggaaaagaauacaaauguaaaguaucaaauaaagcacucccagcaccaauagaaaaaacaauaucaaaagcaaaaggacaaccuagagaaccacaaguauauacauuaccaccaucuagagaagaaaugacaaaaaaucaagucucauuaaccugccuaguaaaaggauucuauccaucagacauagcaguagaaugggaaucaaauggucaaccagaaaauaauuacaaaacuacaccaccuguucucgacucagauggaucauucuuucuauacucaaaauuaacaguagacaaaucaagauggcaacaaggaaacguauucucaugcuccguaaugcaugaagcauuacacaaucauuacacacaaaaaucccuaagccuaucaccaggaaaa

SEQ ID NO: 46803 - RNA, 642 nt, Artificial Sequence
  derived and/or modified sequence opt6 from Zanolimumab_L0_LightChain
gacauacaaaugacacaauccccaucaucaguaucagcaucaguaggagacagaguaacaauaaccugcagagccucacaagacauaucuucaugguuagcaguaguauaccaacacaaacccggaaaagcaccaaaacuacuaauauacgcagcauccucauuacaaucaggaguacccucacgauucucaggaucaggaucaggaacagacuucacacuaacaauaucaucuuuacaaccagaagacuucgcaacauacuacugccaacaagcaaacucauucccauacacauuuggaggaggaacaaaacuagaaauaaaaagaacaguagcagcaccaucaguauucauauucccaccaucagacgaacaacuaaaauccggcacagcaucaguaguaugccuacuaaacaacuucuacccaagagaagcaaaaguacaauggaaaguagacaacgcauuacaaucaggcaacucacaagaauccguaacagaacaagacucaaaagacucaacauacucauuaucaucaacacuaacacuaucaaaagcagacuacgaaaaacacaaaguauacgcaugcgaaguaacacaccaaggacuauccucaccaguaacaaaauucaacagaggagaaugc

SEQ ID NO: 46804 - RNA, 1344 nt, Artificial Sequence
  derived and/or modified sequence opt6 from Zatuximab_HeavyChain1
caaguacaacuccaacaaccaggagccgaacucguagaaccuggagguucaguaaaacuuucaugcaaagcaucaggauauaccuucacaucccacuggaugcacugggugaaacaacgaccuggccaaggacuagaauggauaggagaaauuaacccaaguucaggacgaaacaacuacaacgaaaaauuuaaaucuaaagcaacacuaacaguagacaaaucaaguucuacagcauacaugcaauucucaucccuaacaucagaagacuccgcuguauacuacugcguacgcuauuacggauaugacgaagcaauggacuauuggggacaaggaacaucaguaacuguuucauccgcaaguacaaaaggaccaucaguauucccacuagccccuuccucaaaaucaacaucuggcggaacugcagcacuaggcuguuuaguaaaagacuacuuucccgaaccagucacaguaaguuggaauucuggagcccuaacaagcggaguacacacauucccagcagucuuacaauccucaggacuauauaguuuaagcucaguaguaaccguaccuucaucaucucuaggaacacaaacauauauauguaauguaaaucauaaaccaucaaauacuaaaguagacaaaagagucgaacccaaaucuugcgacaaaacacacacaugcccaccaugccccgccccagaacuacuaggcgguccaucaguauuucuauucccaccaaaaccaaaagauacacuaaugauaucuagaacaccagaaguaacaugcguaguaguagacguaagccaugaagacccagaaguaaaauucaacugguauguagacggaguagaaguacacaaugccaaaacaaaaccaagagaagaacaauacaauucaacauacagaguaguuucuguauuaacaguacuacaucaagacuggcuaaacgguaaagaauauaaauguaaagucucuaauaaagcacuaccugcaccaauagaaaaaaccauaucuaaagcaaaaggccaaccaagggaaccacaagucuauacauuaccaccaucacgagaagaaaugacaaaaaaucaagucuccuuaaccugucuaguaaaaggauucuacccaucagacaucgcaguagaaugggaaucaaauggccaaccagaaaacaauuacaaaacaacaccaccaguacuagacucagacggaucauucuucuuauacuccaaauuaacaguagacaaaagccgauggcaacaaggaaacguuuuuucaugcucaguaaugcaugaagcacuacacaaucacuacacacaaaaaucccuaucguuaucacccgga

SEQ ID NO: 46805 - RNA, 657 nt, Artificial Sequence
  derived and/or modified sequence opt6 from Zatuximab_LightChain1
gacauaguaaugacacaagcagcauucucaaacccaguaacauuaggaacaucagcaucaauaucaugcagaagcucaaaaucacuacuacacucaaacggaauaacauaucuauacugguaccuacaaaaaccaggccaaucaccacaauuauuaauauaccaaaugucaaaccuagcaucaggaguaccagacagauucucaucaucaggaucaggaaccgacuucacacuaagaauaagcagagucgaagccgaagacguaggaguauacuacugcgcacaaaaccuagaacuaccauacacauucggcggaggaacaaaauuagaaauaaaaagaacaguagcagcaccaucaguauucauauucccaccaucagacgaacaacuaaaaucaggaacagcaucaguaguaugcuuacuaaacaacuucuacccaagagaagcaaaaguccaauggaaaguagacaacgcacuacaaucaggaaacucacaagaaucaguaacagaacaagacucaaaagacuccacauauucacuauccucaacacuaacauuaucaaaagcagacuacgaaaaacacaaaguauacgcaugcgaaguaacacaccaaggauuaucaagccccguaacaaaauccuucaaccgaggagaaugc

SEQ ID NO: 46806 - RNA, 1356 nt, Artificial Sequence
  derived and/or modified sequence opt6 from Actoxumab_HeavyChain
caaguacaauugguagaaucaggaggcggaguaguacaaccaggaagaucacuuagacuaucaugcgcagcaucaggauucucauucuccaauuacggaaugcacuggguccggcaagcgccagggaaaggacuagaauggguagcacuaauaugguacgacggaaguaacgaagacuacacagauagcguaaaaggaagauucacaauuucaagagacaacucuaaaaacacauuauaccuccaaaugaacucuuuaagagcagaagauacagcaguauacuacugcgcuagaugggguaugguuagaggaguaauagauguuuuugacaucuggggacaaggaacaguaguaaccguaucuucagcaaguacaaaaggaccaucaguauucccacuagcucccaguucuaaaucaacaucaggaggcacagccgcacuaggauguuuaguaaaagacuauuuuccagaaccaguaacuguaucauggaauagcggagcauuaacaaguggaguacacacauuuccagcaguauuacaaucauccggacuauauagcuuaucaucuguaguuacaguaccaucaucaucauugggaacacaaacauacaucugcaauguaaaucauaaaccuucaaacacaaagguagauaaaagaguagaaccuaaaucaugugacaaaacacacacaugucccccaugcccagcaccagaauuauuaggaggaccaucaguauuccuauucccaccaaaacccaaagacacacuaaugauaucacgaacaccugaaguaacaugcguaguaguagauguaagucaugaagauccagaagucaaauucaacugguacguagauggcguagaaguacauaaugcaaaaacaaaaccuagagaagaacaauacaacucaacauauagagucguaucaguauuaacaguauuacaccaagacugguuaaacggaaaagaauauaaaugcaaaguaucaaacaaagcacuaccagcaccaauagagaaaacaauauccaaagcuaaaggccaaccaagagaaccacaaguauacacauuaccuccaucaagggaagaaaugaccaaaaaccagguaucucuaacauguuuaguaaaaggauuuuacccaagugacauagcuguagaaugggaaaguaacggacaaccagaaaacaacuacaaaacaacacccccagucuuagacucagacggaucauucuuccuauauucaaaauuaacaguagauaaaaguagauggcaacaaggaaauguauucucaugcaguguaaugcaugaagcacuccacaaucacuauacacaaaaaucacuaucacuaucaccaggaaaa

SEQ ID NO: 46807 - RNA, 642 nt, Artificial Sequence
  derived and/or modified sequence opt6 from Actoxumab_LightChain
gacauacaaaugacacaaucaccaucaucaguaucagcaucaguaggagaccgaguaacaauaacaugcagagcaucacaaggaauauccucauggcuagcaugguaccaacauaaaccaggaaaagcaccaaaacuauuaaucuacgcagcaucaucacuacaaucaggaguaccaucaagauucucaggaucaggaucaggaacagacuucacacuaaccaucucaucauuacaaccagaagacuucgcaacauacuacugccaacaagcaaacucauucccauggacauucggacaaggaacaaaaguagaaauaaaaagaacaguagcagccccaucaguauucauauucccaccauccgaugaacaacuaaaaucaggaacagcauccgucguaugccuauuaaacaacuucuacccaagagaagccaaaguacaauggaaagucgacaaugcucuacaaagcggaaacucacaagaaucaguaacagaacaagacaguaaagacucaacauacagucuaucaucaacacuaacacuaucaaaggcagacuacgaaaaacacaaaguauacgcaugcgaaguaacacaucaaggacuaucaucaccaguaacaaaaucauucaacagaggagaaugc

SEQ ID NO: 46808 - RNA, 1326 nt, Artificial Sequence
  derived and/or modified sequence opt6 from Andecaliximab_HeavyChain
caaguccaguuacaagaaucaggacccgguuuaguaaaaccaagugaaacuuuaucacugacauguaccguauccggauucucacuauuaucauauggaguacacugggucagacaaccaccagguaaaggacucgaaugguuaggcguaaucuggacagguggcacuaccaacuauaauucagcacuaaugaguagauucacuauaagcaaagacgacuccaaaaauaccguauaucucaaaaugaacucacuaaaaaccgaagauacagcaauauacuauugcgcaagauauuauuacggaauggauuauuggggacaagguacucuaguaacaguaucaucagcaucaacaaaaggaccuucaguauucccauuagcaccuuguucacgaaguacaucagaaucaaccgcagcgcucggauguuuaguuaaagauuacuucccagaaccaguaacaguaaguuggaacucaggagcucuaaccucaggcguacacacauuuccagcaguacuacaaucaucagguuuauacucccuaucaucagucguaacaguaccaucaucaucauuaggaacaaaaacauauacaugcaacguugaccacaaacccucaaauacaaaaguagauaaaagaguagaaucaaaauacggaccaccuuguccaccauguccagcaccagaauuucuuggugggcccuccguauucuuauuuccaccaaaaccaaaagauacacucaugauaucuagaacaccagaaguaacaugugucguuguagaugucucccaagaagauccugaaguacaauuuaauugguauguugauggugucgaaguacauaacgcuaaaacaaaaccucgcgaagaacaauuuaacucaacauaccgcguagucuccguauuaacaguacuacaccaagacuggcuaaaugguaaagaauauaaauguaaaguaucaaacaaaggauuaccaucaucaauagaaaagacaauauccaaagcaaaaggacaaccaagagaaccacaaguauauacauuaccaccaucacaagaagaaaugacuaaaaaucaaguaucacuaacaugucuaguaaaaggauuuuauccauccgacauagcaguugaaugggaaucgaacggacaaccagaaaauaauuacaaaacaacaccaccgguauuagauucagauggaucauucuucuuauauagcagacuaacaguagauaaaucuagauggcaagaaggaaauguauuuucauguuccguaaugcaugaagcauuacauaaccauuauacucaaaaaucauuaagucuaucacucggaaaa

SEQ ID NO: 46809 - RNA, 642 nt, Artificial Sequence
  derived and/or modified sequence opt6 from Andecaliximab_LightChain
gacauacaaaugacacaaucuccaucaucacuaucagcaucagucggagacagaguaacaauaacaugcaaagcaucacaagacguaagaaauacaguagcaugguaccaacaaaaaccaggaaaagcaccaaaacuacuaauauacagcaguucauacagaaacacaggaguaccagacagauuuucaggaucaggaucaggaacagacuucacacuaaccauauccucacuacaagccgaagacguagccguauacuacugccaacaacacuacauaacaccauacacauucggaggcggaacaaaaguagaaauaaaaagaacaguagcagcaccaucaguauucauauuuccaccaucagacgaacaacuaaaaucaggaacagcaucaguaguaugccuauuaaauaacuucuaccccagagaagcaaaaguacaauggaaaguagacaacgcacuacaaucaggaaacucacaagaaucaguaacagaacaagacucaaaagacucaacauacucauuaagcucaacauuaacuuuaucaaaagcagacuacgaaaaacauaaaguauacgcaugcgaaguaacacaccaaggauuaucaucaccaguaacaaaaucauucaacagaggagaaugc

SEQ ID NO: 46810 - RNA, 1353 nt, Artificial Sequence
  derived and/or modified sequence opt6 from Aprutumab_HeavyChain
gaaguacaauuauuagaaucaggugguggauuaguacaaccaggaggaucucuaagauuaucaugcgcagcaucaggcuucacauucucaagcuaugcaauguccuggguaagacaagcaccuggaaaaggauuagaauggguaucagcaauaucaggaucaggaacgucaacauauuacgcugacuccguaaaaggacgcuucacaaucuccagagauaacucaaaaaacacuuuauaccuacaaaugaacucauuaagagcagaagacacagcaguuuacuacugugcucgaguucguuacaauuggaaucacggagacugguucgacccauggggacaagguacauuaguaacaguaagcucagcaucaacaaaaggaccaucugucuuuccauuagcaccaaguucaaaauccacaucaggcggaacagcagcacuaggaugucuaguaaaagacuauuuccccgaacccguaacaguaucauggaauucaggugcacuaacaucuggaguucauacuuucccagcaguauuacaauccucaggacuauacuccuuaucauccgucguaacaguccccucaucaucccuuggaacucaaacauauaucugcaacgugaaccacaaaccaucaaauacaaaaguugacaaaaaaguagaaccaaaaucaugcgacaaaacucacacuugcccacccuguccagcaccagaauuauuaggaggaccaucaguauucuuauuuccaccaaaaccaaaagacacucuaaugauaucaaggacacccgaaguaaccugcgucguaguugacguuagucacgaagacccagaaguuaaauucaacugguacguagacggaguagaaguacauaacgcaaaaacaaaaccuagagaagaacaauacaacucaacauacagaguaguaucaguauuaacaguacuacaucaagacugguuaaacggaaaagaauauaaaugcaaaguaucaaauaaagcacuaccagcaccaauagaaaaaaccaucuccaaagcaaaaggacaacccagagaaccacaaguauacacucuaccaccaucaagagaugaacuaacaaaaaaucaaguaagccuaacuugccuuguuaaaggcuucuacccaucagacaucgcuguagaaugggaauccaacggucaaccugaaaauaacuacaaaacaacccccccaguuuuagauucagauggaagcuuuuuuuuauauuccaaauuaacuguagauaaauccagauggcaacaaggaaacguauucuccuguucuguaaugcacgaagcucuacacaaccauuacacccaaaaaucacucagccuaucaccagga

SEQ ID NO: 46811 - RNA, 648 nt, Artificial Sequence
  derived and/or modified sequence opt6 from Aprutumab_LightChain
caaucaguacuaacccaaccacccuccgcaucaggaacaccaggacaaagaguaaccauauccugcuccggauccucaucaaacauaggaaacaacuacguaucaugguaccaacaacuaccaggaacagcaccaaaacuacuaaucuacgaaaacuacaacagaccagcuggagucccagacagauucucaggaucaaaaucagguacauccgcaucacuagcaauaucaggacuaagaucagaagacgaagcagacuacuacugcucaagcugggaugacucacuaaacuacuggguauucggaggaggaacaaaauuaaccguacuaggacaaccaaaagcagcaccauccguaacacuauucccccccucauccgaagaacuacaagcaaacaaagcaacacuaguaugccuaauaucagacuucuacccaggagcagucacaguagcauggaaagcagacucaucaccuguaaaagcaggagucgaaacaacaacaccaucaaaacaaucaaacaacaaauaugcagcaucaucauaccuaucacucacaccagaacaauggaaaucacaccgauccuacucaugccaaguaacacacgaaggaucaacaguagaaaaaacaguagcaccaacagaaugcuca

SEQ ID NO: 46812 - RNA, 1341 nt, Artificial Sequence
  derived and/or modified sequence opt6 from Azintuxizumab_HeavyChain
gaaguccaacuaguagaaucaggaggcggauuaguucaacccggaggcucccuaagauuaucuugcgcagcaucuggauuuacauucucagacuacuauauggccugggucagacaagcaccagguaaaggacuagaauggguagcaucaauaaacuaugacggauccagcaccuauuauguagacuccgucaaaggacgauucacaauaucaagagauaacgcaaaaaauucacucuaucuacaaaugaacucacuaagagcagaagacacagcaguauacuacugcgcaagagacagaggauauuauuuugauuacuggggacaaggaacaacaguaacuguaagcucagccucaacaaaaggcccaucaguuuucccauuagccccaucuuccaaaucuacaaguggugguaccgcugcacuagguugccuuguaaaggauuauuucccagaaccagucacaguauccuggaacagcggcgcauuaacauccggcguccacacauucccagcaguauuacaauccuccgguuuauauagcuuaucaucagucguaacaguacccuccucaaguuugggaacacaaacuuacauaugcaacguaaaccauaaaccaucaaacacuaaaguagacaaaaaagucgaaccaaaaucaugcgacaaaacacacacaugcccacccugccccgcaccagaacuacucggagguccaucuguauuuuuauucccaccaaaaccuaaagauacccuaaugauaucacguacaccagaaguuacauguguaguaguagacgucucacaugaagauccugaaguaaaauuuaauugguacgucgacggaguagaaguacauaaugccaaaacuaaaccaagagaagaacaauauaacucaacuuacagaguaguuagcguacuaacaguauuacaccaagacugguuaaauggaaaagaauacaaauguaaaguaucaaacaaagcacuuccugcaccaauagaaaaaacaauaucuaaagcaaaaggacaaccaagagaaccccaaguauauacacuaccaccuagcagagaagaaaugacuaaaaaucaaguauccuuaacauguuuaguaaaaggauucuauccaucagacauagcaguagaaugggaaucaaacggacaaccagaaaauaacuauaaaacuacaccaccuguacuagauucagauggaucauuuuuucuauauucuaaacuaacaguagauaaauccagauggcaacaaggaaauguauucaguuguucaguaaugcaugaagcauuacauaaccacuacacacaaaaaucccuaucauuauccccuggaaaa

SEQ ID NO: 46813 - RNA, 660 nt, Artificial Sequence
  derived and/or modified sequence opt6 from Azintuxizumab_LightChain
gaugucguaaugacacaaacaccauuaucacuaucaguaacaccaggacaaccagcaucaauaucaugcagaucaucacaaagccuaguacauucaaauggaaacacauauuuacauugguaucuacaaaaaccaggacaaucaccccaacuauuaauauacaaaguaucaaacagauucucaggaguaccagacagauucuccggauccggauccggaacagacuucacacuaaaaauaucaagaguagaagcagaagacguaggcguauacuucugcucacaaucaacacacguaccaccauucacauucggaggaggaacaaaaguagaaauaaaaagaacaguagcagcaccaucaguauucauauuuccaccaucagacgaacaacuaaaaucaggaacagcaucaguaguaugcuuacuaaacaacuuuuacccacgagaagcaaaaguacaauggaaaguagacaacgcacuucaaucaggaaacucacaagaauccguaacagaacaagacucuaaagacucaacauacucauuaucaucaacacuaacccuaucaaaagccgacuacgaaaaacacaaaguauacgcaugcgaaguaacacaccaaggauuaucaucaccaguaaccaaaucauucaacagaggagaaugu

SEQ ID NO: 46814 - RNA, 366 nt, Artificial Sequence
  derived and/or modified sequence opt6 from Blinatumomab_HeavyChain1
caaguacaauuacaacaaaguggagcagaauuaguaagaccaggaaguaguguaaaaauaaguuguaaagcaaguggauaugcauuuaguaguuauuggaugaauuggguaaaacaaagaccaggacaaggauuagaauggauaggacaaauauggccaggagauggagauacaaauuauaauggaaaauuuaaaggaaaagcaacauuaacagcagacgaaaguaguaguacagcauauaugcaauuaaguaguuuagcaagugaagauagugcaguauauuuuugugcaagaagagaaacaacaacaguaggaagauauuauuaugcaauggauuauuggggacaaggaacaacaguaacagua

SEQ ID NO: 46815 - RNA, 363 nt, Artificial Sequence
  derived and/or modified sequence opt6 from Blinatumomab_HeavyChain2
gacauaaaacuacaacaaucaggagcagaacuagcaagaccaggagcaucaguaaaaaugucaugcaaaacaucaggauacacauucacaagauacacaaugcacuggguaaaacaaagaccaggacaaggacuagaauggauaggauacauaaacccaucaagaggauacacaaacuacaaccaaaaauucaaagacaaagcaacacuaacaacagacaaaucaucaucaacagcauacaugcaacuaucaucacuaacaucagaagacucagcaguauacuacugcgcaagauacuacgacgaccacuacugccuagacuacuggggacaaggaaccacacuaacaguaucaucaguagaa

SEQ ID NO: 46816 - RNA, 1494 nt, Artificial Sequence
  derived and/or modified sequence opt6 from Blinatumomab_LightChain_HeavyChain_HeavyChain_LightChain
gauauacaacuaacacaaaguccagcaagucuagcaguaucacuaggacaaagagcaacaauaucauguaaagcaucacaaagcguagauuaugauggugauucauaucuaaauugguaucaacaaaucccaggacaaccaccuaaacuacuaauauaugaugcaucaaauuuaguaagcgguauaccaccuagauuuaguggaagugguucaggaacagauuuuacuuuaaauauacacccagucgaaaaaguagacgcagcaacuuaucauugucaacaaucaacagaagauccuuggaccuuuggaggcggaacaaaauuagaaauaaaagggggaggaggaucaggaggaggaggaucagguggcggaggaucacaaguacaauuacaacaaucaggagcagaauuaguuagaccaggaagcucaguaaaaauaucauguaaagcaucaggauaugcauuuucaaguuauuggaugaacugggucaaacaacgaccaggacaaggucucgaguggauaggacaaauauggccaggagacggugauacaaacuauaaugguaaauucaaaggaaaagcaacacuuacagcugaugaaucaucaucaacagcauacaugcaauuaaguucucuagcaucagaagacucagcaguauauuuuugugcccgaagagaaacaacaacaguaggaagauauuauuaugcuauggacuauuggggccaaggaaccacagucacagugagcucaggaggaggaggaucagauauuaaacuacaacaaucaggagcagaauuagcaagaccaggagcaaguguuaaaaugucuuguaaaacaucuggauauacauuuacacgauauacaaugcauuggguaaaacaaagaccaggacaaggacuagaauggauuggauauauaaauccaucacgagguuacacaaacuauaaucaaaaauuuaaagauaaagcaacucuaacaacugauaaaagcagcucaacagcuuacaugcaacuaaguucauugacaagcgaggauucagcaguauauuacugugcaagauauuaugacgaccauuacugucuagacuauuggggucaagguacaacucugacagucuccucuguagaaggaggaagugguggaagcggaggaucagguggaucaggaggaguagaugauauacaauuaacacaaucaccagcaauaaugucagccagcccaggagaaaaaguaacaaugacgugcagagcaaguagcaguguaucauauaugaauugguaucaacaaaaauccggcacaagcccuaaaagauggauauaugacacaaguaaaguagcuucuggaguuccauaucgauuuucuggaaguggaucaggaacaaguuauucauuaacaauaucgucuauggaagcagaagaugccgcuacguauuacugucaacaauggagcagcaauccucuaacuuucggagcaggaacaaaacuagaauuaaaa

SEQ ID NO: 46817 - RNA, 333 nt, Artificial Sequence
  derived and/or modified sequence opt6 from Blinatumomab_LightChain1
gacauacaacuaacacaaucaccagcaucacuagcaguaucacuaggacaaagagcaacaauaucaugcaaagcaucacaaucaguagacuacgacggagacucauaccuaaacugguaccaacaaauaccaggacaaccaccaaaacuacuaauauacgacgcaucaaaccuaguaucaggaauaccaccaagauucucaggaucaggaucaggaacagacuucacacuaaacauacacccaguagaaaaaguagacgcagcaacauaccacugccaacaaucaacagaagacccauggacauucggaggaggaacaaaacuagaaauaaaa

SEQ ID NO: 46818 - RNA, 324 nt, Artificial Sequence
  derived and/or modified sequence opt6 from Blinatumomab_LightChain2
guagacgauauacaacuaacacaaucaccagcaauaaugagcgcaagcccaggagaaaaaguaacaaugacauguagagcaagcucaagcguaaguuauaugaauugguaucaacaaaaaucaggaacaagcccaaaaagauggauauacgauacaucaaaaguagcaucaggaguaccauauagauuuaguggaagcggaagcggaacaucauacucacuaacaauaucaagcauggaagcagaagaugcagcaacauauuacugucaacaauggucaagcaauccauuaacauuuggagcaggaacaaaauuagaauuaaaa

SEQ ID NO: 46819 - RNA, 1350 nt, Artificial Sequence
  derived and/or modified sequence opt6 from Brazikumab_HeavyChain
caaguacaacuaguagaaucagguggaggaguaguacaacccggaagaucacuaagacuaucaugcgccgcauccggauuuaccuuuagcucuuauggaaugcauugggugaggcaagcaccuggaaaaggucuagaauggguagcaguaauaugguacgacggcucuaaugaauauuaugccgacagcgucaaaggacgauucacaauuucuagagauaauucaaaaaauacucuauauuuacaaaugaacucacuaagagccgaagauacugcuguuuacuacugugcccgugauagaggauauacuucaucaugguauccagaugcauuugauauauggggacaagguacaaugguaacaguaucuuccgcaucaacaaaaggaccaagcguauuuccccuagccccaugcuccagaucaacaucugaaucaacagccgcacuaggaugccuaguaaaagauuacuuuccagaaccaguaacuguaagcuggaacucuggagcauuaacaucaggaguucacacuuuuccagcaguccuacaaucuucuggauuauacucacuauccucaguaguaaccguuccaucaucaaauuucggaacacaaacauauacaugcaauguagaucauaaaccaagcaauacaaaaguugauaaaacaguagaaagaaaauguuguguugaaugcccacccugcccagccccaccaguagcuggaccaucaguauucuuauuuccacccaaaccaaaagacacacuaaugauuucaagaacuccugaaguaacuuguguaguaguagaugucucccaugaagauccugaaguacaauuuaacugguauguagacggaguagaaguacacaaugcaaaaacaaaaccuagagaagaacaauuuaauucaacauuccgaguuguaucaguauuaacaguaguccaucaagauugguuaaacggaaaagaauauaaaugcaaaguaucaaauaaaggauuaccagcaccuauagaaaaaacaauaucaaaaacaaaaggccaaccaagagaaccacaaguauauacacuuccaccuucaagagaagaaaugacuaaaaaccaaguaucuuuaacauguuuaguaaaaggauuuuacccuuccgauauagcaguagaaugggaaaguaauggacaaccagaaaacaauuacaaaacaacacccccaaugcuagacucagacggaucuuuuuucuuauacucaaaacucacaguagacaaaagcagauggcaacaaggaaacguguucucuuguucagucaugcacgaagcauuacauaaucacuauacacaaaaaucacuaucacuaucucccggaaaa

SEQ ID NO: 46820 - RNA, 651 nt, Artificial Sequence
  derived and/or modified sequence opt6 from Brazikumab_LightChain
caaucaguccuaacacaaccaccaucaguaucaggagcaccaggacaacgaguaacaauaucaugcacaggaucaucauccaacacaggagcaggauaugacguacacugguaccaacaaguaccaggaacagcaccaaaacuauuaauauacggaucuggaaacagaccaucaggaguaccagaccgauucucaggauccaaaucaggaacaucagcaucccuagcaauaacaggacuacaagcagaagacgaagcagacuacuacugccaaucauacgacucaucacucuccggauggguauucggaggaggaacaagacuaaccguacuaggacaaccaaaagcagcuccaucaguaacacuauuccccccaucaucagaagaauuacaagcaaacaaagcaacacuaguaugucuaauaucagauuucuacccaggagcaguaacaguagccuggaaagcagacucauccccagucaaagcaggaguagaaacaacaacaccaucaaaacaaucaaauaacaaauacgcagcauccucauacuuaucacuaacuccagaacaauggaaaucacauagaucauacucaugccaaguaacacacgaaggaucaacaguagaaaaaacaguagcacccacugaaugcuca

SEQ ID NO: 46821 - RNA, 363 nt, Artificial Sequence
  derived and/or modified sequence opt6 from Brolucizumab_HeavyChain
ucagaaguacaauuaguagaaaguggaggaggauuaguacaaccaggaggaagucuaagauuaaguuguacagcaaguggauuuaguuuaacagauuauuauuauaugacauggguaagacaagcaccaggaaaaggauuagaauggguaggauuuauagauccagaugaugauccauauuaugcaacaugggcaaaaggaagauuuacaauaaguagagauaauaguaaaaauacacuauauuuacaaaugaauaguuuaagagcagaagauacagcaguauauuauugugcaggaggagaucauaauaguggauggggauuagauauauggggacaaggaacauuaguaacaguaagcagu

SEQ ID NO: 46822 - RNA, 333 nt, Artificial Sequence
  derived and/or modified sequence opt6 from Brolucizumab_LightChain
auggaaauaguaaugacacaaucaccaucaacacuaucagcaucaguaggagacagaguaauaauaacaugccaagcaucagaaauaauacacucauggcuagcaugguaccaacaaaaaccaggaaaagcaccaaaacuacuaauauaccuagcaucaacacuagcaucaggaguaccaagcagauucucaggaucaggaucaggagcagaauucacacuaacaauaucaucauuacaaccagacgacuucgcaacauacuacugccaaaacguauaccuagcaucaacaaacggagcaaacuucggacaaggaacaaaacuaacaguacua

SEQ ID NO: 46823 - RNA, 1347 nt, Artificial Sequence
  derived and/or modified sequence opt6 from Cabiralizumab_HeavyChain
caaguacaacuaguacaaucuggggcagaaguaaaaaaaccaggaucauccguaaaaguaucaugcaaagcaucagguuacacauucaccgauaacuacaugaucuggguacgacaagcaccaggacaaggcuuagaauggaugggcgacauaaaccccuacaacgguggaacaaccuucaaucaaaaauuuaaaggaagaguuacaauaaccgcugacaaaaguacaucaacagcuuauauggaacuaucuucauuaagaucagaagacacagcagucuauuacugugcacgugaaaguccauacuucuccaaccuauacguaauggauuacuggggacaaggaacacuaguaaccgucucaagcgcaucaacaaaaggaccaucaguauucccauuagcaccauguucaagaucaaccucagaauccacagccgcacuagguuguuuaguuaaagauuacuuccccgaaccaguaacuguuucauggaacucaggugcauuaacuucaggaguacacacauuuccagcaguucuacaauccagcggccucuauucacuaucaucaguaguaaccguaccaucaucaucauuagguacaaaaacuuauacauguaaugucgaccauaaaccuucaaacacaaaaguugauaaaagaguagaaucuaaauauggaccuccaugccccccuugcccagccccagaauuccuagguggaccaucagucuuuuuauucccaccaaaaccaaaagauacacucaugauaucaagaacaccugaaguaacaugcguaguaguugacgucucacaagaagaccccgaaguccaauuuaauugguauguagauggaguagaaguucacaacgcaaaaacaaaaccaagagaagaacaauuuaacucaacauacagaguuguaucaguauuaacaguauuacaccaagacugguuaaacggcaaagaauacaaaugcaaaguaaguaauaaaggacucccuucaucaauagaaaaaacaaucaguaaagcaaagggacaaccacgagaaccccaaguauacacccuaccacccucacaagaagaaaugacuaaaaaucaaguaucacuaaccugucuaguuaaaggauucuaccccucagacauagcaguagaaugggaauccaauggacaaccagaaaacaacuauaaaacaacaccacccguucuagacucagacggauccuucuucuuauacucaagauuaacaguagacaaauccagauggcaagaaggaaacguuuucaguuguucagucaugcacgaagcauuacacaaccacuacacacaaaaaucacuaucauuaucuuuaggaaaa

SEQ ID NO: 46824 - RNA, 654 nt, Artificial Sequence
  derived and/or modified sequence opt6 from Cabiralizumab_LightChain
gaaauaguauuaacacaaucaccagcaacacuaagucuaucaccaggagaacgcgcuacacuaucaugcaaagcaucacaaucuguagacuacgacggagacaacuacaugaacugguaccaacaaaaaccaggacaagcaccaagauuacuaauauacgcagcaucaaaccuagaaucaggaauaccagccagauucucaggaucaggaucaggaacagacuuuacauuaacaauaucaucacuagaacccgaagauuuugcaguauacuacugucaccuaucaaacgaagacuuaucaacauucggaggcggaacaaaaguagaaauaaaaagaacaguagcagcaccaucaguauucaucuucccaccaucagacgaacaacuaaaaucaggaacagcaucaguaguaugcuuacucaacaacuucuacccaagagaagcaaaaguacaauggaaaguagacaacgcacuacaaucaggaaacucacaagaaucaguaacagaacaagacuccaaagacucaacauacucccuaucaucaacauuaacccuaucaaaagcagacuacgaaaaacacaaaguauacgccugcgaaguaacacaccaaggacuaucaucacccguaacaaaaucauucaacagaggagaaugc

SEQ ID NO: 46825 - RNA, 1329 nt, Artificial Sequence
  derived and/or modified sequence opt6 from Camrelizumab_HeavyChain
gaaguccaacucguagaaucagguggaggcuuaguccaaccaggaggaucacuccgauuaucuugugcugcaucaggauuuacauuuagcucauauaugaugucauggguaagacaagcccccggaaaaggucuagaauggguagcuaccaucucuggaggaggagcaaacacauauuacccugacuccguaaaaggacgauuuacaauaucuagagauaaugcaaaaaauucccuauaccuacaaaugaauucauuaagagcagaagacacagcuguguacuacugcgcaagacaacuauacuacuuugacuauuggggacaaggcacaacaguuacaguaucaucagcauccacaaaaggaccauccguauuuccacuugcaccaugcucaagaucaacuagcgaaucaacagccgcauuaggauguuuaguaaaagauuacuuuccagaaccaguaacaguaucauggaacucuggagcacuaaccucaggaguacauacuuucccagcaguacuucaaucaucaggauuauauagccuauccucaguuguaacaguuccauccucaucacuuggaacaaaaaccuauacauguaauguagaccauaaaccaucaaacacaaaaguugacaaacguguugaauccaaauaugguccaccuugcccuccauguccugcaccugaauuccuaggaggaccaucagucuuccuauuuccaccaaaaccaaaagacacauuaaugauauccagaaccccugaaguaacaugcguaguuguugauguaucacaagaagacccugaaguacaauuuaauugguacguagacggaguagaaguacacaaugcaaaaacaaaaccacgagaagaacaauucaauuccaccuacagaguaguaaguguuuuaaccguacuucaccaagacuggcuaaauggaaaagaauacaaauguaaaguaucaaauaaaggacuacccucaucaauagaaaaaacuauauccaaagcuaaaggacaaccaagagaaccacaaguauauacauuaccaccaagccaagaagaaaugacuaaaaaucaaguauccuuaacauguuuaguaaaaggauuuuaucccucagacaucgcagucgaaugggaauccaacggccaaccagaaaauaauuauaaaaccacaccaccuguacuagacucagauggaucauuuuucuuauacucuagacuuaccgucgacaaaucaagauggcaagaaggaaauguauucucauguucaguaaugcaugaagcauuacauaaucacuauacacaaaaaucauuaagccuaaguuuaggaaaa

SEQ ID NO: 46826 - RNA, 642 nt, Artificial Sequence
  derived and/or modified sequence opt6 from Camrelizumab_LightChain
gacauacaaaugacacaauccccaucaucacuaucagcaucaguaggagacagaguaacaauaacaugccuugcaucacaaacaauaggaacaugguuaacuugguaccaacaaaaaccuggaaaagcaccaaaacuacuaauauacacagcaacaucacuagcagacggaguaccaucaagauucucaggcucaggaucaggaacagacuucacauuaacaauaucaucccuacaaccagaagacuucgcaacauacuacugccaacaaguauacucaauaccauggacauucggaggaggaacaaaaguagaaauaaaaagaacaguagcagcaccaucaguauucaucuucccaccaagugacgaacaauuaaaaucaggaacagcaucaguaguaugccuacuaaacaacuucuauccaagagaagcaaaaguccaauggaaaguagacaacgcacuacaaucaggaaacucacaagaauccguaacagaacaagacucaaaagacucaacauacagccuaucaucaacccuaacacuauccaaagccgacuacgaaaaacacaaaguauacgcaugcgaaguaacacaccaaggacuaaguucuccaguaacaaaaucauucaacagaggagaaugc

SEQ ID NO: 46827 - RNA, 777 nt, Artificial Sequence
  derived and/or modified sequence opt6 from Caplacizumab_HeavyChain
gaaguacagcuaguagaaagugguggaggauuaguacaaccaggagguucauugagauuaaguugugcugcaaguggaagaacauuuaguuauaauccaaugggaugguuuagacaagcaccagggaaaggaagagaauugguggcagcaauaagcagaacagggggaucaacauauuauccagauaguguagaaggaagauuuacgauuaguagagauaaugcaaaaagaaugguauacuuacaaaugaauaguuuaagagcagaagauacagcaguauauuauugugcagcugcaggaguaagagcagaagauggaagaguaagaacauuaccaucugaauauacauuuuggggacaaggaacucaaguaacaguaaguagugcagcagcggaaguacaauuaguagaaagugguggaggauuagugcaaccaggaggaagucuaagauuaucaugugcagcaaguggaagaacauuuaguuauaauccaaugggaugguuuagacaagcaccaggaaaagggagagaauuaguugcagcaauaagcagaacagguggaucaacauauuauccagauucaguagaaggaagguuuacaauaagcagagauaaugcaaaacgaaugguauauuuacaaaugaauaguuuaagagcagaagacacagcaguuuauuacugugcagcagcaggaguaagagcagaagauggaagaguaagaacauuaccaagcgaauacacauuuuggggacaaggaacacaaguaacaguaaguagu

SEQ ID NO: 46828 - RNA, 657 nt, Artificial Sequence
  derived and/or modified sequence opt6 from Citatuzumab_bogatox_HeavyChain
gaaguacaauuaguacaaucaggaccaggauuaguacaaccaggaggauccguacgaauuagcugcgcagcaagcggauacacauucacaaacuauggaaugaacuggguaaaacaagcaccaggaaaaggauuagaauggaugggauggauaaauacauauacaggagaaucaacauaugcagauucauuuaaaggacgauucacauuuucacuagacacaagcgccucagcagcauaucuacaaauaaauucauuaagagcagaagacacagcaguauauuacugcgcaagauucgcaauaaaaggagauuacuggggacaaggaacacuauuaacuguaucaucagcaucaacaaaaggaccaucaguauucccacuagcaccaucaucaaaaucaacuucaggaggaacagcagcacuaggaugccuaguaaaagacuauuuuccagaaccaguaacaguaucauggaauucaggagcauuaacaucuggaguacacacauuuccagcaguacuacaaucaucaggacuauacucauuaucaucaguuguaacuguaccaagcucaucacuaggaacacaaacauacauaugcaauguaaaucacaaaccaucaaacacaaaaguagacaaaaaaguagaaccaaaaucuugc

SEQ ID NO: 46829 - RNA, 1356 nt, Artificial Sequence
  derived and/or modified sequence opt6 from Cosfroviximab_HeavyChain
gacguaaaacuauuagaauccggaggaggacuaguacaaccaggaggaucauuaaaacuaucuugcgcagcaucaggauucucucuaucaacaucaggagucggcguaggaugguucagacaaccaucaggcaaaggacuagaaugguuagcauuaauauggugggacgacgauaaauacuacaacccaucauuaaaaucacaacucucuauaucaaaagauuuuagcagaaaccaaguauucuuaaaaauuuccaacguagauauagcagauacugcaacauacuacugcgcaagacgagacccauucggauacgauaacgcaaugggauauuggggacaaggaaccucaguaacaguaucaucugccucaacaaaaggcccaucaguuuuuccacuagcuccauccuccaaauccacuucaggaggaaccgcagcacuaggaugccuaguaaaagacuauuucccagaaccaguuaccguaucauggaacuccggagcauuaacauccggaguacauacauucccagcaguccuacaaagcucaggcuuauacucacuauccucaguaguaacaguaccaagcucaucauuagguacacaaacauacauaugcaacguuaaucacaaaccaucaaacacuaaagucgacaaaagaguagaaccaaaauccugcgauaaaacacacacauguccaccaugcccagcaccagaacuacuaggaggcccuucaguuuuuuuauuuccaccaaaaccuaaagacacacuaaugauauccagaacaccagaaguaacauguguaguaguagauguuucacacgaagacccagaaguaaaauucaacugguacguagacggaguagaaguccauaacgcuaaaaccaaaccaagagaagaacaauacaauucaacauaccgaguaguaucugucuuaacuguacuacaucaagacuggcuaaacggaaaagaauacaaauguaaaguaucaaauaaagcauuacccgcaccaaucgaaaaaacaauuagcaaagcaaaaggucaaccaagagaaccacaaguauacacccuaccaccuucaagagaugaacuuacuaaaaaccaaguaucacugacaugccuaguaaaaggguucuaccccucagauauagccguagaaugggaaucaaacggacaaccagaaaacaacuauaaaacaacaccccccguauuagacuccgacggaucuuucuucuuauacaguaaauuaacaguagauaaauccagguggcaacaaggaaacguuuucaguuguuccgucaugcaugaagcccuacauaaucauuacacacaaaaaagucuuaguuuauccccaggaaaa

SEQ ID NO: 46830 - RNA, 639 nt, Artificial Sequence
  derived and/or modified sequence opt6 from Cosfroviximab_LightChain
gacauaguaaugacacaaucaccacuaucacuaucaacaucaguaggagacagagucucacuaacaugcaaagcaucacaaaauguaggaacagcaguagcaugguaccaacaaaaaccaggacaaucaccaaaacuauuaauauacucagcaucaaacagauacacaggaguacccgacagauucacaggaucaggaucaggaacagauuuuacacuaacaaucuccaauaugcaaucagaagaccuagcagacuacuucugccaacaauacucaucauaccccuuaacauucggagcaggaacaaaacuagaacuacgaacaguugccgcaccaucaguauucauauucccaccaucagacgaacaauuaaaaucaggaacagcaucaguaguaugucuacuaaacaacuucuacccacgagaagcaaaaguacaauggaaagucgauaacgcacuacaaucaggaaacucccaagaaucaguaacagaacaagacucaaaagacucaacauacucacuauccucaacacuaacauuaucaaaagccgacuacgaaaaacacaaaguauacgcaugcgaaguaacacaccaaggacucucauccccaguaacaaaaucauuuaacagaggagaaugc

SEQ ID NO: 46831 - RNA, 1344 nt, Artificial Sequence
  derived and/or modified sequence opt6 from Crizanlizumab_HeavyChain
caaguacaacuaguacagucaggugcagaaguaaaaaaacccggagcaucugucaaaguuucuuguaaaguaucaggauacacauucaccaguuacgauauaaacuggguaagacaagcaccaggaaaaggauuagaauggaugggauggauauaucccggagauggaucaaucaaauauaaugaaaaauuuaaaggaagaguuacaaugacaguagacaaaucaacagacacagcauacauggaacuaagcucauuaagaagugaagauacggcaguauacuacugugcaagacgaggugaauacggaaacuaugaaggugccauggacuacuggggacaaggaacccuaguaacaguaucuagugcaagcacaaaaggacccuccguauuuccacuagcaccauguaguagaucuacaagcgaaucaacagcagcauuggguugucuaguaaaagauuacuucccagaaccuguaacaguaucauggaauucaggagcacuaacaagcgguguccauacauuucccgccguauuacagucgagcggacuauacucacuaucuucaguaguuacaguaacaagcaguaauuuuggaacacaaacauauacuugcaacguagaccacaaaccaucaaauacuaaaguagacaaaacaguagaaagaaaaugcuguguagaauguccaccaugcccugcaccaccaguagcaggaccaucaguauucuuauucccaccaaaaccuaaagacacacuaaugauaucacgcacuccagaagugacauguguuguaguagauguaucacacgaagaccccgaaguucaauuuaacugguauguagaugguauggaaguacacaaugcuaaaacaaaaccacgugaagaacaauuuaauucaacauuccgaguaguaucaguccuaaccguaguccaucaagacuggcucaacgguaaagaauauaaaugcgcaguuucaaauaaaggcuuaccagcacccauagaaaaaacaauaucaaaaacaaaaggacaaccaagagaaccacaaguauauacccuaccaccaucacgagaagaaaugacaaaaaaucaaguaucucuaacaugcuuaguuaaagguuuuuacccaucagacauagcagucgaaugggaaucaaauggacaaccagaaaacaauuacaaaacaacaccaccuauguuagauagcgacggaucuuucuuccucuacucaaaacuaacaguagacaaauccagauggcaacaagguaacguauucucauguucaguaaugcacgaagcccuacauaaucacuacacccaaaaaucccucucacuaucaccaggaaaa

SEQ ID NO: 46832 - RNA, 654 nt, Artificial Sequence
  derived and/or modified sequence opt6 from Crizanlizumab_LightChain
gacauacaaaugacacaaucaccaucuucacuaagcgccucaguaggagacagaguaacaauaacaugcaaagcaucacaaucaguugacuacgacggacacucauacaugaacugguaccaacaaaaaccaggaaaagcaccaaaauuacuaauauacgccgcaagcaaccucgaaagcggaguaccaagcagauucucaggaucaggaucaggaacagacuucacccuaacaauaucaucacuccaaccagaagacuucgcaaccuacuauugccaacaaucagacgaaaacccacucacauucggaggaggaacaaaaguagaaauaaaaagaaccgucgcagcaccaucaguauucauauucccaccaucagacgaacaacuaaaaucaggaacagcaucagucguaugccuacuaaacaacuucuacccccgagaagcaaaaguacaauggaaaguagacaacgcacuacaaucaggaaauucacaagaaucaguaacagaacaagacucaaaagacucaacauacucauuaagcucaacacuaacacuaucaaaagccgacuacgaaaaacacaaaguauacgcaugcgaaguaacacaccaaggacuaucaucaccaguaaccaaaucauucaacagaggagaaugc

SEQ ID NO: 46833 - RNA, 1365 nt, Artificial Sequence
  derived and/or modified sequence opt6 from Crotedumab_HeavyChain
gaaguacaauuaguugaaucaggaggcggucuaguucaaccuggagguucucuaagacuauccugcgcagcgucaggcuuuacauuuucaaauuaccuaaugaauugggucagacaagcuccaggaaaaggacuagaaugguuagcuaacauacaagaagacggcauagaaaaauacuacguugacagugucaaaggacgauuuacuauaagcagagacaacgcuaaaaauucacuauaucuucaaaugaacuccuuacgagccgaagacacagccguauacuauugugcaagagaaccaucacacuaugacauuuuaacaggauacgacuauuacuauggaauggacguauggggacaaggaacaacuguaacaguuucaucagcaucaacuaaaggacccuccgucuucccuuuagccccuuguagcagaucaacaucagaauccacagcugcauuaggaugucuaguaaaagacuacuuuccagaaccaguaacaguaucauggaacaguggagcacuaacaucuggaguccacaccuucccggcaguauuacaaucaucaggacuauauagcuuaucaucaguagucacaguaccuucuucaucauuaggaacaaaaaccuacacaugcaauguagaccauaaaccauccaauacaaagguagauaaacgaguagaaucaaaauacggaccaccaugcccaccauguccagcaccagaauuucuaggaggaccaucaguauuuuuauucccacccaaaccaaaagauacauuaaugauauccagaaccccagaaguuaccuguguagucguagacguaucccaagaagaucccgaaguccaauucaacugguacguugacggaguagaaguacacaacgccaaaaccaaaccuagagaagaacaauucaacucaacauaccgaguagucucaguauuaacaguccuacaucaagauuggcuaaauggcaaagaauacaaauguaaaguaucaaauaaaggacuaccaucaucaauagagaaaacaauaucaaaagcaaaaggccaaccuagggaaccacaaguauauacacuaccaccaagucaagaagaaaugacuaaaaaccaaguaucauuaacaugcuuaguaaaaggauuuuauccaucugacauagccguagaaugggaaucaaacggccaaccagaaaacaacuacaaaacaacaccaccaguauuagauagcgauggauccuucuuuuuauacucuagauuaacagucgauaaaucaagauggcaagaaggaaacguauucucaugcucaguaaugcacgaagcacuacacaaucacuacacacaaaaaucacuaucauuaucauuaggcaaa

SEQ ID NO: 46834 - RNA, 642 nt, Artificial Sequence
  derived and/or modified sequence opt6 from Crotedumab_LightChain
gauauacaaaugacacaaucuccaucaucauuaagcgcaagcguaggcgaccgaguaacaauaacauguagagcaagccaaggaauaagaaaugaccuaggaugguaccaacaaaaaccaggaaaagcaccaaaaagauuaauauaugcagcaagcucacuacaaucaggaguaccaucaagauucucaggaucaggauccggaacagaauuuauacuaacagucucaucacuacaaccagaagacuuugcaacuuacuacugcuuacaauauaacucaaacccauucacauucggaccaggaaccaaaguagauauaaaaagaacuguagcagcaccaagcguauuuauauucccaccaucagacgaacaauuaaaaucaggcacagcaucaguaguaugcuuacuaaauaacuuuuacccaagagaagcaaaaguacaauggaaaguagauaacgcauuacaaagcggaaacucacaagaaagcguaacagaacaagauucaaaagacucaacauauucacuaagcucaacauuaacacuaagcaaagcagauuacgaaaaacauaaaguauacgcaugcgaaguaacucaccaaggauuaagcucaccaguaaccaaaaguuuuaacagaggcgaaugc

SEQ ID NO: 46835 - RNA, 1356 nt, Artificial Sequence
  derived and/or modified sequence opt6 from Dezamizumab_HeavyChain
caaguucaauuaguccaaucaggcgcagaaguuaaaaaaccaggaucauccguaaaaguaucauguaaagcauccgguuuuacauuugcaacauacaacaugcauuggguaagacaagcuccaggacaaggacuagaauggaugggauauauauacccuggagauggaaaugcuaacuacaaccaacaauucaaaggucguguaaccauaacagccgauaaaucaacaucaacagcauauauggaacuaucaucccucagaucagaagacacagcaguauacuauugcgcaagaggagauuuugacuacgauggaggauacuacuucgacucauggggccaaggaacacucguaacagucuccagcgcaucaacuaaaggacccucaguauucccacuagcaccaagcucaaaaucaacaucaggaggaacagccgcauuaggcugccuaguaaaagacuauuucccagaaccaguaacuguaaguuggaauuccggagcacuaacaaguggaguacacacauucccagcaguacuacaaucaucaggacuauacucccuaucuaguguaguaacaguaccuucaucaucacuaggaacacaaacauacauaugcaauguaaaucacaaaccaucuaacacaaaaguagauaaaaaaguagaaccaaaaucaugcgauaaaacacacacauguccacccugucccgcaccagaauuacuaggaggaccaucagucuuccuauucccaccaaaaccaaaagacacacucaugaucuccagaacccccgaagucacuugcguaguaguagacguaucacaugaagacccagaaguaaaauucaauugguauguagacggagucgaaguccauaacgccaaaacuaaaccacgagaagaacaauauaauucaacauaccggguaguaucagucuuaacaguacuacaccaagauuggcuaaacgguaaagaauacaaauguaaaguaucaaauaaagcacuccccgcuccaauagaaaaaaccauaucaaaagcaaaaggacaaccaagagaaccacaaguauauacacucccacccuccagagacgaauuaacaaaaaaucaaguaucacuaacaugccuaguuaaaggauucuauccaucagauauagcaguagaaugggaaucaaacggacaaccagaaaauaacuacaaaacaacaccacccguacuagauucagacggaucauuuuuccuauacucaaaacuaacaguagacaaaucaagauggcaacaaggaaauguauuuuccuguucaguaaugcacgaagcacuacacaaccacuacacacaaaaaagccuaucccuaucuccuggaaaa

SEQ ID NO: 46836 - RNA, 642 nt, Artificial Sequence
  derived and/or modified sequence opt6 from Dezamizumab_LightChain
gacauacaaaugacacaaucaccaucauccuuaagcgcaucaguaggcgacagaguaacaauaacaugccgagcaucagaaaacauauacucauaccuagcaugguaccaacaaaaaccaggaaaagcaccaaaacuccuaauacauaacgcaaaaacacuagcagaaggaguaccaagcagauucucaggaucagguucaggaacagacuucacacuaacaauaucaucacuacaaccagaagacuucgcaacauacuacugccaacaccacuacggagcaccauuaacauucggacaaggaacaaaacucgaaauaaaaagaaccguagccgcaccaucaguauucauauucccaccaucagacgaacaacuaaaaucaggaacagcaucaguagucugccuauuaaacaacuucuacccaagagaagcaaaaguacaauggaaaguagauaacgcacuccaauccggaaacucccaagaaucaguaacagaacaagacucaaaagacucaacauacucacuaucaucaacacuaacauuaucaaaagcagauuacgaaaaacacaaaguauacgcaugcgaaguaacacaccaaggccuaucaucuccaguaacaaaaucauucaacagaggcgaaugc

SEQ ID NO: 46837 - RNA, 1506 nt, Artificial Sequence
  derived and/or modified sequence opt6 from Duvortuxizumab_Chain1_scFv
gaaaacguauuaacacaaaguccugcuacauuaucuguaacuccaggcgaaaaagcaacaauaacauguagagcaucacaaucaguaucauacaugcacugguaucaacaaaaaccaggccaagcaccaagacuucuuaucuacgacgcaucaaauagagcaucuggaguaccuucaagauucucaggaaguggaucagguacugaucacacacucacaauaucaaguuuagaagcugaagaugcugcaacauacuacuguuuucaaggaucaguauauccauucaccuuuggccaagguacaaaacuagaaauaaaaggcgggggaagcgguggcggaggagaaguacaauuaguugaauccggaggcggauuaguccaaccagguggaucacuaagacuaucuugcgcagcuucuggauucacauuuucuacuuacgcaaugaacuggguaagacaagccccaggaaaaggauuagaauggguaggaagaauaagaucaaaauacaacaauuacgcuaccuauuaugcagacucaguuaaagguagguuuacaauaagcagagacgauucuaaaaacagccuauaccuacaaaugaacagucuaaaaaccgaagauacagcaguauacuacugcgucagacaugguaauuucggaaauucuuacguaagcugguuugcauacuggggacaaggaacucucguuacaguuucaucugccucgacaaaaggugaaguugcagcaugcgaaaaagaaguagcugcauuagaaaaagaagucgcagcauuagaaaaagaaguagcagcauuagaaaaaggaggcggagacaaaacacauacaugcccaccauguccggcaccagaagcagccggcggaccuaguguauuuuuauucccaccaaaaccaaaagacacauuaaugauaucaagaacaccagaaguaacaugcguagucguagauguaagucacgaagauccugaaguuaaauucaacugguacguagaugggguagaaguucacaaugcaaaaacaaaaccaagagaagaacaauauaauucaaccuauagaguuguuagcguuuuaacaguacuacaucaagauuggcuaaacggaaaagaauauaaaugcaaaguaucaaacaaagcccuaccagcaccaauugaaaagaccauuucaaaagcuaaaggccaaccuagggaaccgcaagucuauacacuaccaccuucccgagaagaaaugacuaaaaaucaagucucauuauggugcuuaguaaaaggcuuuuacccaagcgauauagcaguagaaugggaaaguaauggccaaccagaaaauaauuacaaaacaacaccaccaguauuagacucagacgguucauuuuuccuauauucaaaacuaacaguagauaaaagccgauggcaacaaggaaacguauucagcugcucugucaugcaugaagcauuacauaaucauuacacgcaaaaaucacuaucacuaucaccagguaaa

SEQ ID NO: 46838 - RNA, 813 nt, Artificial Sequence
  derived and/or modified sequence opt6 from Duvortuxizumab_Chain2_scFv
caagcagugguaacacaagaaccaucauuaacaguaaguccugguggaacaguuacauuaaccuguagaucaagcacaggagcuguaacaacaucgaacuaugcaaauuggguacaacaaaaaccaggacaagccccaagaggacuaaucggaggaacaaauaaaagagcaccuuggacaccagcaagauuuagcggaaguuuauuaggaggaaaagcagcacuaacaauaacaggagcacaggcagaagaugaagcagacuauuacugugcacuaugguauaguaaucuauggguauuuggaggaggaacaaaauuaacaguguuaggaggaggaggaaguggcgguggaggacaaguaacauuaagagaaaguggaccagcucuaguuaaaccaacacaaacacuaacauuaacauguacauuuagcggauucaguuuaucaacaaguggaaugggcguaggauggauaagacaaccaccaggaaaagcauuagaaugguuagcacauauauggugggaugacgacaaaagauacaauccagcacuaaaaagcagacuaacaauaucaaaagacacaaguaaaaaucaaguauucuuaacaaugacaaauauggauccaguagacacagcaacauacuauugcgcuagaauggaacuauggucauacuauuuugauuacuggggacaaggaacaacaguaacaguaagcucagcaaguacaaaaggaaaaguagcagcuuguaaagaaaaaguagcagcacuaaaagaaaaaguagcagcauuaaaagaaaaaguagcagcacuaaaagaa

SEQ ID NO: 46839 - RNA, 681 nt, Artificial Sequence
  derived and/or modified sequence opt6 from Duvortuxizumab_Chain3_h-CH2-CH3
gacaaaacacacacaugcccaccaugcccagcaccagaagcagcaggaggaccaucaguauucuuauucccaccaaaacccaaagacacacuaaugauaucaagaacaccagaaguaacaugcguaguaguagacguaagccaugaagacccagaaguaaaauuuaacugguacguagacggaguagaaguacauaaugcaaaaacaaaaccaagagaagaacaauacaacucaacauacagaguaguauccguacuaacaguccuacaccaagacuggcuaaacggaaaagaauauaaaugcaaaguaucaaauaaagcucuaccagcaccaaucgaaaaaacaauaucaaaagcaaaaggacaaccaagagaaccacaaguauacacacuaccaccaucaagagaagaaaugacaaaaaaccaaguaucacuaucaugcgcaguaaaaggauucuacccaucagacauagcaguagaaugggaaucaaacggacaaccagaaaacaacuacaaaacaacaccaccaguacuagacucagacggaucauucuucuuaguaucaaaauuaacaguagacaaaucaagauggcaacaaggaaacguauuuucaugcuccguaaugcacgaagcauuacauaacagauauacacaaaaaucacuaucacucuccccaggaaaa

SEQ ID NO: 46840 - RNA, 360 nt, Artificial Sequence
  derived and/or modified sequence opt6 from Efungumab_HeavyChain
auggcagaaguacaauuaguagaaagcggagcagaaguaaaaaaaccaggagaaaguuuaagaauaagcuguaaaggaagcggaugcauaauaucaagcuauuggauaagcuggguaagacaaaugccaggaaaaggauuagaauggaugggaaaaauagauccaggagacucauacauaaacuauagcccaaguuuucaaggacacguaacaauaagugcagacaaaaguauaaacacagcauauuuacaauggaauaguuugaaagcaagcgauacagcaauguauuacugugcaagaggaggaagagauuucggagacucauuugauuacuggggacaaggaacacuaguaacagua

SEQ ID NO: 46841 - RNA, 750 nt, Artificial Sequence
  derived and/or modified sequence opt6 from Efungumab_HeavyChain_LightChain
auggcagaaguacaauuaguagaaagcggagcagaaguaaaaaaaccaggagaaagucuaagaauaaguuguaaaggaagcggauguauaauaaguucauauuggauaaguuggguaagacaaaugccaggaaaaggauuagaauggaugggaaaaauagauccaggagacaguuauauaaauuauucaccaaguuuucaaggacauguuacuauaagugcagauaaaagcauaaauacagcauauuuacaauggaauaguuuaaaagcaagugauacagcaauguauuauugugcaagaggaggaagagacuuuggagacucauuugauuauuggggacaagggacauuaguaacaguaaguucaggaggaggaggaaguggaggaggaggaaguggaggaggaggaagugauguaguuaugacacaaucaccaucauuuuuaagugcauuuguaggagaucgaauaacaauaacauguagagcgaguaguggaauaaguagauauuuagcaugguaucaacaagcaccuggaaaagcaccaaaacuauuaauauacgcagcaaguacauuacagacaggaguaccaagcagauuuaguggaucaggcucaggaacagaauuuacacuaacaauaaauucauuacaaccagaagauuuugcaacauauuauugucaacaucuaaacucauauccacuuacauucggaggaggaacaaaaguagauauuaaaagagcagccgcauuagaa

SEQ ID NO: 46842 - RNA, 339 nt, Artificial Sequence
  derived and/or modified sequence opt6 from Efungumab_LightChain
gacguaguaaugacacaaucaccaucauuccuaucagcauucguaggagacagaauaacaauaacaugccgagcaucaucaggaauaucaagauaccuagcaugguaccaacaagcaccaggaaaagcaccaaaacuacuaauauacgcagcaucaacacuacaaacaggaguaccaucaagauucucaggaucaggaucaggaacagaauucacacuaacaauaaacucauuacaaccagaagacuucgcaacauacuacugccaacaccuaaacucauacccacuaacauucggaggaggaacaaaaguagacauaaaaagagcagcagcacuagaa

SEQ ID NO: 46843 - RNA, 1350 nt, Artificial Sequence
  derived and/or modified sequence opt6 from Elezanumab_HeavyChain
gaaguccaacuaguacaaaguggagcugagguaaaaaaaccaggcgcuagcguuaaaguaucauguaaagcaagcggauacacauucacaagucauggaauaucauggguaagacaagcaccaggacaaggccuagauuggaugggauggauaucaccauacucaggaaauacaaacuacgcucaaaaacuacaaggaagaguaacaaugacaacagacacaucaacaaguaccgcauacauggaauugucaagccuacgaucugaagauacagcaguauacuauugcgcccgaguuggaucaggaccauauuacuacauggacguauggggacaaggcacacucguaacaguaucaucagccucaacaaaaggacccucaguauucccacuagcucccucaucaaaaucaacaaguggaggaacagcagcauuaggaugccuaguaaaagacuacuucccagaaccaguaacaguauccuggaacucaggagcauuaaccucuggcguucauacauucccagcuguauuacaaucaucaggauuauacucacuaucaagcguaguaacagucccauccucuagcuuaggaacacaaacauauauaugcaacguaaaccacaaaccauccaauacaaaaguugacaaaaaaguagaaccaaaaucaugcgacaaaacacauacaugcccacccuguccagcuccagaagcagcaggagguccaucaguauucuuauucccaccaaaaccuaaagaucaauuaaugauaucucgaacacccgaaguaacaugcguagucguagacgucucacaugaagauccagaaguuaaauuuaacugguauguagacggaguagaaguacacaaugcaaaaacaaaaccaagagaagaacaauacaacucaaccuacagaguaguaucaguacuaacgguauuacaccaagacuggcucaaugguaaagaauacaaaugcaaaguuaguaacaaagcauuaccagcaccaauagaaaaaacaaucucuaaagcaaaaggccaaccaagagaaccacaagucuauacauuacccccaagcagagaagaaaugacuaaaaaucaaguaagccuuaccugucuaguaaaaggauuuuacccaucagacauagccguggaaugggaaaguaacggucaaccagaaaauaauuacaaaacaacaccaccaguacuagacagcgacggcucauucuucuuauacucaaaacuuacgguagacaaaucacgauggcaacaaggcaaugucuuuagcugcucaguacuacacgaagcauuacacaaccacuacacacaaaaaucacuuucucuaucaccaggaaaa

SEQ ID NO: 46844 - RNA, 645 nt, Artificial Sequence
  derived and/or modified sequence opt6 from Elezanumab_LightChain
caaucagcacuaacacaaccaagaucagucucaggaucaccaggacaaucuguaacaauaucaugcacaggaacaucaucaucaguaggcgacucaauauacguaucaugguaccaacaacacccaggaaaagcaccaaaacuaaugcuauacgacguaacaaaacgaccaucaggaguaccagacagauucucaggaucaaaauccgguaacacagcaucacuaacaauaagcggacuacaagccgaagacgaagcagauuacuacugcuacuccuacgcaggaacagauacacuauuuggaggaggaacaaaaguaacaguccuaggacaaccaaaagcagcaccaucaguaacacuauucccaccaucaucagaagaauuacaagcaaacaaagcaacacuaguaugccuaauaucagacuucuacccaggcgcagucacaguagccuggaaagcagacucaucaccaguaaaagcaggaguagaaacaaccacaccaucaaaacaaucaaacaacaaauacgcagcaucaucuuaccuaucauuaacaccagaacaauggaaaucacacagaucauacucaugccaaguaacacacgaaggaucaacaguagaaaaaacaguagccccaacagaaugcucc

SEQ ID NO: 46845 - RNA, 1359 nt, Artificial Sequence
  derived and/or modified sequence opt6 from Emapalumab_HeavyChain
gaaguacaauuacuagaaagcggaggaggauuaguacaaccaggaggcagccuucgacuaucaugcgcagcaucuggcuucacauuuucauccuaugcaaugucaugggucagacaagcucccggcaaaggacuagaauggguauccgcaauaucaggcucaggaggauccacauacuaugcugauucagucaaaggaagauucacaauaagcagagacaauuccaaaaacacacuauaccuacaaaugaacucacuaagagcagaagacacagcuguauacuauugugcuaaagaugguagcuccggaugguacguaccacauugguuugacccauggggacaaggaacucuagucacaguaucaucugcaucaacaaaagguccaucaguauuuccacuagcaccaaguucaaaaucaacaucaggcggcacagcagcucuaggaugucuaguaaaagacuauuuuccugaacccguaacaguaucauggaacucaggcgcacuuaccaguggaguacacacauuuccagcaguauuacaaucuucaggacuauauucauuaucaucaguaguaacagucccaucaucaucauuaggaacacaaacauauauaugcaacguaaaccauaaaccaucaaacacaaaaguugacaaaagagucgaaccaaaaucaugugacaaaacacauacaugcccaccaugcccagcaccggaauuacuaggaggcccauccguauucuuauuuccaccaaaaccaaaagauacacuuaugauaucuagaacuccagaaguuacuuguguaguaguagacguaagccaugaagauccagaaguaaaauucaauugguauguagauggaguagaaguacauaaugcaaaaacaaaaccacgagaagaacaauauaacucuacuuauagaguaguuucuguacuaacuguacuacaccaagacuggcuaaacggaaaagaauauaaauguaaaguaucaaacaaagccuuaccagcaccaauagaaaagacaauaucaaaagcuaaaggacaaccacgagaaccacaaguuuauacauuaccaccaucaagagaagaaaugacuaaaaaccaaguuucauuaacauguuuagucaaaggauuuuacccaucagauauagcugucgaaugggaauccaauggucaacccgaaaacaauuacaaaacaacacccccaguuuuagauucagacggcucauuuuucuuauauucaaaauuaacaguagacaaaaguagauggcaacaaggaaacguauucucaugcuccguuaugcacgaagcacuucacaaucacuauacacaaaaaucacuuucacuaucaccaggaaaa

SEQ ID NO: 46846 - RNA, 651 nt, Artificial Sequence
  derived and/or modified sequence opt6 from Emapalumab_LightChain
aacuucaugcuaacacaaccacacucaguaucagaaucaccaggaaaaacaguaacaauauccugcaccagaucaucaggcucaauagcaucaaauuacguacaaugguaccaacaaagaccaggauccucaccaacaacagucauauacgaagacaaccaaagaccaucaggaguaccagacagauucucaggaucaauagacucaucaucaaauuccgcaucucuaacaauaucaggacuaaaaacagaagaugaagcagacuacuacugccaaucauaugacggaucuaauagauggauguucggaggaggaacaaaacuaacagucuuaggacaaccaaaagcagcaccaucaguaacauuauucccaccaucaucagaagaacuacaagcaaacaaagcaacacuaguaugcuuaauaucagacuucuacccaggcgcaguaacaguagcauggaaagcagacuccucaccaguaaaagcaggaguagaaacaacaacacccucaaaacaaucaaacaacaaauacgcagcaucaucauaccuaucacuaacaccagaacaauggaaaucacacagaucauacucaugccaaguaacacacgaaggaucuacagucgaaaaaacaguagcaccaacagaaugcuca

SEQ ID NO: 46847 - RNA, 1341 nt, Artificial Sequence
  derived and/or modified sequence opt6 from Enoblituzumab_HeavyChain
caaguagaacuaguagaaucaggaggaggauuaguacaaccagguggaaguuuaagacuaucuugcgcagcaucgggcuuuacauucacauccuacuggaugucuuggguaagacaagcaccaggaaaaggcuuagaacuaguaucauccauaacaucauacgguagcuucacauauuacgcugauucagucaaaggaagauucacaauaucuagagacaacuccaaaaacacauuauaccuucaaaugaauucacucagggcagaagacacagcaguauauuacugugcaagaaauauguacacacauuuugacuccuggggacagggaacucucguaaccguaagcagcgcaucuacuaaaggaccaucaguuuucccauuagcaccaucaucaaaaucaacaucaggaggaaccgccgccuuaggaugccuaguuaaagacuauuuucccgaacccguuacaguaucuuggaauucaggugcucuuaccuccggcguucauacauucccugcaguacuacaaaguucuggauuauauucccucuccucaguuguaacaguacccucaucuucacucggaacacaaacauacauaugcaauguaaaucacaaacccucaaacacaaaaguagacaaaaaaguagaaccaaaauccugcgacaaaacacacaccuguccaccauguccagcacccgaacuauuaggaggaccaucaguauucuuauucccaccuaaaccaaaagacacacucaugauaucaagaacaccagaaguaacaugcguagucguagacgucucccaugaagaccccgaagucaaauuuaacugguacguugauggaguagaaguacauaacgccaaaacaaaaccuagagaagaacaauacaacucaacuuaccguguagucucaguacuaacaguacuccaccaagauugguuaaaugguaaagaauauaaauguaaaguuuccaacaaagcacuaccagcaccaauagaaaaaacaauaucaaaagccaaaggacaaccacgcgaaccacaaguauacacacuaccaccaaguagagaugaauuaacaaaaaaccaaguaucacucacaugucuaguaaaagguuucuauccaucugacauagcaguagaaugggaaucaaacggccaaccugaaaacaacuacaaaacaacaccaccaguauuagacucagauggaucauuuuuucuauacucuaaacuaacaguagacaaaucacgauggcaacaaggaaauguauuuucauguucaguaaugcacgaagcccuacacaaccacuacacucaaaagucacuaucacuaagcccaggaaaa

SEQ ID NO: 46848 - RNA, 648 nt, Artificial Sequence
  derived and/or modified sequence opt6 from Enoblituzumab_LightChain
gacauaguauuaacacaaccaccaucaguauccggagcaccaggacaacgaguaacaaucuccugcucaggaucaucauccaacauaggaucaaacuccguaucaugguaccaacaacuaccaggaaccgcaccaaaacuacuaauauacgacaauucaaaacgaccaucaggagucccagacagauucucaggaagcaaaagcggaacaucagcaucacucgcaauaacaggauuacaaucagaagacgaagcagacuacuacugccaaucaagagacacuuacggcuacuacuggguauucggaggaggaacaaaauuaacaguacuaggccaaccaaaagcagcaccaaguguaacacuauucccaccaucaucagaagaacuacaagcaaacaaagcaacacucguaugucuaauaucagacuuuuacccaggagcaguaacaguagcuuggaaaggagauaguucaccaguaaaagcaggaguagaaacaacaacaccaucaaaacaaucaaacaacaaauacgcagcaucaucauaccuaucacuaacacccgaacaauggaaaucacacagaucauacaguugucaaguaacacacgaaggaaguacagucgaaaaaacaguagcaccaacagaauguuca

SEQ ID NO: 46849 - RNA, 1323 nt, Artificial Sequence
  derived and/or modified sequence opt6 from Eptinezumab_HeavyChain
gaaguucaauuaguagaaucuggaggaggacucguucaaccagguggaucucuaagauuaucaugugcaguaucaggaauugaucuuucuggcuauuacaugaacuggguccgacaagcuccaggcaaaggauuagaauggguaggaguaauuggaauaaacggagcuaccuacuaugcaucuugggcuaaaggaagauuuacaauuuccagagauaacucaaaaacaacaguauaccuacaaaugaacucucuacgagcagaagacacagcaguauauuuuugugcacgaggugacauauggggacaaggcacccuaguaacagucucaucugccucaacaaaaggaccauccguauuuccauuagccccaucaucaaaaucaacaucaggagguacagcagcauuaggcugucuaguuaaagacuacuuucccgaacccguaacuguauccuggaacucuggagcucuaacauccgguguacacacuuuuccagcaguauuacaaucaucaggauuauauucacuaucaucaguaguaaccguacccucaucaucacuaggcacacaaacauauauaugcaacguaaaccauaaaccaucaaacacaaaaguagacgcaagaguagaaccaaaaucaugugacaaaacacauaccuguccaccaugccccgcaccagaacuauuaggaggcccuucuguaacacuauuuccuccuaaaccaaaagauacacuaaugaucucaagaacaccagaaguaacauguguagugguugauguaucacaugaagacccagaaguaaaauucaacugguacguagacgguguagaaguacacaaugcuaaaacaaaaccacgagaagaacaauaugcaucaacauauagaguaguauccguacucacaguccuacaucaagauuggcuaaauggaaaagaauauaaaugcaaagucagcaauaaagcucuaccugcuccaauagaaaaaacaauaucuaaagccaaaggccaacccagagaaccacaaguuuacacacuaccuccaucuagagaagaaaugacaaaaaaucaaguaucucuaacaugucuaguaaaaggauucuaccccuccgauauagcaguagaaugggaaaguaacggacaaccugaaaauaauuacaaaacaacaccaccuguauuagacagugauggaucauucuuucuuuauucaaaauuaacaguagacaaaagccgauggcaacaaggaaauguauuuucauguagugucaugcaugaagcacuacacaaucacuauacacaaaaaagucuaucacuaucaccagguaaa

SEQ ID NO: 46850 - RNA, 657 nt, Artificial Sequence
  derived and/or modified sequence opt6 from Eptinezumab_LightChain
caaguauuaacacaaucacccucaagucuaagcgcaagcguaggagauagaguaacaauaaacugccaagcaagucaaucaguauaccauaauacauacuuagcaugguaccaacaaaaaccagguaaaguaccaaaacaauuaauauaugaugcaagcacacuagcaagcggaguaccuagcagauucucgggaucaggcucaggaacagauuuuaccuuaacaauaagcucacuacaaccagaagauguagcaacauacuauugcuuaggcucauacgauugcacaaacggagacuguuucguauucggaggaggaacaaaaguagaaauaaaacgaacaguagcagcaccaagcguauucauauucccacccucagacgaacaacuaaaaucaggcacagcaucaguaguaugcuuauuaaauaacuuuuacccacgagaagcaaaaguacaauggaaaguagauaacgcacuccaaagcggaaacucacaagaaaguguaacagaacaagauagcaaagacucaacauauagcuuaucaucaacauuaacauuaagcaaagcagauuacgaaaaacauaaaguauacgcaugcgaaguaacacaccaaggacuaagcucgccagugaccaaaucauuuaacagaggagaaugc

SEQ ID NO: 46851 - RNA, 1368 nt, Artificial Sequence
  derived and/or modified sequence opt6 from Erenumab_HeavyChain
caaguacaacuaguagaaucaggaggcggaguaguacaaccaggacgaucucuaaggcucucaugcgcagcaucaggcuucacauuuaguucauuuggaaugcauuggguacgacaagccccuggaaaaggacuagaauggguagcagucauaucauucgacggaagcauaaaauauucagucgacucaguaaaaggaagauuuacaauaucaagagauaacuccaaaaauacacuauuccuacaaaugaacucauuacgagcagaagacacagcaguauacuauugcgccagagauagauuaaacuauuacgauucauccggauacuaucacuacaaauauuacggaauggcaguauggggacaaggaacuacaguuacaguaucaucagcaagcacaaaaggaccaucaguauucccuuuagcccccuguucaagaucaacaucugaaucuacagcagcacuaggcugucuaguaaaagauuacuucccagaaccaguuaccguauccuggaacagcggcgcccuaacaucaggaguccacaccuucccugcugucuuacaaucuaguggacuguacucuuuaagcucagucguaacuguaccaaguagcaauuucgguacacaaacuuauacaugcaacguagaucauaaacccagcaacacaaaagucgauaaaacagucgaacgaaaaugcuguguagaauguccaccauguccagcuccaccagucgcaggcccauccguuuuucuuuuuccacccaaaccaaaagauacacucaugaucucuagaacaccagaaguaacaugcguagucguagacguaucacaugaagauccagaaguacaauuuaauugguauguagacggaguagaaguacauaaugcaaaaacuaaaccacgagaagaacaauuuaacuccacuuuuagaguaguuucagucuuaacaguaguacaucaagauugguuaaaugguaaagaauauaaauguaaaguaucaaacaaaggacuuccagcaccaauagaaaaaacaaucucaaaaacaaaaggacaaccaagagaaccacaaguauacacauuaccaccaucaagagaagaaaugacaaaaaaccaaguaucauuaaccugcuuagucaaaggauucuauccaucagauauagcaguagaaugggaaagcaauggacaaccagaaaacaacuacaaaaccacaccaccaauguuagacagcgacggaagcuuuuuccuauacucuaaauuaacuguagauaaaagcagauggcaacaaggaaacguauuuucuugcuccguaaugcaugaagcauuacacaaccauuauacacaaaaaucauuaucacuaucaccaggaaaa

SEQ ID NO: 46852 - RNA, 648 nt, Artificial Sequence
  derived and/or modified sequence opt6 from Erenumab_LightChain
caauccguacuaacacaaccaccaucaguaucagcagcaccaggacaaaaagucacuauauccugcucaggaucaaguucaaacauaggaaacaacuacguaucaugguaccaacaacuaccaggcacagcaccaaaacuacuaauauacgacaacaacaaaagaccaucaggaauaccagacagauucucaggcucaaaaucaggaacaucaacaacacuaggaauaacaggacuacaaacaggcgacgaagcagacuacuauugcggaacaugggacucaagacuaucagcaguaguauucggaggaggaacaaaacuaacaguuuuaggacaaccaaaagcaaaccccacaguaacacuauucccaccaucaucagaagaacuacaagcaaacaaagcaacauuaguaugucuaauaucagacuucuaccccggagcaguaacaguagcauggaaagcagacggaucaccaguaaaagccggcguagaaacaacaaaaccauccaaacaaucaaacaacaaauacgcagccucaucauaccuaucccuaacaccagaacaauggaaaucacauagaucauacucaugccaaguaacacacgaaggaucaacagucgaaaaaacaguagcaccaacagaaugcagc

SEQ ID NO: 46853 - RNA, 1344 nt, Artificial Sequence
  derived and/or modified sequence opt6 from Fremanezumab_HeavyChain
gaaguacaacuuguugaaucgggaggaggccuaguacaacccggaggaucuuuaagacuuucaugugcagcaucaggauucacauucaguaauuacuggauaucauggguuagacaagcaccaggaaaaggacuagaauggguagcugaaauaagaucagaauccgaugcauccgcaacccauuacgcagaagcaguaaaaggaagauucacaauaucaagagauaacgcuaaaaacucuuuauacuuacaaaugaauagccuaagagcagaagauacagcaguuuacuauugccuagcauauuucgauuauggacuagcaauacaaaacuacuggggacaaggaacauuagucacaguauccucagcaucuacaaaaggacccucaguauuccccuuagcacccugcucaagaucaacauccgaaaguacagcagcauuaggaugucuaguaaaagauuacuuucccgaaccaguuacaguaagcuggaacaguggagcccuuacaaguggaguccauacauuucccgcaguauuacaaucaucaggacucuauagcuuaucaucaguaguaacaguacccuccaguaacuucggaacucaaacauauaccugcaacguugaccacaaaccauccaauacaaagguagauaaaacaguagaaagaaaaugcuguguagaaugcccacccuguccagcacccccaguagcaggacccaguguauuuuuauucccaccaaaaccaaaagacacauuaaugaucucacgaacccccgaaguaacauguguaguaguagacguaucacaugaagauccagaaguccaauuuaauugguacguagauggaguagaaguacacaaugcaaaaaccaaaccaagagaagaacaauuuaacucaacauuuagaguaguuucaguccuaaccguaguacaucaagauugguuaaacggcaaagaauauaaauguaaaguuuccaacaaaggccuaccaucuucuauagagaaaacaauuucaaaaacaaaaggucaacccagagaaccacaaguauauacacuaccaccaucacgugaagaaaugacuaaaaaucaaguaucucuaacaugccuaguaaaaggauucuacccaucagacauagcagucgaaugggaaucaaauggacaaccagaaaacaauuacaaaacaacaccaccaauguuagauucagacggaucauuuuucuuauacucaaaacuuaccguagacaaaucaagauggcaacaagggaacguauucucauguucaguaaugcaugaagcacuacacaaucacuauacacaaaaaucacuaagucuaagcccagguaaa

SEQ ID NO: 46854 - RNA, 642 nt, Artificial Sequence
  derived and/or modified sequence opt6 from Fremanezumab_LightChain
gaaauaguacuaacacaaucaccagccacccuaucacuaagcccaggcgaaagagcaacacuaucaugcaaagcaucaaaacgagucacaacauacguaucaugguaccaacaaaaaccaggacaagcaccaagacuccuaauauacggcgcaucaaacagauaccuaggaauaccagcaagauucucaggaucaggaucaggaacagacuucacacuaacaauuucaucucuagaacccgaagacuuugcaguauacuauugcucacaaucauacaacuacccauacacauucggccaaggaacaaaacuagaaauaaaacgaacaguagcagccccaucaguauucauauucccaccaucagacgaacaacuaaaaucaggaacagcaucagucguaugccuacucaacaauuucuacccaagagaagcaaaaguacaauggaaaguagacaacgcacuacaauccggaaacucacaagaaucaguaacagaacaagacucaaaagacucaacauacucacuauccucaacccuaacacuaucaaaagcagacuaugaaaaacauaaaguauacgcaugugaaguaacacaccaaggacuaucaucaccaguaacaaaauccuucaaccgaggcgaaugc

SEQ ID NO: 46855 - RNA, 1371 nt, Artificial Sequence
  derived and/or modified sequence opt6 from Frunevetmab_HeavyChain
caaguacaauuaguagaaagcggagcagaauuaguacaaccaggagaaucacuucgacuaacaugcgcagcaaguggauucucacuaacuaacaauaauguaaacuggguccgucaagcaccagguaaaggucuagaauggaugggcggcguaugggcaggaggagcaacagacuacaacucagcgcuaaaaucucgacuaacaaucacucgagacacaucuaaaaauaccguuuuccuacaaaugcauagucuacaaucugaagauacagcaacauauuauugcgcaagagacggcggauacucauccucaacauuauacgcaauggacgcauggggccaaggaacaaccguaacaguaucagcagcaucaacuacugcaccaucaguauucccacuagcaccaucuugcggcacuacauccggagcaacaguagcacucgcuugccuaguauugggauauuuuccagaaccuguaacaguaucauggaauaguggugcauuaacuucgggaguacauaccuuuccagcuguacuucaagcaucuggauuauauucacuuucaucaaugguuaccguucccuccucaagauggcucucagacacauuuacauguaauguagcccacccacccucuaacacaaaaguagacaaaacuguucguaaaacugaccacccaccaggcccaaaaccaugugacugcccaaaaugcccaccaccggaaaugcuaggaggaccaucaauauucauauuuccucccaaaccaaaagauacauuaucaauaucaagaacaccugaaguaacaugccuaguuguagaccuagguccagaugacucugauguacaaauaacaugguuuguagacaauacucaaguuuacacagccaagacaucaccacgagaagaacaauucaacucaacuuaccgcguaguaucaguuuuaccuauucuacaucaagacugguuaaaagguaaagaauuuaaaugcaaaguaaauuccaaaaguuuaccuucuccaauagaacgaacaauaucaaaagcaaaaggacaaccacaugaaccccaaguuuauguacucccaccagcacaagaagaacucucaagaaauaaaguaucaguuacaugcuuaauaaaaucauuccacccaccagacauagccgucgaaugggaaauaacaggacaaccagaaccagaaaauaacuaucgaaccacaccaccacaacuagauuccgacggaaccuauuucgucuacucuaaacuaucuguagauaggucucauuggcaacguggaaauaccuacacuugcucuguaucacaugaagcauuacacucacaucacacucaaaaaucauuaacacaaucgccuggaaaa

SEQ ID NO: 46856 - RNA, 651 nt, Artificial Sequence
  derived and/or modified sequence opt6 from Frunevetmab_LightChain
gauauagaaaugacacaaucaccacuaucacuaucagucacaccaggcgaaucaguaucaauaucaugcagagcaucagaagacauauacaacgccuuagcaugguacuuacaaaaaccaggaagaucaccaagacuacuaaucuacaacacagacacacuacacacaggaguaccagacagauucucaggaucaggcucaggaacagacuuuacauuaaaaauauccagaguacaaacagaagacguaggaguauacuucugccaacacuacuuccacuacccaagaacauucggacaaggaacaaaacuagaacuaaaaagaucagacgcacaaccaucaguauuccuauuccaaccaucacuagacgaacuacacacaggaucagcaucaauaguaugcauacuaaacgacuucuacccaaaagaagucaacguaaaauggaaaguagacggcguaguacaaaacaaaggaauacaagaaucaacaacagaacaaaacucaaaagacaguacauauucacuaucaucaacacuaacaaugucaucaacagaauaccaaucccacgaaaaauucucaugcgaagucacacacaaaucauuagcaucuacucuaguaaaaucauuuaacagaagcgaaugccaaagagaa

SEQ ID NO: 46857 - RNA, 1341 nt, Artificial Sequence
  derived and/or modified sequence opt6 from Gatipotuzumab_HeavyChain
gaaguucaauuaguagaauccggaggcggcuuaguacaaccaggaggaucuaugagauuauccugcguagcaagcggauucccauucucaaauuacuggaugaacuggguaagacaagcaccuggaaaaggcuuagaauggguaggugaaauaagauuaaaaucuaacaacuauaccacucacuacgcagaaagcgucaaaggaagauuuacaauaucaagagacgacucaaaaaauucacuuuaucuacaaaugaacucccuaaaaacagaagauacagcagucuauuauuguacaagacacuauuacuucgacuacuggggacaaggaacauuaguaacagucucaucagccucaacaaaagguccauccguauucccucuagcaccaucaucaaaaucaacaucaggaggcaccgcagcucuaggaugucuaguuaaagacuacuuccccgaaccaguuacuguaucauggaacucaggcgcacuaacaucaggcguacacacauucccagcaguacuacaaucaucaggacuauacucacuaucaagcguugucacaguacccucaucaucacuaggaacccaaacauauaucugcaacguaaaucauaaacccucaaauacaaaaguagacaaaaaaguagaaccaaaauccugcgauaaaacacacaccugcccaccaugcccagcacccgaacuccuaggaggcccuucagucuuccuauuuccuccaaaaccaaaagacacacucaugauaucaagaacaccugaaguaacaugcgucguugucgacguaucccaugaagauccagaaguaaaauucaacugguauguagauggagucgaaguacauaacgccaaaacaaaaccaagagaagaacaauacaacucuacauacagaguagucucaguacuaacaguccuacaccaagacuggcuaaacggaaaagaauacaaguguaaaguaucaaacaaagcacucccagcaccaauagaaaaaacaauaucaaaagcaaaaggucaaccaagagaaccacaaguauacacccuaccaccaucacgagaugaauuaaccaaaaaccaaguaucacuaacaugucuagucaaaggauucuacccuucugacauagcaguagaaugggaaucuaacggucaaccagaaaauaacuacaaaacuacaccaccaguucuagauucugacggauccuucuucuuauauucaaaacuaacuguagauaaaaguagauggcaacaaggaaacguauucucauguucaguaaugcacgaaggauuacacaaucacuacacacaaaaaucauuaucauuaucaccaggaaaa

SEQ ID NO: 46858 - RNA, 657 nt, Artificial Sequence
  derived and/or modified sequence opt6 from Gatipotuzumab_LightChain
gauauaguaaugacacaaucaccacuaucaaacccaguaacaccaggagaaccagcaucaauaucaugccgauccucaaaaucacuacuacacucaaacggaauaacauacuucuucugguacuuacaaaaaccaggacaaucaccacaacuacucaucuaccaaaugucaaaccuagcaucaggaguaccagaccgauucucaggaucaggaucaggaacagacuucacauuaagaauauccagaguagaagcagaagacgucggaguauacuacugcgcacaaaacuuagaacuacccccaacauucggacaaggaacaaaaguagaaauuaaaagaacuguagcagcaccaucagucuucauauucccaccaucagacgaacaauuaaaaucaggcacagcaucaguaguaugccuacuaaacaauuucuacccaagagaagcaaaaguacaauggaaaguagacaacgcacuacaaucaggaaacucacaagaaucaguaacagaacaagacucaaaagacucaacauauucacuauccucaacacuaacauuaucaaaagccgacuacgaaaaacacaaaguauacgcaugcgaaguaacacaccaaggacuaucaucaccagucacaaaaucuuucaacagaggugaaugc

SEQ ID NO: 46859 - RNA, 1365 nt, Artificial Sequence
  derived and/or modified sequence opt6 from Gedivumab_HeavyChain
gagguacaauuaguugaaaguggaggaggcgucguacaaccaggaaaaucucuacgauuaucaugcgcugcaucaggcuuaacauucagcuccuacgccguccauugggucagacaagcaccaggcaaaggauuagaaugggucacacuaauaucauaugacggagcaaaucaauauuaugccgacagcguaaaaggaagauuuacaauaucccgagacaacucaaaaaauacagucuacuuacaaaugaacucuuuaagacccgaagacacagcaguauacuacugugcaguacccggaccaguauuuggaauauucccccccuggucuuacuucgauaacuggggacaaggaauacuaguaacaguauccucagcaucuacaaaaggcccaaguguauuuccauuagccccaucauccaaaucaacaucaggaggaacagcagcacuuggaugucugguuaaagacuacuuuccagaaccaguaacaguaucauggaauucaggagcauuaacaucuggaguccauacauuccccgcuguacuccaaucaucaggacuauacucacucucaucaguugucacaguaccuucauccagccucgguacacaaacauacauuuguaauguaaaccauaaacccucaaauacaaaaguagacaaaaaaguagaaccaaaaucaugugacaaaacacacacaugcccaccauguccugcaccugaacuacuaggaggaccaucaguauuccuauuuccaccuaaaccaaaagacacacuaaugaucucacgaacaccagaaguaacaugcgucgucguagacguaucccacgaagaccccgaaguaaaauucaauugguauguagacggaguagaaguucacaacgccaaaaccaaaccuagagaagaacaauacaauucaacuuauagaguagucucaguauuaacaguauuacaccaagacuggcuaaauggaaaagaauacaaaugcaaaguaucaaacaaagcacuaccagcaccaauagaaaaaacaauaucaaaagcaaaaggacaacccagagaaccacaaguauacacacuaccaccaagucgagaagaaaugacaaaaaaccaaguaucauuaacuugccucguuaaaggauucuauccuucagacaucgcagucgaaugggaaucaaauggacaaccagaaaacaacuacaaaacaacaccucccguauuagacucagacggcucuuucuuccuauacucuaaacuaacuguagacaaaucaagauggcaacaaggaaacgucuucuccugcucaguaaugcacgaagcacuucacaaucacuacacucaaaaaucuuuauccuuaaguccagguaaa

SEQ ID NO: 46860 - RNA, 648 nt, Artificial Sequence
  derived and/or modified sequence opt6 from Gedivumab_LightChain
gaaauaguacucacacaaucaccagccacacuaaguguaucaccaggagaaagagcaacacuaucaugcagagccucacaaguaauaucacacaaccuagcaugguaccaacaaaaaccaggacaagcuccaagacuacuaauauacggagcaucaacaagagcaucaggaauaccagccagauuuucaggaucaggaucaggcacagacuacaccuuaacaauaacaucacuacaaagcgaagacuucgcaguauacuacugccaacauuacagcaauuggccaccaagacuaacauucggaggaggaacaaaaguagaaauaaaaagaacaguagcagcaccaucaguauucauauucccaccaucagaugaacaauuaaaaucaggaacagcaucaguaguaugccuauuaaacaacuucuacccaagagaagcaaaaguccaauggaaaguagacaacgcacuacaaagcggaaauucacaagaaucaguaacagaacaagacagcaaagacucaacauacucacuaagcucaacacuaacauuaucaaaagccgacuacgaaaaacacaaaguauacgcaugcgaaguaacacaccaaggacuaucauccccaguaacaaaaucauucaacagaggagaaugc

SEQ ID NO: 46861 - RNA, 1329 nt, Artificial Sequence
  derived and/or modified sequence opt6 from Gemetuzumab_HeavyChain
gaaguacaacucguacaaucuggagcugaaguaaaaaaaccagguuccaguguuaaaguaucuugcaaagcauccggauauacaaucaccgauucaaacauacacuggguaagacaagcaccuggacaaucauuagaauggauaggauacauauauccauauaauggaggcacagacuauaaucaaaaauucaaaaaccgcgcaacacuaacaguugacaaccccacaaacacagcauacauggaauuauccucuuuacguucagaagacacagcauucuacuauugcguaaauggcaacccguggcuagccuacuggggacaaggaacacuagucacaguaagcuccgccucaacaaaaggaccaucuguauuuccguuagccccauguucaagaucaacaagugaaucaacagcagcauuaggaugccuaguaaaagauuacuuuccugaaccugucaccguaucauggaauuccggagcauuaacauccggaguacacacauucccagcuguauuacaaucaucaggauuauacucauuaucauccguaguuaccguaccaaguucauccuuaggaacaaaaacauauaccugcaacguagaucauaaaccaucaaauacaaaaguagauaaaagaguagaaucaaaauacggaccaccaugcccuccauguccagcaccagaauuccuaggaggcccaucaguauuucuauucccaccaaaaccaaaagacacacuaaugauaucacgaacaccugaaguaacauguguaguaguagacguaucacaagaagacccugaaguccaauuuaauugguacguagauggaguagaaguacacaaugcaaaaacaaaaccaagagaagaacaauuuaacucaaccuaccgagucguaucaguauuaaccguauuacaucaagacugguuaaacggaaaagaauacaaauguaaaguuucaaacaaaggccuaccaucaucaauagaaaaaacuauauccaaagcaaaaggacaacccagagaaccacaaguauacacacuuccaccaucacaagaagaaaugacuaaaaaccaaguaucauuaacauguuuaguaaaaggcuucuacccaucagacauugcaguagagugggaaucaaacggacaaccagaaaauaacuacaaaacaacucccccaguacuagauucagacggcucauucuuccuauauagcagacuaaccguagacaaaucccguuggcaagaaggaaacguauuuucaugcuccguaaugcacgaagcauuacauaaccacuacacccaaaaaucacuaucacucagcuuaggaaaa

SEQ ID NO: 46862 - RNA, 654 nt, Artificial Sequence
  derived and/or modified sequence opt6 from Gemetuzumab_LightChain
gacauacaauuaacacaaucacccucaacacuaucagcaagcguaggagaccgaguaacaauaacaugcagagcaucagaaucacuagacaacuauggaauaagauucuuaacaugguuccaacaaaaaccuggaaaagcaccaaaacuacuaauguacgcagcaucaaaccaaggaucaggcguaccaaguagauucucaggaucaggaucaggaacagaauucacauuaaccauauccucacuacaaccagacgacuucgcaacauacuacugccaacaaacaaaagaaguaccauggucauucggacaaggaacaaaaguagaaguaaaaagaacaguagcagcaccaucagucuucaucuucccaccaucagacgaacaacuaaaaucaggaacagcaucaguaguaugccuacuaaacaacuucuacccacgagaagcaaaaguccaauggaaaguagacaacgcacuacaaagcggaaauucacaagaaucaguaacagaacaagacagcaaagacucaacauacucauuaucaucaacacuaacacuaucaaaagcagacuacgaaaaacacaaaguauacgcaugcgaagucacacaccaaggccuaaguucaccaguaacaaaauccuucaacagaggagaaugc

SEQ ID NO: 46863 - RNA, 1365 nt, Artificial Sequence
  derived and/or modified sequence opt6 from Gilvetmab_HeavyChain
gaaguacaauuaguacaaaguggaggagaucuaguuaaaccaggaggaagcguaagacuaucuuguguugcaaguggauuuaauauuaaaaauacauacaugcauuggguaagacaagcaccaggaaaaggauuacaauggauaggccgaauagcaccagcgaauguagacacaaaauacgcuccaaaauuccaagguaaagcaacuauaucagcagacacagccaaaaauacagcauacaugcaacucaacagccuaagagcagaagacacugcaguauacuauugcguacuaauuuacuacgauuaugacggagauauagauguauggggucaaggaacucuaguaacaguaucuucagcaucaacaacugcucccaguguauuuccauuagcaccaucaugcggaaguacaucugggucaacaguagcucuugcaugcuuaguaucagguuauuuuccagaaccaguaacaguaagcuggaauagcggaucacuuacaucaggaguucacaccuuuccaucagucuuacaauccucaggucuauacucauuaucaucuaugguuacaguaccaaguucaagauggccauccgaaaccuucacauguaacgucgcacacccagcauccaaaacaaaaguagauaaaccuguacccaaacgagaaaaugggagaguaccaagaccaccagacugccccaaauguccagcaccagaaauguuaggagguccaucaguauucauauuuccaccaaagccaaaagauacacuacuaauugcuaggacaccagaaguuacauguguaguuguagcuuuagaucccgaagaccccgaaguacaaauaucaugguuuguugaugguaaacaaaugcaaacagcaaaaacucaaccaagagaagaacaauuugcaggcacuuauagaguaguaucaguacuaccaauaggccaucaagauuggcucaaagguaaacaauucacauguaaaguaaacaauaaagcucuaccaucaccuauagaaagaaccaucucaaaagcaaggggacaagcacaccaaccaucaguauauguuuuacccccaucaagagaagaauuauccaaaaauacaguaucacuuacaugucuaauaaaagauuucuucccaccugacauagacguagaauggcaauccaacggucaacaagaaccugaauccaaauaucgaacaacaccuccacaacuagaugaagauggaucuuacuucuuauauucaaaacuaucuguagauaaaucacgauggcaaagaggagauacuuuuauaugugcaguaaugcacgaagcauuacauaaccauuauacacaagaaucacuaucacacucccccggaaaa

SEQ ID NO: 46864 - RNA, 654 nt, Artificial Sequence
  derived and/or modified sequence opt6 from Gilvetmab_LightChain
gacauaguaaugacacaaacaccacuaucacuaucaguaucauuaggcgaaccagcauccauaucaugccacgcaucucaaaacauaaacguuuggcuaucaugguauagacaaaaaccaggacaaauaccccaacuacuaauauacaaagcaucacaccuacacacaggagucccagacagauucucaggaucaggcucaggaacagacuucacacuaagaauaucaagaguagaagccgacgacgcaggcguauacuauugccaacaaggacaauccuggccacuaacauucggacaaggaacaaaaguagaaauaaaaagaaacgacgcacaaccagcaguauaccuauuccaaccaucaccagaccaauuacacacaggaucagcaucaguaguaugcuuacuaaacucauucuacccaaaagauauaaacguaaaauggaaaguagacggaguaauacaagacacaggaauacaagaaucaguaaccgaacaagacucaaaagacucaacauacucacuaucaucaacacuaaccauguccucaacagaauaucuaucacacgaacuauacucaugcgaaauaacacacaaaucacuaccaucaacauuaauaaaaucauuccaaagaucagaaugccaaagaguagac

SEQ ID NO: 46865 - RNA, 1344 nt, Artificial Sequence
  derived and/or modified sequence opt6 from Ifabotuzumab_HeavyChain
caaguccaacuaguacaaucaggagcagaaguaaaaaaaccaggagcaagcguaaaaguauccuguaaagcaucaggauacacauucaccggauauuggaugaauuggguaagacaagcacccggucaaggauuagaauggaugggugacauauauccaggaucaggaaauacaaacuaugacgaaaaauuccaaggaagaguaacaaugacaagagacacuucaauaagcacagcauauauggaauuaaguagauuaagaucagaugauacagcaguauauuacugugcacgaggaggauacuaugaagacuucgauagcuggggacaaggcacaacagucacaguuagcucugcaucaacaaaaggcccgucagucuucccucuagcaccgaguagcaaaaguacaagcggaggaaccgcagcauuaggauguuuaguuaaagacuacuucccagaaccaguaacaguaucauggaauucaggagcacuaacaucaggcguacauacauuccccgcagucuuacaaucaagcggacuauacucacuaucaucaguaguaacaguacccucaucuagccuaggaacacaaacauacauaugcaacgucaaucacaaaccaucaaauacaaaaguagacaaaagaguagaaccaaaaucaugugauaaaacacauacaugcccaccaugcccagcaccagaauuauuaggaggaccaucaguauuccuauuuccaccaaaaccuaaagacacacucaugauaucaagaacaccugaaguuacaugcguaguaguagacguaucacaugaagauccagaaguaaaauuuaacugguauguagacggcguagaaguacauaacgcaaaaacaaaaccaagagaagaacaauacaacucaacauauagaguaguuucaguauugacaguacuacaccaagacuggcuaaauggcaaagaauauaaauguaaaguaucaaacaaagcacuaccggcaccgauagaaaaaacaauaaguaaagcaaaaggacaaccaagagaaccacaaguauauaccuuaccacccagcagagaagaaaugacuaaaaaucaaguaucacuaacaugccuaguuaaagguuucuacccaagcgacauagcaguagaaugggaaucaaauggacaaccugaaaauaacuauaaaacaacaccaccaguuuuagacuccgauggaucauucuuucuauacuccaaacuaacaguagacaaaucaagauggcaacaaggaaacguauuuucauguucagugaugcaugaagcauuacacaaccauuacacccaaaaaagcuuaagcuuaucacccggaaaa

SEQ ID NO: 46866 - RNA, 642 nt, Artificial Sequence
  derived and/or modified sequence opt6 from Ifabotuzumab_LightChain
gacauacaaaugacacaaucaccaucauucuuaucagcaucagucggcgacagaguaacaauaacaugcagagccucccaaggaauaauaucauaccuagcaugguaccaacaaaaaccagaaaaagcacccaaaagacuaaucuacgcagccuccucacuacaaucaggaguaccaucaagauucucaggauccggcucagguacagaauucacacuaacaauaucaucacuacaacccgaagacuucgcaacauacuacugcggacaauacgcaaauuacccauacacauucggacaaggaaccaaacucgaaauaaaaagaacaguagcagcaccauccguauucauauucccaccauccgacgaacaacuaaaaucaggaacagcaucagucguaugcuuacucaacaacuucuacccaagagaagcaaaaguacaauggaaaguagacaacgcacuacaauccggaaacucacaagaaucaguaacagaacaagacucaaaagacucaacauacucacuaucaucaacacuaacacuuucaaaagcagacuacgaaaaacacaaaguauaugcaugcgaaguaacacaccaaggauuauccucaccagucacaaaaucauucaacagaggagaaugc

SEQ ID NO: 46867 - RNA, 1323 nt, Artificial Sequence
  derived and/or modified sequence opt6 from Iratumumab_HeavyChain
caaguccaacuucaacaauggggagcaggucuacuaaagccaucagaaacacuaucccuaacaugcgcagucuacggaggaaguuucucagccuacuacuggucauggauacgucaaccaccagguaaaggacuagaauggauaggagacaucaaccacggaggaggaacaaacuauaacccauccuuaaaaucacgagucaccauaucuguagacacaucaaaaaaccaauucucauuaaaacucaacaguguaacagcagcagacaccgccgucuauuacugcgccagccuaacagcauacuggggacaaggaucauuaguaacugucucaucagccucaacaaaaggaccaucagucuuuccauuagcaccuucaucuaaaucaacuucaggaggaacagcagcacuaggcugcuuaguaaaagacuacuucccagaaccaguuacaguaaguuggaauucaggagcacucaccucaggaguccauacauuccccgcaguacuccaaucaucaggacuauacucacucucaaguguaguaacaguaccaucaucaucccuuggaacacaaacauacauuuguaacguaaaccacaaaccaucaaacacaaaaguagauaaaaaaguagaacccaaauccugugauaaaacucacacaugcccaccaugucccgcaccugaauuacucggaggucccucaguauuuuuauuuccaccaaaaccaaaagauacacuaaugauaucacguacaccagaaguaacaugcguagucguagacguaucacaugaagacccagaagucaaauucaauugguacgucgacggaguagaaguacacaacgcuaaaacaaaaccuagagaagaacaauauaauagcacuuacagaguuguaucaguauuaacaguacuccaucaagacuggcuaaacggaaaagaauacaaauguaaaguauccaacaaagcucuaccagcaccaauagaaaaaacaauuucuaaagcaaaaggucaaccaagagaaccacaaguauauacacucccaccaucaagagaugaacuaaccaaaaaucaaguaucucuuacaugccuaguaaaaggcuuuuacccaucagauauagcaguagaaugggaauccaauggucaacccgaaaacaacuacaaaacaacaccuccaguccucgacucagacgguucauucuuucucuacuccaaacuaacaguagacaaaagccgauggcaacaaggaaauguauucucauguucaguaaugcacgaagcacuucacaaccauacacaaaaauccuuaucacuaucaccaggaaaa

SEQ ID NO: 46868 - RNA, 642 nt, Artificial Sequence
  derived and/or modified sequence opt6 from Iratumumab_LightChain
gacauacaaaugacccaaucacccacaucccuaagcgcaucaguaggagaccgaguaacaauaacaugccgagcaucccaaggaauauccucauggcuaacaugguaccaacaaaaaccagaaaaagcuccaaaaucacuaauauacgcagcaucaucucuccaaucaggaguaccaucaagauucuccggaucaggcucaggaacagacuuuacacuaacaauaucaucacuccaaccagaagacuucgcaacauacuacugccaacaauacgacucauacccaaucaccuucggacaaggaacaagacuugaaauaaaaagaacaguagcagcaccaucaguauucauauucccaccauccgacgaacaauuaaaaucaggcacagcaucaguaguaugccuacuaaacaacuuuuacccaagagaagcaaaaguccaauggaaaguagacaacgcacuacaaucaggaaacucacaagaaucaguaacagaacaagacucaaaagacucaacauacucacuaucaucaaccuuaacacuaagcaaagcagacuacgaaaaacacaaaguauacgccugcgaagucacacaccaaggacuaucaucucccgucacaaaauccuucaacagaggcgaaugc

SEQ ID NO: 46869 - RNA, 1344 nt, Artificial Sequence
  derived and/or modified sequence opt6 from Lacnotuzumab_HeavyChain
caaguacaacuccaagaaucaggaccaggacuugucaaacccucacaaacacuaucacuaacaugcaccguaucagacuacuccauaacaucagauuaugcauggaauuggauacgccaauucccaggcaaaggacuagaauggaugggauacauaucuuauucaggaucaacaucauacaacccaucauugaaaucaagaauaacaauaucaagagauacaucuaaaaaccaauuuagccuacaacucaacagcguaaccgcugcagauacugcaguauacuacugcgccucauucgacuacgcacacgcaauggacuacuggggacaaggaacaacugucacaguaaguuccgcaucuacaaaaggacccucaguauucccccuagcacccucaucaaaauccacaucaggaggaacagcagcauuaggcugccucguuaaagauuauuuucccgaaccaguuacagucucauggaacucaggagcauuaacaucagguguacacacauucccagcaguauuacaaucauccggauuauauucacuaucaucaguuguaacaguaccauccucaucauuaggcacacaaaccuauauaugcaacguaaaccauaaaccauccaauacaaaaguagacaaaagagucgaacccaaaucaugugauaaaacacauacaugcccaccaugccccgcaccagaacuacuaggaggacccuccguauuucuauuuccaccgaaaccaaaagacacacuaaugauaucacgaacaccagaaguaacauguguagucguagacguaucacaugaagauccagaaguaaaauuuaacugguacguagacggugucgaaguacacaacgccaaaacaaaaccccgcgaagaacaauacaacucaaccuacagaguuguuucaguucuuaccgucuuacaccaagacuggcucaacggcaaagaauacaaauguaaaguauccaacaaagcacucccagcaccaauugaaaaaacaauaucaaaagcaaaaggacaaccaagagaaccacaaguuuacacauuaccacccucaagagaagaaaugacuaaaaaucaaguaucauuaacaugccuagucaaaggcuucuaccccucagacauagcaguagaaugggaaucaaaugggcaaccagaaaauaauuacaaaacaacaccaccuguacuagacuccgacggauccuuuuucuuauacuccaaauuaacaguagauaaaucccgauggcaacaaggaaacguauuuucuugcucuguaaugcacgaagcacuucacaaucacuacacacaaaaaucucucucauuaucaccuggaaaa

SEQ ID NO: 46870 - RNA, 642 nt, Artificial Sequence
  derived and/or modified sequence opt6 from Lacnotuzumab_LightChain
gacauaguauuaacacaaucacccgcauuccuaucaguaaccccaggcgaaaaaguaacauucaccugucaagcaucacaaucaauaggcacaucaauacacugguaccaacaaaaaacagaccaagcaccaaaacuacuaauaaaauacgcaucagaaucaauaagcggaaucccaucaagauucucaggcucaggcucaggaacagacuucacacuaacaauaucaucagucgaagcagaagacgcagcagacuacuacugccaacaaauaaacucauggccaacaacauucggaggagguacaaaacuagaaauaaaaagaacaguagcagcaccaucaguauucauauucccaccaucagacgaacaacuaaaaucaggcacagcaucuguaguaugccuacuaaacaacuucuacccaagagaagcaaaaguacaauggaaagucgacaacgcacuacaaagcggaaacucacaagaaagcguaacagaacaagacucaaaagacucaacauacagccuaucaucaacacuaacauuaucaaaagcagacuacgaaaaacacaaaguauacgcaugcgaagucacacaccaaggauuaucaucaccaguaaccaaauccuucaacagaggagaaugc

SEQ ID NO: 46871 - RNA, 1347 nt, Artificial Sequence
  derived and/or modified sequence opt6 from Larcaviximab_HeavyChain
gaaguacaacuccaagaaucaggcccagaacuagaaaugccaggagcaucuguaaaaauuuccuguaaagcaucaggaucaucauucacugguuucuccaugaacuggguuaaacaaucaaacggaaaaucacuagaauggauuggaaauauagauacauauuacggaggaacuacauauaaucaaaaauucaaaggaaaagcaacacucaccguagacaaaagcucaucaacagccuauaugcaacuaaaaucccucacuucagaagauucagcaguauacuauugugcaagaagcgcauacuacggaucaacuuuugcauacuggggacaaggcacacuaguaacagucucagcagcuucaacaaaaggaccaucaguauucccacuugcaccaucaucaaaaucaacaucaggagguacagcagcauuaggaugucuaguaaaagacuacuucccagaacccgucacaguaucauggaauucaggagcauuaacuaguggaguacauacauucccugcaguccuacaaucauccggacucuauagcuuaucuucaguagucacugucccaucaucaucacucggaacacaaacauauauauguaacgucaaucauaaaccaucaaauacaaaaguagacaaaagaguugaaccuaaauccugugacaaaacucacacaugccccccaugcccugcaccagaacuauuaggaggcccaucuguauuccuauucccaccaaaaccaaaagacacccuaaugauaucaagaacaccagaaguaacaugcgucguaguugacguuucacacgaagacccagaaguaaaauuuaauugguacguagacggcguagaaguacacaacgcaaaaacaaaaccaagagaagaacaauauaacucaacauauagaguaguuucaguauuaacaguacuacaucaagauuggcucaacggaaaagaauacaaaugcaaaguaucaaacaaagcccuuccagcaccuauagaaaaaacaaucucaaaagcaaaaggacaaccaagagaaccucaaguuuacacccuaccccccucgagagaugaauuaaccaaaaaucaaguaucccuuacuugcuuagucaaaggauuuuaucccagcgacauagcagucgaaugggaauccaacggacaaccagaaaacaacuauaaaacaaccccaccaguacuugacagugacggaucauucuuccucuacucaaaacuaacaguagacaaaucaagauggcaacaaggcaacguauucucuuguucagucaugcaugaagcauuacacaaucacuauacacaaaaauccuuaucuuuaucuccaggcaaa

SEQ ID NO: 46872 - RNA, 642 nt, Artificial Sequence
  derived and/or modified sequence opt6 from Larcaviximab_LightChain
gacauacaaaugacacaaucaccagcaucauuaagcgcaucaguaggagaaacagucacaauaacaugcagagcaucagaaaacauauacucauaccuagcaugguaccaacaaaaacaaggaaaauccccacaacuauuaguauacaacgcaaaaacacuaauagaaggaguaccaucaagauucucaggaucaggaucaggaacacaauucucacuaaaaauaaacucacuacaaccagaagacuucggaucauacuucugccaacaccauuucggaacaccauucacauucggaucaggaacagaacuagaaauaaaacgaacaguagcagccccaagcguauucauauuuccaccaucagacgaacaacuaaaaucaggaacagcaucaguaguaugccuacuaaacaacuucuacccacgagaagccaaaguacaauggaaagucgacaacgcacuacaaucaggaaacucacaagaaucaguaaccgaacaagauucaaaagacucaacuuacucacuaucaucaacacuaacauuaagcaaagcagacuacgaaaaacacaaaguauacgcaugcgaagucacacaccaaggccuaagcucaccaguaacaaaaucauucaacagaggagaaugc

SEQ ID NO: 46873 - RNA, 1338 nt, Artificial Sequence
  derived and/or modified sequence opt6 from Lendalizumab_HeavyChain
caaguacaauuaguacaaucuggagcugaaguaaaaaaacccggugccucagucaaaguaucaugcaaagcaucaggauauacauucacagauuacaguauggauuggguacgucaagcaccaggccaaggacuagaauggaugggugcaauacauuuaaacacaggauauacaaauuacaaucaaaaauucaaaggaagagucacaaugacacgcgacaccucuacaucaacaguauauauggaacuaagcucacuaagaucugaagacacugcaguauacuacugugcaagaggcuuuuacgacggauauucaccaauggacuacuggggacaaggaacaacagucacaguaaguucagcgucaacaaaaggcccaucagucuuccccuuagcaccaugcucaagaucaaccucggaaucaaccgcagcccuaggaugcuuaguaaaagacuacuucccagaaccaguaacaguaaguuggaacucuggagcacuaaccaguggaguacauacauuuccagccgucuuacaaucaucaggauuauacucauuaucauccguaguuaccguaccaucuagcaacuucggaacacaaacuuacaccuguaauguugaccauaaaccaaguaauacuaaaguugacaaaacaguagaacgaaaauguugcgucgaaugcccuccaugcccagcucccccaguagcaggaccaaguguauucuuauuuccaccaaaaccaaaagacacauuaaugauaucacgcacaccagaaguaacauguguagucguugauguaucacaagaagauccagaaguucaauucaacugguacguagacggaguugaaguacacaaugcaaaaaccaaaccaagagaagaacaauucaacagcacuuauagaguaguaagcguauuaacagucuuacaccaagauugguuaaauggaaaagaauacaaaugcaaaguaucaaacaaaggacuaccaucauccauagaaaagacaauaaguaaagcaaaaggacaacccagagaaccacaaguauacacacuaccaccuucucaagaagaaaugacaaaaaaccaaguaagcuuaacaugccucguaaaagguuucuauccaucagauaucgcaguagaaugggaaaguaacggccaaccagaaaacaacuauaaaacaacacccccagucuuagauucagacggaagcuuuuuucuauacuccagauuaacaguugacaaaucuagauggcaagaaggaaacguauuuaguugcucaguaaugcacgaagcacuacauaaucacuauacacaaaaaucccuaagcuuaucacuaggaaaa

SEQ ID NO: 46874 - RNA, 654 nt, Artificial Sequence
  derived and/or modified sequence opt6 from Lendalizumab_LightChain
gacauccaaaugacacaaagcccaucaagccuaagcgcaagcguaggcgaccgaguaacaauaacaugcagagcaucagaaagcguagacucauacggaaacucauucaugcacugguaccaacaaaaaccaggaaaagcaccaaaacuauuaauauacagagcaagcaaccuugaaucaggaguaccaucaagauucucaggcucaggaucaggaacagacuuuacacuaacaauaucaucacuacaaccagaagacuucgcaacauacuacugccaacaaucaaacgaagacccauacacauucggaggcggaacaaaaguagaaauaaaaagaacaguagcagcaccaagcguauucauauuuccaccaucagacgaacaacuaaaaucaggcacagcaucaguaguaugcuuacuaaacaacuucuacccaagagaagcaaaaguacaauggaaaguagacaaugcacuacaaagcggaaacucacaagaaucaguaacagaacaagacucaaaagacuccacauacucacuaagcucaacacuaacauuaagcaaagcagauuacgaaaaacauaaaguauacgcaugugaaguaacacaccaaggacuaucaucaccuguaacaaaaucauucaacagaggagaaugc

SEQ ID NO: 46875 - RNA, 1359 nt, Artificial Sequence
  derived and/or modified sequence opt6 from Lesofavumab_HeavyChain
gaaguacaacuuguacaaucaggagcagaaguaaaaaaaccaggagaaucguuaaaaauaucauguaaaguuucuggauauucauucaccucacaauggaucggauggguuagacaaaugccaggcaagggacuagaauggauuggaaugauguauccaggagaaucagaaacaauauacucaccaucauuccaaggacaaguaacaauaucagcagacaacucaauaucaacagcauacuuacaauggucuucuuuaaaagcaucugacaccgcuauauauuauugugcaucaggccccggauacucagguuaccacuacgguugguucgacacauggggacaaggaacacuaguaacagucuccuccgcaucaacaaaaggacccucaguauucccacuagcacccucaagcaaaagcacaucaggugguacagcagcacuagguugccuaguaaaagauuacuuccccgaaccaguaacaguuucauggaacagcggagcacuaacaucaggaguucacacauuuccagcaguccuacaauccaguggcuuauacucauuaucuucaguaguaacaguaccuucauccucacuuggcacucaaacuuacauaugcaacguaaaucauaaaccaucaaauacaaaaguagauaaaaaaguagaaccaaaaucaugugacaaaacacacacaugcccaccaugcccagcacccgaacuucuaggcggaccaucaguauuuuuauucccaccaaaaccaaaagauacauuaaugauaucaagaacuccagaaguaacaugcguagugguagacgucucacacgaagaccccgaaguaaaauucaauugguacguagauggaguagaaguacacaacgcaaaaacaaaaccuagagaagaacaauacaauucaacauauagaguaguaucaguauuaaccguucuacaccaagacuggcuaaacggaaaagaauauaaaugcaaaguaucaaauaaagcacuacccgcccccauugaaaaaaccauaucaaaagcaaaaggacaaccaagagaaccucaaguauacacacuaccaccauccagagaagaaaugacaaaaaaucaaguaagucuaacaugccuaguaaaaggauucuaccccucagacaucgcuguagaaugggaauccaauggccaaccagaaaauaacuacaaaacaacaccaccaguacuagauucagacggaucauucuuucuuuacucaaaacuaacaguagauaaaucuagauggcaacaaggcaacguauuuucauguucaguuaugcaugaagcauuacauaaccacuacacacaaaaauccuuaucuuuaucacccggaaaa

SEQ ID NO: 46876 - RNA, 657 nt, Artificial Sequence
  derived and/or modified sequence opt6 from Lesofavumab_LightChain
gacaucguaaugacccaaagcccccuaucacuaccaguaaccccaggagaaccagcaucaauaucaugcagaagcucacaaucauuacuaagaucaaacggauacaacuacuuagacugguaccuacaaaaaccaggacaaucaccccaacuacuaauauaccuaggaucaaacagagccucaggaguuccagacagauuuucaggcucaggaucaggcacagacuucacacuaaaaauaucaagaguagaagcagaagacguaggaguauacuacugcaugcaagcacuacaaacaccauacacauucggacaaggaacaaaacuagaaauaaaaagaacaguagcagcaccaucaguauucauauucccacccucagacgaacaacuaaaaucaggcacagcaucaguaguaugccuacuaaacaacuucuacccacgagaagcuaaaguacaauggaaaguagacaaugcacuacaaaguggaaacucacaagaaucaguaacagaacaagacucaaaagacucaacauauucacuaucauccacacuaacacuaucaaaagcagacuacgaaaaacacaaaguauaugcaugcgaagucacacaccaaggauuaucaucaccaguaacaaaaucauucaacagaggagaaugc

SEQ ID NO: 46877 - RNA, 1059 nt, Artificial Sequence
  derived and/or modified sequence opt6 from Letolizumab_HeavyChain
gaaguacaacuauuagaaucaggcgguggauuaguacaacccggaggaucacuaagacuaagcugcgcagcaucaggauucacauuuaauugggaauuaaugggcugggcaagacaagcaccuggaaaaggucuagaauggguaucaggaauagaaggaccuggagauguaacuuauuaugcagauucaguaaaaggcagguuuacaauaucuagagacaauuccaaaaacacacuauaccuacaaaugaauagucuaagagcagaagacacagcaguauauuacugcguuaaaguaggaaaagacgcaaaaucagacuacagaggccaaggaacucuagugacaguaucaagcgcaucaacagaaccaaaaaguagcgauaaaacccauacaucaccaccaucaccagcaccagaguuauuaggaggaucaaguguauuccuauucccaccaaaaccaaaagacacacuaaugauaucaagaacacccgaaguaacaugcguagucguagauguaagccaugaagacccagaaguaaaauucaauugguacguagacggaguagaaguacacaaugcaaaaacaaaaccaagagaagaacaauauaacucaacauacagaguaguaucaguauuaacaguacuacaccaagauuggcuaaacggaaaagaauauaaauguaaagucagcaacaaagcauuacccgcaccaauagagaaaacaaucucaaaagcaaaaggacaacccagagaaccacaaguauacacauuaccaccaucaagagacgaauuaacuaaaaaccaaguaucacuaacaugccuagucaaaggcuucuacccauccgacauagcaguagaaugggaaaguaacggacaaccagaaaacaacuauaaaacaacaccgccagucuuagacagcgauggaucauucuuccuauauucuaaauuaacaguagauaaaagcagauggcaacaaggaaacguuuucucaugcaguguaaugcacgaagccuuacauaaccacuauacacaaaaaucauuaagccuaagcccagguaaa

SEQ ID NO: 46878 - RNA, 1338 nt, Artificial Sequence
  derived and/or modified sequence opt6 from Losatuxizumab_HeavyChain
gaaguacaacuacaagaauccggcccaggacuagucaaaccaucacaaacccuaagccuaaccugcacaguaucaggauacucaauuucaagagacuuugcuuggaacuggauuaggcaacccccaggaaaaggauuagaauggaugggcuacauuucauacaauggcaacacaagauaucaaccaucuuuaaaaucaagaauaacaauaaguagagauaccucaaaaaaucaauucuuccuaaaacuaaacaguguaacagcagcagauacagcaacuuacuauugcguaacagcaagcagaggauucccauacuggggacaaggaacacuaguaacaguuuccucagcaucaacaaaaggacccuccguauucccacuagcaccuucaucaaaaucaacauccggcggaacagccgcgcuaggauguuuaguuaaagacuacuucccagaacccguaacaguaucauggaacuccggcgcccuaacaagcggaguacauaccuucccagcaguacuucaauccucaggacuuuacucccuaucaucuguaguuacaguaccaucauccagccuaggaacucaaacauacauauguaacguaaaccacaaaccaucaaacaccaaagucgauaaaaaaguagaaccuaaaucaugcgacaaaacacacaccugcccaccauguccagcacccgaauuauuaggcggaccaucaguuuucuuauuucccccaaaaccaaaagauacucuaaugauauccagaacaccagaagucacaugugucguagucgacguaucacaugaagaccccgaaguaaaauuuaacugguacguagacggaguagaaguccacaaugcaaaaacaaaaccacgagaagaacaauacaacucaacauaccgcguaguaucaguacuaacaguucuacaccaagacuggcuaaacggcaaagaauacaaaugcaaaguaucaaauaaagcauuaccagcaccaauagaaaagacaauaucaaaagccaaaggacaaccacgagaaccucaagucuacacacuaccucccucuagagaagaaaugacaaaaaaccaaguaucacuaaccugucuaguaaaaggauuuuacccaucagacauagcaguagaaugggaaucuaacggacaaccagaaaacaauuacaaaacuacaccaccgguacucgacucagacggaucauucuuccucuauuccaaacuaacaguagacaaaagucgauggcaacaaggaaauguuuuuucuuguucaguaaugcaugaagccuuacauaaccacuacacacaaaaaucauuaagccuauccccaggcaaa

SEQ ID NO: 46879 - RNA, 642 nt, Artificial Sequence
  derived and/or modified sequence opt6 from Losatuxizumab_LightChain
gacauacaaaugacacaaucaccaucaagcaugagcguaucaguaggagaccgaguaacaauaacaugccacucaagccaagacauaaacucaaacauaggauggcuacaacaaaaaccaggaaaaucauucaaaggauuaauauaccacggaacaaacuuagacgauggaguaccaagcagauucucaggaucaggaucaggaacagacuacacccuaacaauaaguucacuacaaccagaagacuucgcaacauacuacugcguacaauacgcacaauucccauggacauucggaggaggaacaaaacuagaaauaaaaagaacaguagcagcaccaagcguauucauauucccaccaucagacgaacaauuaaaaucaggaacagcaucaguaguaugcuuauuaaacaacuucuacccaagagaagcaaaaguacaauggaaagucgacaacgcacuacaaucaggaaacucacaagaaucaguaacagaacaagacagcaaagacucaacauacucauuaagcucaacacuaacacuaagcaaagccgacuacgaaaaacacaaaguauaugcaugcgaagucacacaccaaggauuaagcucucccguaacaaaaucauucaacagaggcgaaugc

SEQ ID NO: 46880 - RNA, 1338 nt, Artificial Sequence
  derived and/or modified sequence opt6 from Lupartumab_HeavyChain
gaaguacaauuauuagaauccggcggaggacucguacaaccugguggcagcuuaagauuaucaugugcagcaucagguuucacauuuucaaacgcuuggaugucuuggguaagacaagcaccaggaaaaggccuagaauggguauccuacauaucaucaucuggaucaaccauauacuaugccgacucaguaaaaggaagauuuacaauaucacgagauaacagcaaaaauacuuuauaccuccaaaugaauucccuuagagcugaagacacagcaguauacuacugcgcacgagaaggacucugggcauuugauuacuggggacaaggaacauuagucacuguaucaucagcaagcacaaaaggcccaucagucuuuccucuagcaccaucaucuaaaucaacaucuggaggcacagcagccuuaggauguuuaguaaaagauuacuuuccagaaccaguaaccguuuccuggaacucaggagcauuaacaucaggaguacacaccuucccagcaguccuucaaucaaguggcuuauauucacuaucaucuguaguaaccguaccaucaucaagucuaggcacacaaacauacauauguaacgucaaucauaaaccauccaacacaaaaguagauaaaaaaguagaaccaaaaucuugugacaaaacacauacauguccuccaugcccagcaccagaauuacucggugguccaucaguauuccuguucccaccaaaaccaaaagacacacuaaugauuagcagaacaccagaagucaccugcgucgucguagauguaucacacgaagaccccgaaguaaaauucaacugguacguagacggaguugaaguucacaacgcaaaaacaaaaccaagagaagaacaauauaauaguacauaccgaguaguauccgugcuaacaguacuacaucaagacuggcuuaacggaaaagaauacaaauguaaagucagcaauaaagcauuaccagcacccauagaaaaaacuauaucuaaagccaaaggacaaccaagagaaccucaaguauauacacuaccacccucaagagaugaauuaacuaagaaccaaguaucacuaacaugcuuaguuaaaggauuuuacccaucagauauagcuguagaaugggaaucaaacggacaaccugaaaauaacuacaaaaccacaccacccguccuagauucagacggaagcuucuuucuuuauucaaaauuaacaguagauaaaucuagauggcaacaaggaaacguauucaguugcucugucaugcacgaagcacuucacaaccacuacacccaaaaaucauuaucucuaucaccagga

SEQ ID NO: 46881 - RNA, 651 nt, Artificial Sequence
  derived and/or modified sequence opt6 from Lupartumab_LightChain
gaaucaguacuaacacaaccaccaucaguaucaggagcaccaggucaaagaguaacaauaucaugcacaggaucauccucaaauauaggagcaggauacguaguacacugguaccaacaauuaccuggaacagccccaaaauuacuaaucuaugacaacaacaaaagaccaucaggaguaccagacagauucucaggaucaaaaucaggaaccucagcaucauuagcaauaucaggauuaagaucagaagacgaagcagacuacuacugcgcagcaugggacgacagacuaaauggaccaguauucggaggaggaacaaaacuaacaguccuaggacaaccaaaagccgcaccaucaguaacccuauucccaccaucaucagaagaauuacaagccaauaaagcaacacuaguuugccuaauaucagacuucuacccaggagcaguaacaguagcauggaaagcagacucaagcccaguaaaagcaggaguagaaacaacaacaccaucaaaacaaucaaacaacaaauacgccgcaagcucauaccuaucacuaacuccagaacaauggaaaucacacagaucauacucaugccaaguaacacacgaaggaucaacaguagaaaaaacaguagcaccaacagaaugcucc

SEQ ID NO: 46882 - RNA, 1731 nt, Artificial Sequence
  derived and/or modified sequence opt6 from Lutikizumab_HeavyChain
gaaguacaauuaguagaaaguggaggaggaguaguacaaccagguagaagccuaagauuaucauguucugcaagcggauuuauuuuuaguagauaugacaugagcuggguaagacaagcaccugguaaaggacuagaauggguugcauacauuucacacggaggggcagguacuuacuaucccgacaguguaaaaggaagauuuaccauaagucgagauaauaguaaaaauacauuguuuuuacaaauggacucacuacgaccugaagauacaggaguauauuuuugcgcaagaggcggugugacaaaaggauauuuugauguauggggacaaggaaccccagucacuguaaguagcgcaaguaccaaagguccccaaguacaauuaguagaaucgggaggaggaguaguacaaccaggaagaucuuuaaggcuaagcugcacagcaagcggguuuacauuuucuauguuuggaguacacuggguuagacaagcaccugguaaaggauuagaauggguagcagcaguaucauaugauggaucuaauaaauauuacgcagaaaguguaaaaggccgauucacaauuagcagagauaauuccaaaaauauauuauuuuuacaaauggauucacuaagacucgaagauacagcaguauauuacugugccagagguagaccgaaaguuguaaucccagcaccucuagcacacuggggccaaggaacauuaguaacuuuuucaagcgcaucaaccaaaggaccaucaguauuuccacuugcaccaagcuccaaaucuacaagugguggaacagcagcauuaggaugucuagugaaagauuauuucccagaaccaguuacaguuaguuggaacagcggagcucuuacaucagggguacauacauuuccugcaguauuacaaucauccggauuauacucauuaaguucaguaguaaccguaccgaguucaucuuuaggaacacaaacauacauauguaauguaaaucacaaaccaucaaauacuaaaguagauaagaaaguagaaccgaaaagcugugacaaaacucauaccuguccaccuuguccugcaccagaagcagcaggcggaccauccguauuuuuguuuccuccaaaaccaaaagacacauuaaugauaucacgaacuccagaaguaacaugcguuguaguagacguaagccaugaagacccagaaguaaaauuuaauugguacguagaugguguagaagugcauaacgccaagacaaaaccaagagaagaacaauacaauucaacauaucgagucguaucaguacuaaccguucuacaucaagauuggcuaaauggaaaagaauauaaauguaaaguaucaaacaaagcauuaccagccccuauagagaaaacuauaucuaaagcuaaaggacaaccuagagaaccucaaguauauacuuuaccaccaucacgagaagaaaugacuaaaaaccaaguaucacuaacaugccuaguaaaagguuuuuacccaagugauauagcaguagaaugggaaucaaacggucaacccgaaaauaauuauaaaacaacaccaccaguauuagauagugauggaucauucuuucuuuauucaaaauuaacaguagauaaaagccgauggcaacaaggaaaugucuuuucaugcaguguaaugcaugaagcacuacacaaucauuauacacaaaaaucauuaucauuaaguccaggaaaa

SEQ ID NO: 46883 - RNA, 981 nt, Artificial Sequence
  derived and/or modified sequence opt6 from Lutikizumab_LightChain
gacauacaaaugacacaaaguccaucaucauuaucagcaucagucggagauagaguuacaaucacaugcagagcaucaggaaauauacauaacuacuuaacaugguaccaacaaacaccaggcaaagcaccaaaauuacuaauauauaacgccaaaacauuagcagacggaguaccaucaagauucucuggcucaggaucagguacagacuacaccuucacuauauccucauuacaaccagaagacauagcaacauacuacugccaacacuucugguccauaccauacacauucggacaaggaaccaaacuacaaauaacaagaacaguagcagccccagauauacaaaugacacaaucaccaucaucuguaucugcaaguguaggcgacagaguaacuauaacaugccgagcaucacaaggaauaucaucauggcucgcaugguaccaacaaaaaccaggaaaagcaccaaaacuacuaauuuacgaagcaucaaacuuagaaaccgguguuccaucaagauuuucaggauccggauccggaucugacuuuacacuaaccauaucuucccuccaaccagaagauuucgccacauacuauugccaacaaacauccucauuccuacuauccuucggaggagguacaaaagucgaacacaaacgcacaguagcagcaccaucaguauucauauucccaccaucugaugaacaacucaaaucaggcacagcaucaguaguaugucuacuaaauaacuuuuauccaagagaagccaaaguacaauggaaaguugacaacgcacuacaaagcggaaacucacaagaaucaguaacagaacaagauuccaaagacucuacuuauucccuaucuucaacauuaacauuaucaaaagcagacuacgaaaaacacaaaguauacgcaugugaaguuacacaucaaggacuauccucuccaguaaccaaaucauuuaacagaggcgaaugc

SEQ ID NO: 46884 - RNA, 1341 nt, Artificial Sequence
  derived and/or modified sequence opt6 from Oleclumab_HeavyChain
gaaguacaauuacuagaaucaggaggaggacuaguacaaccaggagguuccuuaagauuaucaugcgcagcaucuggcuucacuuucucaucuuacgccuauucuuggguaagacaagcucccggcaaaggacuugaauggguaucagccauaucaggaucaggaggaagaacauacuaugcugacaguguaaaaggaagauuuacaauaucaagagacaauuccaaaaacacacucuauuuacaaaugaauucucuaagagcagaagauacagcaguauauuauugugcacgacuagguuacggaagaguagaugaauggggaagaggaacuuuaguaaccguuagcucagcaucaacaaaagguccaucugucuuucccuuagcaccaucaucaaaaaguacuucaggcggaaccgcagcacuaggaugcuuaguaaaagauuacuuuccagaaccaguaacaguaucauggaacucaggagcauuaacuucaggaguacauaccuuuccagcugugcuacaaucaucaggucuauauucacuaucuaguguuguaaccguacccucaucaucauuaggaacucaaacauauauaugcaaugucaaucacaaaccgucuaacaccaaaguugauaaaagaguagaaccuaaaucaugugacaaaacccauacauguccaccaugcccugcaccagaauuugaagguggaccuucaguauuccuuuucccaccaaaaccuaaagauacauuaaugauaucaagaaccccagaaguaacuuguguaguuguugacguaagccaugaagauccagaaguaaaauucaauugguauguagauggcguagaaguacacaaugcaaaaacuaaaccaagagaagaacaauacaacucaacauacagaguaguaucaguacuuacaguucuucaucaagauugguuaaacggaaaagaauacaaauguaaaguaucaaacaaagcucuaccugcauccauagaaaaaacaauaucaaaagcaaaaggacaaccaagagaaccucaaguauauacccuaccaccaucaagagaagaaaugacaaaaaaccaagucagccuaacaugccuggucaaaggauuuuacccgucagacauagcaguagaaugggaaucaaauggacaacccgaaaauaauuacaaaacuacuccacccgucuuagacucagacggaucauucuuucucuacucuaaacuaacaguugauaaaucacgcuggcaacagggaaacguauucucauguucugucaugcacgaagcauuacacaaccauuauacacaaaaaucacuaucacuuucaccaggaaaa

SEQ ID NO: 46885 - RNA, 648 nt, Artificial Sequence
  derived and/or modified sequence opt6 from Oleclumab_LightChain
caaucaguuuuaacacaaccaccaucagccucaggaacaccuggacaaagagucacaauaucaugcucaggaucauuaucaaacauaggaagaaaccccguaaacugguaccaacaacuaccaggaacagcaccaaaacuacuaauauacuuagacaaucuaagacuauccggcgucccagacagauuuucaggaucaaaaucaggaacaucugcaucucuagcaauaucaggacuacaaucugaagacgaagcagacuacuacugcgcaacaugggacgacucacauccaggauggacauucggaggaggaacaaaacuaacaguauuaggacaaccaaaagcagcacccucaguaacacuauucccaccaucuucagaagaacuacaagcaaacaaagcaacacuaguaugcuuaauaucagacuucuacccaggagcaguaacaguagcuuggaaagcagacuccucaccaguaaaagcaggcguagaaacaaccacaccaucaaaacaaucaaacaacaaauaugcagccagcucauaccuaucacuaacaccagaacaauggaaaucacacagaucauacucaugccaaguaacacacgaaggauccacaguagaaaaaacaguagcaccaacagaaugcuca

SEQ ID NO: 46886 - RNA, 1449 nt, Artificial Sequence
  derived and/or modified sequence opt6 from Otlertuzumab_HeavyChain
gaaguacaauugguacaaaguggagcagaagucaagaaaccaggugaaucacuaaaaaucaguuguaaaggaaguggauacuccuuuacagguuauaauaugaauuggguaagacaaaugcccggaaaaggauuagaauggaugggaaauaucgaccccuauuauggaggaacuacuuacaauagaaaauuuaaaggacaaguaacaauaagugcggauaaaaguauaaguacagcauauuuacaauggucaucucuaaaagcaucugauacagcgauguauuauugcgcaagaaguguaggaccauucgauaguuggggacaaggaacucuagugacaguaagcagcggaggaggaggaaguggaggaggaggaucagguggaggaggaaguggaggaggcggaucaggagguggaggaucagaaauuguccuuacacaaucaccagcaacauuaucauuaaguccaggagaaagggccacauuaucauguagggcauccgaaaauguauauucauaucuagcaugguaucagcaaaaaccaggacaagcaccgagacuuuuaauauauuuugcaaaaacauuagcagaagggauaccagcaagauuuaguggaucaggaaguggaacagauuuuacacuuacaauuagcucacucgaaccagaagauuuugcaguauacuauugccaacaucacucagauaacccuuggacauuuggacaaggaacaaaaguagaaaucaaaggagaucaagaaccaaaaucaucggauaaaacgcauacgucaccaccauguccagcaccagaacuauuagguggaccuucaguauucuuauucccaccaaaacccaaagauacauuaaugauaucaagaacaccagaaguaacguguguugucgucgaugucagccaugaagauccugaaguaaaauuuaauugguauguagaugguguagaaguacauaaugcaaagaccaaaccaagagaagaacaauauaauucaacauauagaguagucucaguauuaacaguacuacaucaagacugguugaauggaaaagaauacaaauguaaaguaaguaauaaagcauuaccugcaccuauagagaaaacaauaagcaaagcuaaaggacaaccaagagaaccacaaguauacacauuaccaccaaguagggaugaauuaacuaaaaaccaaguuaguuuaacaugccuaguuaaaggauucuauccaagcgauauugcaguagaaugggaaagcaauggacaaccagaaaauaauuauaaaacaacuccaccaguauuagacagcgauggcagcuucuuuuuauacagcaaacuaacaguagauaaaaguagauggcaacaaggaaauguauuuucaugcucaguaaugcaugaagcauuacauaaccauuauacacaaaaaucacuaaguuuaucaccaggaaaa

SEQ ID NO: 46887 - RNA, 339 nt, Artificial Sequence
  derived and/or modified sequence opt6 from Ozoralizumab_HeavyChain
gaaguacaauuaguagaaagcggaggaggauuaguacaaccaggaggaagcuuaagauuaagcugugcagcaagcggauucacauucagugacuauuggauguacuggguaagacaagcaccaggaaaaggauuagaauggguaagcgaaauaaauacaaauggacuaauaacaaaauauccagauaguguaaaaggaagauuuacaauaagcagagacaaugcaaaaaacacauuauauuuacaaaugaauagcuuaagaccagaagauacagcaguauauuacugugcaagaagcccaagcggauucaauagaggacaaggaacauuaguaacagua

SEQ ID NO: 46888 - RNA, 1089 nt, Artificial Sequence
  derived and/or modified sequence opt6 from Ozoralizumab_HeavyChain_HeavyChain_HeavyChain
gaaguacaauuaguagaaagcggaggaggucuaguacaaccaggaggaaguuuaagacuuagcugugcagcuucaggauuuacauuuucagauuauuggauguauuggguaaggcaagcaccaggaaaaggacuagaauggguaagcgaaauaaauacaaauggacuaauaacuaaauacccagauagcgugaaaggaagauuuacaauaucuagagacaaugcuaaaaauacauuauaucuacaaaugaauaguuuacgaccugaagacacagcaguauauuauugugcaagaucaccaucagguuuuaauagaggacaaggaacauuaguaacuguaaguucaggaggaggaggaaguggaggaggaagugaaguacaauuaguagaaucagggggagggcuaguacaaccuggaaauaguuuaagauuaaguugugcagcuucggguuuuacauuuaguaguuuuggaaugucguggguuagacaagcaccaggaaaaggucuagaauggguaagcucaauaagugguaguggaagugauacacuauaugcagauaguguaaaaggaagauuuacaauaagcagagauaaugcaaaaacaacauuauacuuacaaaugaauaguuuaaggccagaagauaccgcaguauacuacuguacaauaggaggaucucuuaguagaucaucacaagguacauuaguaacaguaagcucaggaggaggaggguccggaggaggaagugagguacaauuaguagaaaguggaggaggauugguacaaccaggaggaagccuaagacuaucuugugcagcuucaggauuuacauuuagugauuauuggauguauuggguaagacaagcaccaggaaaaggacuagaaugggugagugaaauaaauacaaauggauuaauaacaaaauauccagauucaguuaaaggaagauuuacaauaaguagagacaaugccaaaaauacauuauauuuacaaaugaacucauuacgaccagaagauacagcuguauauuauugugcgagaucaccauccggauuuaauaggggucaagguacauuaguuacaguaaguagu

SEQ ID NO: 46889 - RNA, 1494 nt, Artificial Sequence
  derived and/or modified sequence opt6 from Pasotuxizumab_HeavyChain_LightChain_HeavyChain_LightChain
caaguacaauugguagaaagugggggaggauuaguaaaaccaggagaaaguuuaagauuaucuugugcagcuaguggguuuacauuuagugauuauuauauguauugggugagacaagcaccaggaaaaggacuagaauggguagcaauaauaucagauggaggauauuauacauauuauucagauauaauaaaaggucgauuuacaauaaguagggacaaugcgaaaaauagucuguauuuacaaaugaauagucuaaaagcagaagacacugcuguauauuauugcgcaagaggauuuccgcuucuaaggcauggagcgauggacuauuggggacaaggaacguugguaacaguuaguaguggaggaggaggaucaggaggaggaggcagugguggcggggguagugauauacaaaugacacaaucuccuaguagucuaagugcuaguguaggagauaggguaacaauaacauguaaagcaucucaaaauguagauacaaauguugcaugguaccaacaaaaaccaggacaagccccaaagaguuuaauauauagugcaucauauagguacagugacguuccaagcagauuuagcggaagcgcaaguggaacugauuuuacuuuaacaauaagcaguguacagagcgaagauuuugcuacauacuauugucaacaauaugauucauauccauacacguuuggaggaggaacaaaacuagaaauaaaaaguggcggaggaggaagugaaguccaauuaguagaaaguggaggagguuuaguacaacccggaggaucuuugaaauugagcugugcugcaagcggauuuacauuuaauaaauaugcaaugaauuggguaagacaagcaccagguaaaggauuagaauggguagcaagaauacgaagcaaauauaauaacuacgcaacguauuaugcagauaguguaaaagauagauuuacgauuagcagagacgauaguaaaaauacagcauauuuacaaaugaauaauuuaaaaacagaggauacggcuguauauuacuguguaagacauggaaauuuuggaaauucauacauaagcuauugggcauauuggggacaggggacuuuaguaacuguaucaagcggaggaggagggaguggaggaggaggaaguggaggaggaggaagucaaacagugguaacacaagaaccaaguuuaacaguaucaccaggaggaacaguaacauuaacauguggaaguaguacaggggcaguaacuucaggaaauuaucccaauuggguacaacaaaagccaggacaagcaccaagaggacuuauagggggaacaaaauuuuuagcuccaggaacaccagcuagguuuaguggaucauuauuaggugggaaagcagcauuaacauuaucaggaguacaaccagaagacgaagcagaauauuauuguguacuaugguauaguaauagauggguguuuggaggagguacaaaauuaacaguauua

SEQ ID NO: 46890 - RNA, 357 nt, Artificial Sequence
  derived and/or modified sequence opt6 from Pasotuxizumab_HeavyChain1
caaguacaauuaguagaaaguggaggaggauuaguaaaaccaggagaaaguuuaagauuaaguugugcagcaaguggauuuacauuuagugauuauuauauguauuggguaagacaagcaccaggaaaaggauuagaauggguagcaauaauaagugauggaggauauuauacauauuauagugauauaauaaaaggaagauuuacaauaagucgagauaaugcaaaaaauaguuuauauuuacaaaugaauagucuaaaagcagaagauacagcaguauauuauugugcaagaggauuuccauuauuaagacauggagcaauggauuauuggggacaaggaacauuagugacagua

SEQ ID NO: 46891 - RNA, 369 nt, Artificial Sequence
  derived and/or modified sequence opt6 from Pasotuxizumab_HeavyChain2
gaaguacaacuaguagaaucaggaggaggauuaguacaaccaggaggaucacuaaaacuaucgugcgcagcaucaggauuuacauuuaacaaauacgcaaugaauuggguaagacaagcaccaggaaaaggacuagaauggguagcaagaauaagaucgaaauauaacaauuacgcaacauauuacgcagacucaguaaaagacagauucacaauaucaagagaugacucaaaaaauacagcauacuuacaaaugaacaaucuaaaaacagaagacacagcaguauacuauugcguaagacauggaaauuucggaaacucauacauaagcuauugggcauacuggggacaaggaacacuaguaacagua

SEQ ID NO: 46892 - RNA, 321 nt, Artificial Sequence
  derived and/or modified sequence opt6 from Pasotuxizumab_LightChain1
gacauacaaaugacacaaucaccaucaucacuaucagcaucaguaggagacagaguaacaauaacaugcaaagcaucacaaaacguagacacaaacguagcaugguaccaacaaaaaccaggccaagcaccaaaaucacuaauauacucagcaucauacagauacucagacguaccaucaagauucucaggaucagcaucaggaacagacuucacacuaacaauaucaucaguacaaucagaagacuucgcaacauacuacugccaacaauacgacucauacccauacacauucggaggaggaacaaaacuagaaauaaaa

SEQ ID NO: 46893 - RNA, 327 nt, Artificial Sequence
  derived and/or modified sequence opt6 from Pasotuxizumab_LightChain2
caaacaguaguaacacaagaaccaucauuaacaguaucaccaggaggaacaguaacauuaacauguggaucaucaacaggagcaguaacaucaggaaacuauccaaauuggguacaacaaaaaccaggacaagcaccaagaggauuaauaggaggaacaaaauucuuagcaccaggaacaccagcaagauuuucaggaucauuacuaggaggaaaagcagcacuaacacuaucaggaguacaaccagaagaugaagcagaauauuacuguguauuaugguauucaaauagauggguauuuggaggaggaacaaaauuaacaguacua

SEQ ID NO: 46894 - RNA, 1023 nt, Artificial Sequence
  derived and/or modified sequence opt6 from Placulumab_HeavyChain
gacauacaaaugacacaaucaccaucaucacucucagcaucaguaggagacagagucacaauaacauguagagcaucucaagccauagacucauaccugcacugguaccaacaaaaaccaggcaaagcaccaaaacuccuaaucuauucagcaucaaacuuagaaaccggcguuccaucaagauuuucaggauccggcucaggcacagacuuuacauuaaccauaucaucacuauuaccagaagacuuugccacauacuacugucaacaaguagucuggcgcccauuuacauucggccaaggcacaaaaguagaaauaaaacgcguagaaccaaaaucauccgacaaaacacacacaugcccacccugcccagcaccagaacuauuaggaggaccaucaguauuuuuauucccaccaaaaccaaaagacacauuaaugauaucaagaacaccagaaguuacaugcguaguaguagacgucucucacgaagacccagaagucaaauucaauugguauguugacggaguagaaguccauaacgcaaaaacaaaaccaagagaagaacaauacaauucaaccuacagaguagucucaguauuaacagucuuacaccaagacugguuaaacggaaaagaauacaaaugcaaaguaucaaacaaagcacuacccgcaccaauagagaaaacaauauccaaagcaaaaggacaaccacgagaaccacaaguauacacauuaccaccaucaagagacgaacucaccaaaaaccaaguaucauuaacaugcuuaguaaaaggcuuuuaucccucagacauugcaguagaaugggaauccaauggacaaccagaaaacaacuauaaaacaacaccaccuguacucgacucagacggaucauucuuuuuauauuccaaauuaaccguugacaaaucaagauggcaacaaggaaacguauuuucaugcucaguaaugcacgaagcacuacauaaccacuacacacaaaaaucccuaucauuaucaccaggaaaa

SEQ ID NO: 46895 - RNA, 1353 nt, Artificial Sequence
  derived and/or modified sequence opt6 from Porgaviximab_HeavyChain
gaaguacaacuacaagaauccggaggaggucuaaugcaaccaggaggaucaaugaaacuaucaugcguagcaucuggauucacauucucaaacuacuggaugaacuggguacgacaaucacccgaaaaaggauuagaauggguagcagaaauaagauuaaaaucaaacaacuacgcaacccacuaugcagaauccgucaaaggaagauucacaauaagucgugacgacuccaaaagaucaguauaccuacaaaugaauaccuuaagagcagaagacacuggaauauauuacugcacaagaggaaauggaaacuauagagcaauggacuacuggggacaaggaacaaguguaacaguaaguagugccucgacaaaaggaccaucaguauuuccacuagcaccaucuucaaaaaguacaucaggaggaacggcagcauuaggcuguuuaguaaaagacuacuucccagaaccaguaacuguuucauggaacaguggcgcacuaaccucaggaguacacacauucccagcagucuuacaaagcucaggcuuauauucccuuucaucagucgucacaguuccaucaucuucacuaggaacacaaacauacauaugcaacguaaaucacaaaccaucgaacacaaaaguagauaaacgcguagaaccaaaaucaugcgauaaaacacauaccugcccaccaugcccagcuccagaacuacuaggcggaccaucaguauuuuuauuccccccaaaaccaaaagacacacuaaugauaagcagaacgccagaaguaacaugcguaguaguagacguaucacaugaagacccagaaguaaaauuuaacugguauguagacggcgucgaaguucauaaugccaaaacaaaaccaagagaagaacaauacaacucaaccuacagaguaguaucuguauuaacaguccuacaccaagacugguuaaauggaaaagaauacaaauguaaaguaaguaacaaagcauuaccagcaccuauagaaaaaacaauaucaaaagcaaaaggucaaccaagagaaccccaaguauauacacuaccaccaucacgagaugaacuaacaaaaaaccaaguaagucuaacuugucuuguaaaaggcuucuauccuucagauauagcaguagaaugggaaucaaauggccaaccugaaaacaacuacaaaacaacaccaccaguacuagacagugauggaucuuucuuuuuauacuccaaauuaacaguagacaaaucaagauggcaacaaggaaacguauucaguugcagcguaaugcacgaagcauuacauaaccauuauacacaaaaaucauuaucacucucaccagguaaa

SEQ ID NO: 46896 - RNA, 642 nt, Artificial Sequence
  derived and/or modified sequence opt6 from Porgaviximab_LightChain
gauauacaaaugacgcaaucaccagcaucauuaagcguaaguguaggagaaacaguaagcauaacauguagagcuagcgaaaacauuuacagcucauuagcaugguaccaacaaaaacaaggaaaaucaccacaacuauuaguauauagcgcaacaauauuagcagacggaguaccaagcagguucucaggaucaggaucaggaacacaauauucauuaaaaauaaacucacuacaaucagaagacuuuggaacauacuauugccaacacuuuuggggaacaccauacacauucggaggaggaacaaaacuagaaauaaaaagaacaguagcagcaccaagcguauucauauucccaccaucagacgaacaauuaaaaucaggaacagcaucagucguuugcuuacuaaauaacuuuuauccaagagaagcaaaaguccaauggaaaguagauaacgcacuccaaagcggaaacucacaagaaucagugacagaacaagauaguaaagacucaacauauagucuaucaucaacauuaacauuaagcaaagcagauuacgaaaaacauaaaguauacgcaugcgaagucacacaccaaggauuaagcucaccaguaacaaaaucauuuaacagaggagaaugc

SEQ ID NO: 46897 - RNA, 1341 nt, Artificial Sequence
  derived and/or modified sequence opt6 from Prezalumab_HeavyChain
gaaguacaauuagucgaaucaggaggcggacuagugcaaccaggaggaucacuucgccuuucaugugcagcauccggauucacauucucaaguuauuggaugucauggguuagacaagcaccaggaaaaggacuugaauggguagcauacaucaaacaagauggaaacgaaaaauauuaugucgauucugucaaaggaagauucacaaucagccgagauaacgcaaaaaacucucuauaccuucaaaugaauucauuacgagcagaagauacagcuguauauuauugugcaagagaaggaauauuaugguuuggagauuuaccuacauuuuggggacaaggaacauuaguaacuguaucaucugcaucuacaaaaggaccaucuguauuuccccuagcaccuugcucuagaucaaccucagaaagcacugcagcacuagguugucuaguaaaagacuauuuuccagaacccguaacaguaucauggaacucuggugcuuuaacaucaggaguccauacauuuccagcaguacuacaaaguuccggacuauauucacuaucaucaguaguaacaguaccuucaucaaauuucgguacgcaaacauauacauguaauguagaccauaaaccuucaaauacaaaaguagauaaaacaguagaaagaaaaugcuguguagaaugccccccaugcccagcaccaccaguagcaggcccaucaguauucuuauucccacccaaaccaaaagacacauuaaugaucucacgcaccccagaaguaaccugcguugucguugacguaagccacgaagacccagaaguacaauucaacugguauguagacggaguugaaguucacaaugcaaaaacuaaaccaagagaagaacaauuuaauuccacauucagagucguaaguguacuaacaguuguacaccaagacugguuaaacggaaaagaauacaaaugcaaaguaaguaauaaaggauuaccagcaccaauugaaaaaacaauaucuaaaaccaaaggacaaccuagagaaccacaaguauacacacuaccaccaucacgagaagaaaugacaaaaaaccaaguaucauuaacaugucuuguaaaaggauuuuacccauccgacauagcagucgaaugggaaucuaacggacaaccagaaaauaauuacaaaacuacuccaccaauguuagacucagacggaucauuuuuucuauacucaaaauuaacaguagacaaaagcagauggcaacaaggaaauguauucucaugcucaguaaugcacgaagcacuacacaaucacuauacccaaaaaucauuaucacucagucccggaaaa

SEQ ID NO: 46898 - RNA, 642 nt, Artificial Sequence
  derived and/or modified sequence opt6 from Prezalumab_LightChain
gacauacaaaugacacaaagcccaucaagccuaagcgcaucaguaggagacagaguaacaauaaccugcagagcaucacaaggaauaucaaacuggcuagcaugguaccaacaaaaaccagaaaaagcaccaaaaucauuaauauacgcagcaucaucacuacaaagcggagucccaagcagauucucaggaucaggaucaggaacagacuucacacuaacaauaucaucauuacaaccagaagacuuugcuacauauuacugccaacaauacgacucauacccucgcacauucggacaaggaacaaaaguagaaauaaaaagaacaguagcagcaccaaguguauucauauucccacccucagacgaacaacuaaaaucaggaacagcaucaguaguaugcuuacuaaacaacuucuacccaagagaagccaaaguacaauggaaagucgacaacgcauuacaaucaggcaacucacaagaaucaguaacagaacaagacagcaaagacucaacauacucacuaagcucaacacuaacacuaagcaaagcagacuacgaaaaacacaaaguauacgcaugcgaaguaacacaccaaggacuaagcucaccaguaacaaaaucauucaaucgaggagaaugc

SEQ ID NO: 46899 - RNA, 342 nt, Artificial Sequence
  derived and/or modified sequence opt6 from Radretumab_HeavyChain
gaaguacaacuacuagaaagcggaggaggauuagugcaaccaggaggaucauuaagauuaagcugugccgcaagcggauucacauucagcagcuuuaguaugagcuggguaagacaagcaccaggaaaaggacuagaauggguaagcucaauaucaggaucaagcggaacaacauacuaugcagauagcguaaaaggaagauuuacaauaagcagagacaauagcaaaaacacacuauaucuacaaaugaauagcuuaagagcagaagauacagcaguauauuacugugcaaaaccauuuccauauuucgauuacuggggacaaggaacauuaguaacagua

SEQ ID NO: 46900 - RNA, 1071 nt, Artificial Sequence
  derived and/or modified sequence opt6 from Radretumab_HeavyChain_LightChain
gaaguucaacuauuagaaucagguggaggauuaguacaaccaggaggaaguuuaagauuaucaugugcagcuucaggauuuacauucucaaguuuuucaaugaguuggguaagacaagcaccaggaaaaggauuagaauggguaagcucaauaucaggaagcucaggaacaacauacuaugcugauucaguaaaaggaagauuuacuauaucaagagauaauaguaaaaauacacuuuauuuacaaaugaacucauuaagagcagaagauacagcaguauauuauugugcaaaaccauuccccuacuuugacuacuggggucaaggaacauuaguaacaguaucaucaggagauggaaguucaggagguaguggaggagcaagugaaauaguacuaacacaaucaccaggaacauuaucacuaaguccaggagaaagagcaacacuaucauguagagcuagucaaucuguaucaucaaguuuccuagcaugguaucaacaaaaaccaggccaagcaccaagauuauuaauauauuacgcaucaucaagagccacaggaauaccagauagauuuagcggaaguggaaguggaacagauuuuacacuaacaaucucaagacuagaaccagaagauuuugcaguauauuauugucaacaaacaggaagaauaccaccaacauuuggacaaggcacaaaaguagaaauuaaaucaggaggaucaggaggaccaagagcugcaccagaaguauaugcauucgcaacaccagaauggccuggaucaagagauaaaagaacauuagcauguuuaauacaaaauuucaugccagaggauauaaguguacaaugguuacacaaugaaguacaauuaccagaugcgagacauucaacaacucaaccuagaaaaacaaaagguagcggauucuuuguuuuuagucgacuagaaguaacaagagcagaaugggaacaaaaagaugaauuuauauguagagcaguacaugaagcagcaucaccaucacaaacuguucagagagcaguuucaguaaauccagaaagcagucgaagagguggcugu

SEQ ID NO: 46901 - RNA, 693 nt, Artificial Sequence
  derived and/or modified sequence opt6 from Radretumab_LightChain
gcaucagaaauaguauuaacacaaucaccaggaacauuaucacuaucaccaggagaaagagcaacacuaucuugucgagcaucacaaucaguaaguucaucauuuuuagcaugguaucaacaaaaaccaggacaagccccuagauuacuaauauacuaugcaucaucaagagcaacaggcauaccagauagauucucaggaagcggaucaggaacagauuucacauuaacaauaucuagauuagaaccagaagauuucgcaguauacuacugucaacaaacaggaagaauaccaccaacauuuggacaaggaacaaaaguagaaauuaaaucaggaggaucaggaggaccaagagcagcaccagaaguauacgcguucgcaacaccagaauggccaggaucaagagauaaaagaacucuagcaugccuaauacaaaacuuuaugccagaagauauaucaguacaaugguuacacaaugaaguacaacuaccagacgcaagacacuccacaacacaaccaagaaaaacaaaaggcucuggauucuuuguauucucacgauuagaaguaacaagagcagaaugggaacaaaaagacgaauuuauaugcagagcuguacacgaagcagcaucaccaucccaaacaguacaaagagcaguaaguguaaacccagaaucaucaagaagaggcggaugu

SEQ ID NO: 46902 - RNA, 1359 nt, Artificial Sequence
  derived and/or modified sequence opt6 from Ranevetmab_HeavyChain1
gaaguucaauuaguagaaucaggaggaggauuaguucaaccaggaggaucauuaagauuaagcugcgucgcaagcgguuucucauuaacaaauaauaauguaaacuggguaagacaagcaccaggaaaaggacucgaauggguaggagguguuugggccggaggagcaacugacuacaauagugcacuaaaaaguagauucaccauaucuagagauaacgcuaaaaauacaguuuuccuacaaaugcacucauuaagaagcgaagauacagcaguguacuacugcgcaagagauggaggauacucaagcuccacacuauaugcaauggaugcauggggacaaggaacuucaguaacaguaaguucugcuucaacuacugccccaucaguauuuccauuagcuccaucuugcggaucaacaucaggaaguacuguugcauuagcuugcuuaguauccggauauuucccagaaccaguaaccguaucauggaacucaggaucacuuacaucaggaguacacacauuuccaagcguucuacaaucaucaggacuucauucauuaaguaguaugguaacaguaccuagcucacgauggccaucagaaacauucacaugcaauguaguacauccugcaucaaauacaaaaguagauaaaccaguauucaaugaauguagaugcaccgauacaccaccauguccaguacccgaacccuuagguggaccauccgucuuaauuuuuccucccaaacccaaagauauacuacgcaucaccagaacacccgaaguaacuugugucguuuuagaucuagguagagaagacccagaaguacaaauaagcugguucguagacgguaaagaagucauaacagcaaaaacucaaucaagagaacaacaauucaacggaacauaucaaguaguauccguauuaccaauugaacaccaagacuggcuaacagguaaagaauuuaaaugcagaguaaaccauauagauuuaccaucaccaauagaaagaacaauuagcaaagcaagaggcagagcacacaaaccaucggucuauguacuucccccauccccaaaagaacucucaucaucagacacgguaaguaucacaugucuaaucaaagacuucuacccaccagauauagacguagaauggcaaucaguaggacaacaagaaccugaacgcaaacauagaaugacaccaccacaauuagacgaagauggaagcuacuucuuguacucuaaauuaucaguugacaaaaguagauggcaacaaggcgauccuuucacaugugcagucaugcaugaaacacuacaaaaucauuauacugacuuaucauuaucacacucaccaggaaaa

SEQ ID NO: 46903 - RNA, 1359 nt, Artificial Sequence
  derived and/or modified sequence opt6 from Ranevetmab_HeavyChain2
gaaguacaacuuguugaaucaggaggaggauuaguacaaccaggaggaaguuuaagacuaucaugcguugcuuccggauucucacuaacuaacaauaauguaaacuggguuagacaagcaccaggaaaaggauuagaauggguuggaggaguaugggcuggaggcgcaaccgauuauaauucagcauuaaaaaguagauucacaauuucaagagacaacgcuaaaaauaccguuuuucuacaaaugcauucucuaagaucugaagacacagcaguauacuauugcgcaagagauggaggauacucaagcucaacauuguacgcaauggacgcauggggacaaggaacaucaguaacaguaaguucagcaucaaccaccgcacccucuguauucccccuagcaccuucuugcggaucaacuucagguaguacuguugcuuuagcaugccuaguauccggcuauuucccagaacccgucaccguaucauggaacucaggaucauuaacaucaggaguccauacauucccaucagugcuacaaucaucagguuuacacucacuaucaucaaugguaacagugccaucaucaagauggccaucugaaacauucacaugcaauguaguacacccagcaucaaauacaaaaguagacaaaccuguauucaaugaaugucgauguacagacacuccuccuugucccguaccagaacccuuaggaggaccaucaguuuuaauauuuccaccaaaaccaaaagacauauuaagaauaacaagaacuccugaaguaacaugugucguauuagauuuaggacgagaagauccagaaguacaaauaucaugguucguagauggcaaagaaguauuaacagcaaaaacacaaucaagagaacaacaauucaauggaacauaccaaguaguaagcguacuaccaauagaacaccaagacuggcuuacaggaaaagaauuuaaaugcagaguuaaucauauagacuuaccaucaccaauagaaagaacaauaucaaaagcgagaggcagagcacauaaaccaucagucuauguauuaccaccaagcccgaaagaacuaucaaguucugauacaguaucuaucacuuguuuaauuaaagacuucuauccaccagauauagaugucgaauggcagucaguuggacaacaagaaccagaaagaaaacacaggaugacuccuccucaacuugacgaagacggaucauauuucuuauacucaaaauuauccguagacaaaagcagauggcaacaaggagacccuuuuacaugugcaguuaugcacgaaacuuuacaaaaccauuauaccgaccuaucucuuucacauucaccuggcaaa

SEQ ID NO: 46904 - RNA, 651 nt, Artificial Sequence
  derived and/or modified sequence opt6 from Ranevetmab_LightChain
gacauaguaaugacacaaucaccagcaucacuaucacuaucccaaggagaaaccguaacaauaacauguagagccucagaagacauauacaacgcauuagccugguaucaacaaaaaccaggacaagcccccaaacuacuaauauacaacacagacacacuacacacaggaguacccucaagauucucaggauccggcucaggaacagacuucucacuaaccauaucaucacuugaaccagaagacgucgcaguauacuacugccaacauuauuuccauuauccacgaacauuuggacaaggaaccaaaguagaacuaaaaagaaacgacgcacaaccagcaguauaccuauuccaaccaucaccagaccaacuacacacaggaucagcaucaguaguuugucuauuaaacucauucuacccaaaagacauaaacguaaaauggaaaguagacggcguaauacaagacacaggaauacaagaauccguaacagaacaagauaaagacucaacauacucauuaucaucaacccuaacaaugucaucaacagaauauuuaucacacgaacuauacucaugcgaaauaacacacaaaucauuaccaucaacauuaauaaaaucauuccaacgaucagaaugucaaagaguagau

SEQ ID NO: 46905 - RNA, 1761 nt, Artificial Sequence
  derived and/or modified sequence opt6 from Remtolumab_HeavyChain
gaaguacaauuaguagaaaguggaggaggucuaguccaaccaggaagaucacuacgauuaucaugcgcagcauccggauuuacauuugaugacuaugcaaugcauuggguacgacaagcaccaggaaaaggauuagaauggguuucagcuauaaccuggaacaguggacauauagacuaugcagauucaguagaagguagauuuacuauaagcagagauaaugcuaaaaauagucuauauuuacaaaugaacaguuuacgagcagaagacacugcaguauauuacugugccaagguaucauauuuaaguacagcuucaagccucgauuauuggggacaaggaaccuuaguuacaguuucaucagggggaggaggaagcggaggaggagggucagaaguccaauuaguccaaagcggagcagaaguaaagaaaccaggaucaucaguaaaaguaucuuguaaagcaaguggcggcucauuuggaggauacggaauaggauggguaagacaagcaccaggacaaggacucgaauggaugggaggaauaacaccauucuucggauuugcagacuacgcacaaaaauuccaaggaagaguaacaauaacagcagaugaaucaaccacaacagcuuauauggaauuaucaggacugacaagugaugauacagcaguguacuauugugcaagagauccaaaugaauuuuggaauggauacuauucgacucaugauuuugacagcuggggucaaggaacaacaguaacuguaucuagugcaucaacaaaaggcccaaguguauucccauuggcacccucaucaaaaaguacaaguggaggaacagcagccuuaggaugucuagugaaagauuauuuuccagaaccaguaacaguaucauggaacucaggagcccuaacaucaggaguacauacauucccugcuguacuacaauccaguggacuauauucucuuuccaguguaguaacgguuccaaguaguucgcuaggaacacaaaccuauauauguaaugugaaccauaaaccgucaaacacaaaaguagauaagaaaguugagccaaaaucaugugauaaaacacauacuugcccaccauguccugcaccagaauuauuagguggaccaaguguuuuccuuuuucccccaaaaccgaaagauacuuuaaugauaagucgaacaccagaaguuaccugugucgucguugacgucagccaugaagaucccgaaguaaaauucaacugguaugucgacggaguagaaguucacaaugcaaagaccaaaccacgggaagaacaauacaacagcacauauagaguaguaucagucuuaacaguauuacaccaagauugguuaaacggaaaagaauauaaauguaaaguaucaaauaaagcauuaccagcgccuaucgagaaaacuauaucaaaagcaaaaggacaaccaagagaaccacaaguauacacacuacccccaucaagagaugaacuaaccaaaaaccagguuucauuaacauguuuaguaaaagguuuuuauccaagcgacauagcgguagaaugggaaucaaacggacaaccagaaaacaauuauaaaacuaccccuccaguacuagauucagacggcaguuucuuuuuauauagcaaauuaacaguagacaaaaguagauggcaacaaggaaauguauuuucauguucaguaaugcaugaagcauuacacaaucauuauacacaaaagucacuaagucuaaguccagguaaa

SEQ ID NO: 46906 - RNA, 993 nt, Artificial Sequence
  derived and/or modified sequence opt6 from Remtolumab_LightChain
gacauacaaaugacacaaucuccaucaucauuaucagccuccguaggcgacagaguaacaauaaccugcagagcuucacaaggaauaagaaacuaccuagcaugguaccaacaaaaacccgguaaagcccccaaauuacuaauauacgcagcaucaacccuacaaucaggcguaccaucaagauuuuccggaucaggaucaggaacagacuuuacauuaacaauaucaucacuacaacccgaagacgucgccacauacuacugucaaagauacaaccgcgcaccauacacauucggacaaggcacaaaaguagaaauaaaaagaggaggaucaggaggcggaggaucaggagaaaucguacuaacacaaucccccgacuuccaaucaguaacaccaaaagaaaaaguaacaauaacaugccgagcaagccaagacauuggcucagaacuacacugguaccaacaaaaaccagaccaaccaccaaaacuacuaauaaaauacgcaucacacucaacaagcggaguaccaucaagauucucaggaucaggaucaggaacagacuucaccuuaaccauaaacggacuagaagcagaagacgcaggaacauauuacugccaccaaacagacucauuaccuuauaccuuuggaccuggaacaaaagucgauauaaaaagaacaguagcugcaccaagcguauucauauucccuccaucagacgaacaacuaaaaucaggaacagcaucaguaguaugccuacucaacaacuucuacccaagagaagccaaaguacaauggaaaguugacaacgcacuacaaucaggaaacucacaagaauccguaaccgaacaagacucaaaagacucaacauacucacuaucaucaaccuuaacccuaucaaaagcagacuacgaaaaacauaaaguauacgcaugcgaaguaacacaucaaggccucuccucaccagucacaaaaucauuuaacagaggcgaaugu

SEQ ID NO: 46907 - RNA, 1341 nt, Artificial Sequence
  derived and/or modified sequence opt6 from Rosmantuzumab_HeavyChain
caaguacaacuaguacaaucuggcgcagaagucaaaaaaccaggugcaucuguaaaaguaucaugcaaagcuuccgguuauacauuuacugauuauuccauucacuggguacgacaagcaccaggacaaggcuuagaauggauaggauacaucuacccuucaaacggcgacuccggauauaaucaaaaauucaaaaacagagucacuaugacacgcgauaccucaacauccacagcauauauggaauuaucaagacuacgaucagaagacacagcaguauauuauugcgcaacauacuucgcaaauaauuucgacuacuggggacaaggcacaacacuaaccguaucaucagcuucaaccaaaggaccuucaguauucccacuagcaccaucaucaaaaucaacgucaggaggaacagcagcccuaggauguuuaguaaaagacuauuucccagaaccuguaacagucucauggaauucaggcgcacuaacaucaggaguucacacauuuccugcuguauuacaauccuccggauuauauagucuaucaucuguugucaccguaccaucaucaucacuagguacccaaaccuauauauguaauguuaaccacaaaccauccaauacaaaaguagacaaaagaguagaacccaaaucaugcgacaaaacucacacauguccaccaugcccugcaccagaauuauuaggaggacccuccguauuccuauuuccaccaaaaccaaaagacacucuaaugaucucaagaacaccagaagucacauguguagucguugauguaucacacgaagacccagaagucaaauucaauugguacguugacggaguagaaguucacaaugccaaaacuaaaccaagagaagaacaauacaacucaacauacagaguaguaucaguauuaaccguacuacaucaagacugguuaaauggaaaagaauacaaaugcaaaguuuccaauaaagccuuaccagcaccaaucgaaaaaaccauaucaaaagcaaaaggccaaccccgagaaccacaaguauacacauuaccaccaucacgcgaagaaaugacaaaaaaccaaguaucucuaacaugcuuaguaaaaggauucuaucccucagacauagcaguagaaugggaauccaacggacaaccagaaaacaacuacaaaacaacaccuccugucuuagacucagacggaucauucuucuuauacucaaaacuaacaguagacaaaucaagauggcaacaaggaaacguuuuuucauguucaguaaugcacgaagcacuacacaaccacuacacacaaaaaucauuaucacuuucaccagguaaa

SEQ ID NO: 46908 - RNA, 654 nt, Artificial Sequence
  derived and/or modified sequence opt6 from Rosmantuzumab_LightChain
gacauacaaaugacacaaucaccaucaucacuaucagcaucaguaggagacagaguaacaauaacaugcaaagcaucacaaucaguagacuacgacggcgacucauacaugaacugguaccaacaaaaaccaggaaaagcaccaaaacuacuaauauacgcagcauccaacuuagaaucaggaguaccaucaagauucucagguucaggaucaggaacagacuucacauuaacaauaucaccaguacaagcagaagacuucgcaacauacuacugccaacaaucaaacgaagacccacuaacauucggagcaggaacaaaacuagaacucaaaagaacaguagcagcaccaucaguauucauauucccaccaucagacgaacaauuaaaaucaggcacagcaucagucguaugccuauuaaacaacuucuacccaagagaagcaaaaguacaauggaaagucgacaacgcacuacaaucaggaaacucacaagaauccguaacagaacaagacucaaaagacuccaccuacucacuaucaucaacauuaaccuuaucaaaagccgacuacgaaaaacacaaaguauacgcaugcgaaguaacacaccaaggacuaucaucaccaguaacaaaaucauuuaacagaggagaaugu

SEQ ID NO: 46909 - RNA, 1332 nt, Artificial Sequence
  derived and/or modified sequence opt6 from Rozanolixizumab_HeavyChain
gaaguuccauuagucgaaucaggaggaggacuaguacaaccaggagguucacuaagauuaucaugugcaguaucaggauuuacuuuuaguaacuauggaaugguuugggucagacaagcaccuggaaaaggucuagaauggguagccuauauagacuccgauggagacaacaccuacuacagagauaguguaaaaggcagauucacaauaucuagagauaaugcaaaauccucacuauauuuacaaaugaauucacuaagagccgaagacacagcaguauacuacuguacaacaggaauaguacgaccauuccuauacuggggacaaggaacacuaguaacagucucaucugcaucaacuaaaggaccaucaguauuuccauuagcuccauguucccgaucaacaucagaaucaacagcagcauuagguugcuuagucaaagauuacuucccagaaccaguaacgguaucauggaacucaggagcacuaacauccggaguacauacauucccugcaguauuacaaucaucaggccuauauucacuuucaagugucguaacaguacccucaucaucauuaggaaccaaaacauacacauguaacguugaccauaaaccaucaaacacaaaaguagauaaaagaguagaaucaaaauacggaccuccuuguccaccgugcccagcucccgaauuccuagggggaccaucaguauuucuauuuccaccuaaaccaaaagacacacuaaugauaucuagaacaccagaaguaaccuguguaguaguugauguaucucaagaagacccagaaguacaauuuaacugguacgucgauggaguagaaguucauaaugcaaaaacaaaaccaagagaagaacaauucaauucaacauacagaguuguaucaguauuaaccguauuacaccaagacugguuaaacgggaaagaauacaaauguaaagucucaaauaaaggacuaccaagcucuauagaaaaaacaauaucuaaagcaaaaggccaaccacgagaaccacaaguauauacucuaccacccucacaagaagaaaugacaaaaaaccaaguaucauuaacaugucucguaaaaggcuuuuacccaucagauauagcaguagaaugggaauccaauggacaaccagaaaauaauuauaaaacaacaccaccuguccuagauucagauggaucauuuuucuuauacucaagauuaacaguagauaaauccagauggcaagaaggaaacguuuuuucuuguucuguaaugcaugaagcacugcauaaucacuacacacaaaaaucacuuucacuaucacucggaaaa

SEQ ID NO: 46910 - RNA, 657 nt, Artificial Sequence
  derived and/or modified sequence opt6 from Rozanolixizumab_LightChain
gacauacaaaugacacaaucaccaucaucacuaucagccucaguaggagacagaguaacaauaacaugcaaaucaucacaaagccuaguaggcgcaucaggaaaaacauaccuauacugguuauuccaaaaaccaggaaaagcaccaaaacgauuaauauaucuaguaagcacauuagacucaggaauaccaucaagauucucuggaucaggaucaggaacagaauuuacacuaacaauaaguucacuacaaccagaagacuucgcaacauacuacugccuacaaggaacacauuucccacacacauucggacaaggaacaaaacuagaaauaaaaagaaccgucgcagcaccaucaguauucauauucccaccaucagacgaacaacucaaaucaggaacagcaucaguagucugccuacuaaacaacuucuacccacgagaagcaaaaguacaauggaaagucgacaacgcccuacaaagcggaaacucacaagaaucaguaacagaacaagacucaaaagauucaacauacagccuaucaucaacauuaacacuaagcaaagcagacuacgaaaaacacaaaguauacgcaugcgaaguaacacaccaaggacucucaucaccaguaacaaaaucauucaacagaggagaaugc

SEQ ID NO: 46911 - RNA, 1329 nt, Artificial Sequence
  derived and/or modified sequence opt6 from Sapelizumab_HeavyChain
caaguacaacuacaagaaucaggaccaggccuagucaaaccaagcgaaacauuaagccuaacaugugcaguaucaggucauuccauuucacacgaucacgcauggucauggguaagacaaccaccaggagaaggacucgaauggaucggauuuaucucauacucaggaauaacaaacuauaacccaagccuucaaggaagaguaaccauaucaagagacaauuccaaaaacacccuuuaccuacaaaugaacucauuaagagcagaagacacagcaguuuacuacugcgcaagaucauuagcacgaacuacagcaauggauuauuggggugaaggcacccuaguaacaguaucaucagcaucaacaaaaggaccaucuguauucccauuagccccuagcucuaaaucaaccucaggaggaacagcagcacucggcugucuaguaaaagacuacuuuccagaaccaguaacaguaucauggaacucaggagcccuaacauccgguguacacacauucccagccguacuacaaucaucaggucuauauucauuaagcucuguagucacaguaccuucaagcaauuucggaacacaaacauacacauguaacguugaccauaaaccauccaauacaaaaguagacaaaacaguagaaagaaaauccugugucgaaugcccaccaugcccagcacccccaguagcaggccccagcguauuccuuuuuccacccaaaccuaaagacacccuaaugauaucaagaacacccgaaguaacaugcguaguuguagaugucucccaagaagauccagaaguacaauucaauugguauguagauggaguagaaguucauaaugcaaaaacuaaaccuagagaagaacaauuuaacucaacauuucgcguaguaucaguauuaaccguagugcaucaagacuggcuuaauggaaaagaauacaaaugcaaaguaucaaacaaaggauuaccagcaccaauagaaaagaccauaucaaaaacaaaaggacaaccaagagaaccccaaguauauacccuaccaccaucucaagaagaaaugaccaaaaaucaaguauccuuaacaugcuuagucaaaggauuuuauccaagugacauagcugucgaaugggaaucaaauggacaaccagaaaacaacuauaaaacaacaccuccaaugcuagauucugacggaucauucuucuuauacucaaaauuaaccguagauaaaagcagauggcaagaagguaacguauuuuccugcucaguaaugcaugaagcccuacacgcacacuauacacaaaaaucucuaucauuaucacca

SEQ ID NO: 46912 - RNA, 642 nt, Artificial Sequence
  derived and/or modified sequence opt6 from Sapelizumab_LightChain
gacauacaaaugacccaaucaccaucaucacuaucagcaucaguaggagauuccguaacaauaaccugccaagcauccaccgacauaucaucacacuuaaacugguaccaacaaaaaccaggaaaagcacccgaauuacuaauauacuacggaucacaccuccuaucaggaguaccaucaagauucucaggaucaggcucaggaacagacuucacauucacaauaucaucacuagaagcagaagacgcagccacauacuauugcggacaaggaaacagacucccauacacauucggacaaggaacaaaaguagaaauagaaagaacaguagcagcaccauccguauucauauucccaccaucagacgaacaacuaaaaucaggcacagccucaguaguuugccuacucaacaacuucuacccaagagaagcaaaaguacaauggaaaguagacaacgcacuacaaucaggaaacucacaagaaucaguaaccgaacaagauucaaaagacucaacauacucacuaucaucaacauuaacacuaucuaaagcagacuacgaaaaacacaaaguauacgcaugcgaaguaacacaucaaggacuaucaucacccguaacaaaaucauucaaccgaggugaaugc

SEQ ID NO: 46913 - RNA, 1356 nt, Artificial Sequence
  derived and/or modified sequence opt6 from Selicrelumab_HeavyChain
caaguacaauuaguacaaucuggugcagaaguaaagaaaccaggagcauccguaaaaguaucaugcaaagcaucaggauauacauuuacaggauacuacaugcacuggguaagacaagcaccaggucaaggauuagaauggauggguuggauuaauccagauaguggaggaacaaauuaugcacaaaaauuccaaggcagaguaacaaugacuagagacaccaguauaucaacagcauacauggaauuaaacagacuaagaucagaugauacugcaguauauuauugcgcaagagaccaaccacuaggauacuguacaaauggaguaugcucauauuucgauuacuggggacaaggaacucuaguaacuguaucaucagcaucaacaaaagguccuucuguauuuccacuugcaccauguaguagaucaacauccgaaucaacagcagcccuaggaugcuuaguaaaagacuacuuucccgaaccuguaaccguaagcuggaacucaggcgcacuaacaucaggaguacacacauuuccagcaguuuuacaaucaagugguuuauacagcuuaucaucagucguaacaguuccauccagcaauuucggaacccaaaccuauacauguaauguugaucauaaaccaucuaauacaaaaguagacaaaacgguugaaagaaaaugcuguguagaaugcccacccugucccgcuccuccuguagcaggaccuucaguauuucuauucccuccaaaaccaaaagacacccuaaugauaagcagaacaccagaaguaacaugcguaguaguagacgucucgcaugaagaccccgaaguacaauuuaacugguauguagacggaguagaaguacacaaugcaaaaacaaaaccaagagaagaacaauuuaacucuacuuuuagaguuguaucagucuuaacuguaguucaccaagauugguuaaauggaaaagaauacaaaugcaaaguaucuaacaaaggcuuaccagcacccauagaaaagacaauuucaaaaacaaaaggacaaccaagagaaccacaaguauacacauuaccaccaucaagagaagaaaugaccaaaaaccaaguaucacuaacaugccuuguaaaaggcuucuauccaagcgauauagcaguagaaugggaaagcaacggucaaccagaaaauaauuauaaaacaacacccccaauguuagacucagauggcagcuucuucuuauacucaaaauuaacaguagacaaaucaagauggcaacaaggaaauguauucucauguucuguaaugcacgaagcacuacacaaucacuauacacaaaaaucacuaucucuaucuccaggaaaa

SEQ ID NO: 46914 - RNA, 642 nt, Artificial Sequence
  derived and/or modified sequence opt6 from Selicrelumab_LightChain
gacauacaaaugacacaaucaccaucuucaguaucagcaagcguaggagacagaguaaccauaaccuguagagcaucacaaggaauauacucaugguuagcaugguaccaacaaaaaccaggcaaagcaccaaaccuacuaauauacaccgcaucaacacuacaaucaggagucccaagcagauucucaggaucaggaucaggaacagacuucacacuaacaauaucuucauuacaaccagaagacuucgcaacauacuacugccaacaagcaaacauauucccacuaacauucggaggaggaacaaaaguagaaauaaaaagaaccgucgcagcaccaucaguauucauauucccaccaucagacgaacaauuaaaauccggaacagcauccgucguaugcuuacuaaacaacuucuacccaagagaagcaaaaguacaauggaaaguagacaacgcauuacaaucaggaaacucacaagaaagcguaacagaacaagauucaaaagacucaacauacucauuaucaucaacacuaacauuaagcaaagcagacuacgaaaaacacaaaguauacgcaugcgaaguaacacaccaaggauuaucaucaccaguaaccaaaucauucaacagaggagaaugc

SEQ ID NO: 46915 - RNA, 354 nt, Artificial Sequence
  derived and/or modified sequence opt6 from Solitomab_HeavyChain1
gaaguacaauuacuagaacaaucaggagcagaauuaguaagaccaggaacaucaguaaaaauaucaugcaaagcaucaggauaugcauuuacaaauuacuggcuaggauggguaaaacaaagaccaggacauggauuagaauggauaggagacauauucccaggaucaggaaauauacauuacaaugaaaaauucaaaggaaaagcaacacuaacagcagauaaaucaagcucaacagcauacaugcaauuaagcucacuaacauucgaagacucagcaguauacuuuugcgcaagauuaagaaauugggaugaaccaauggauuacuggggacaaggaacaacaguaacagua

SEQ ID NO: 46916 - RNA, 375 nt, Artificial Sequence
  derived and/or modified sequence opt6 from Solitomab_HeavyChain2
gacguacaauuaguacaaagcggagcagaaguaaaaaaaccaggagcaaguguaaaaguaagcuguaaagcaagcggauacacauucacaagauauacaaugcacuggguaagacaagcaccaggacaaggauuagaauggauaggauauauaaauccaucaagaggauacacaaacuaugcagauagcguaaaaggaagauuuacaauaacaacagacaaaagcacaagcacagcauauauggaauuaucaucauuaagaucagaagauacagcaacauauuacugugcaagauacuaugacgaucacuauugcuuagacuauuggggacaaggaacaacaguaacaguaucaagcggagaaggaacaucaaca

SEQ ID NO: 46917 - RNA, 1488 nt, Artificial Sequence
  derived and/or modified sequence opt6 from Solitomab_LightChain_HeavyChain_HeavyChain_LightChain
gaauuaguaaugacacaauccccaucgaguuuaacaguaacagcaggagaaaaaguaacuaugucaugcaaaucaucacaaaguuuacuaaauagcgguaaccagaaaaauuacuuaacaugguaucaacaaaaaccaggacaaccaccaaaauuauuaauauauugggcaagcacaagagaaagugguguaccugacagguuuacaggaucgggaaguggaacggauuuuacucuuacuauaagcuccguacaagcagaagauuuggcaguauacuauugucaaaacgacuacucuuacccacuaacauuuggagcaggaacuaaacuagaaauuaaaggaggaggaggaaguggaggaggaggaucaggaggaggagguagcgaaguacaacuauuagaacaaaguggagccgaauuaguaagaccuggcacaucaguaaaaauaagcuguaaagcuagcggauaugcuuuuacuaacuauugguuaggguggguaaaacaaaggccaggucauggauuggaauggauaggcgauauuuuuccaggaaguggaaauauacacuacaaugaaaaauucaaagguaaagcaacacuuacagcugacaaaucaaguagcacagcauauaugcaauuaucaaguuugacauuugaagauagcgcgguauauuucugugcaagacuacgaaauugggaugaaccaauggauuauuggggacaaggaacuacaguaacaguaucaaguggaggaggaggaagugacgugcaauuaguacagaguggagccgaaguaaagaaaccaggagcaagcguaaaaguaagcuguaaagcaucaggauacacauuuacaagauauacaaugcauuggguaagacaagcaccaggucaaggacuagaauggauaggauauauaaaucccucacgaggauauacaaauuaugcugauaguguaaaaggacgauuuacuauaacaacggauaaaucaacaucaacagcauauauggaacuaaguagucuaagaagugaggauacagcaacuuauuauugugcaagauauuacgaugaucauuauugcuuagauuauuggggacaagguaccacaguaacaguaaguagcggagaagguacaucaacaggaaguggagguucaggcggaucaggcggugcagacgacauuguguuaacucaaucaccagcaacauuaagccuaagcccaggcgaaagagcaacauugagcugccgugcuagucaaagcgugagcuacaugaauugguaucaacaaaaaccaggaaaagcacccaaaagauggauauaugauacaucuaaaguagcaucuggaguaccagcaagauuuagcggaaguggaaguggaacugauuacaguuuaacaauuaauagccuagaagcagaagaugcagcaacauauuauugucaacaauggaguucaaauccauuaacauuuggaggaggaacuaaaguugaaauaaaa

SEQ ID NO: 46918 - RNA, 339 nt, Artificial Sequence
  derived and/or modified sequence opt6 from Solitomab_LightChain1
gaacuaguaaugacacaaucaccaucaucacuaacaguaacagcaggagaaaaaguaacaaugucaugcaaaucaucacaaucacuacuaaacucaggaaaccaaaaaaacuaccuaacaugguaccaacaaaaaccaggacaaccaccaaaacuacuaauauacugggcaagcacaagagaaucaggaguaccagacagauucacaggaucaggaucaggaacagacuucacauuaacaauaucaucaguacaagcagaagaccuagcaguauacuacugccaaaacgacuacucauacccacuaacauucggagcaggaacaaaacuagaaauaaaa

SEQ ID NO: 46919 - RNA, 324 nt, Artificial Sequence
  derived and/or modified sequence opt6 from Solitomab_LightChain2
gcagacgauauaguacuaacacaaucaccagcaacauuaucauuaagcccaggagaaagagcaacauuaagcuguagagcaagccaaagcguaagcuauaugaauugguaucaacaaaaaccaggaaaagcaccaaaaagauggauauacgauacaagcaaaguagcaucaggaguaccagcaagauuuaguggaagcggaagcggaacagauuacucacuaacaauaaauagcuuagaagcagaagaugcagcaacauauuacugucaacaauggucaagcaauccacuaacauuuggaggaggaacaaaaguagaaauaaaa

SEQ ID NO: 46920 - RNA, 1359 nt, Artificial Sequence
  derived and/or modified sequence opt6 from Suptavumab_HeavyChain2
gaaguacaauuaguugaauccggaggagacuuaguacaaccaggaagaucccuaagauuauccugcgucgcaucaggcuucacauucgacgauuacgcuaugcacuggguacgacaagcucccggaaaaggacuagaaugggucucuggcguaaguuggucaggaucuacugucggcuaugccgauagugucaaaggaagauuuaccguaucaagagacaaugcacaaaaaucacuauaccuacaaaugaauucacuaagagcagaagauacagcacuauauuacuguguaaaagaugcuuacaaauuuaauuacuacuauuauggacuagauguauggggacaaggcaccacuguaaccgucucaucugccucuacaaaaggccccucaguauuuccacuagcacccuccucaaaaucaaccucuggaggcacugcugcauuaggaugccuaguaaaagacuauuuuccagaaccaguuacuguaucuuggaacagcggagcacucacaucaggaguacauacauuuccagcagucuuacaaucaaguggauuauauucacuaucaucaguuguaacaguaccaagcucaucacuaggaacacaaaccuacauuugcaauguaaaucacaaaccaucaaacacaaaaguagauaaaaaaguugaaccaaaaaguugcgauaaaacacacacauguccaccauguccagccccagaacuacuaggaggaccaucaguauucuuauuucccccaaaaccaaaagacacauuaaugauaucuagaacaccagaaguaacaugcgucguagucgauguaucacaugaagaucccgaaguaaaauuuaauugguacgucgaugguguagaaguacauaaugcaaaaacuaaaccacgagaagaacaauauaauuccacauacagaguagucucaguauuaacuguauuacaccaagacugguuaaacggcaaagaauauaaauguaaaguaucaaacaaagccuuaccagcaccaauugaaaaaacaauaucaaaagccaaaggacaaccaagagaaccacaaguauauacacuuccaccaucuagagaugaauuaacaaaaaaucaaguaucauuaacaugucuagucaaaggauucuauccuagugacauagcuguagaaugggaaucaaauggccaaccagaaaacaauuauaaaacaacaccacccguauuagacucagauggaaguuucuuccuauacucuaaauuaaccguugacaaaucacgcuggcaacaaggaaauguuuucaguugcuccguuaugcacgaagcacuacacaaccauuacacccaaaaaucauuaucuuuaucaccuggaaaa

SEQ ID NO: 46921 - RNA, 1356 nt, Artificial Sequence
  derived and/or modified sequence opt6 from Suvratoxumab_HeavyChain
gaaguccaauuaguagaaaguggaggaggccuaguacaaccaggaggaagucuaagauuaagcugcgcagcaaguggauuuacauuuucuagccacgacaugcacuggguacgccaagcaaccggaaaaggacuagaauggguaaguggcauaggcacagcaggcgacacauacuacccagauucaguuaaaggaagauuuacuauuuccagagaaaaugcaaagaacaguuuauauuuacaaaugaauaguuuaagagcuggugacacagcaguauauuacugcgcaagagauagauauucaccaacaggacacuauuacgguauggacguauggggacaaggaacaacuguuacaguaucaucagcaucuaccaaaggaccaucaguauucccacuugcuccaaguagcaaaucaacaucaggagguaccgccgcauuaggauguuuagucaaagacuauuuuccagaaccagucacaguaucauggaacucuggagcacuaacaucaggaguacacacauuuccagcaguacuccaauccagcggucuauauucauuaaguucaguaguaacagucccaucuaguucauuaggaacacaaacauacauaugcaauguaaaucauaaaccaucaaacaccaaaguagacaaaaggguagaaccuaaaucaugcgauaaaacacacacaugcccuccaugcccagcaccugaauuacuaggaggaccuucgguauuucuauuuccaccaaaaccaaaagauacauuauauauaacaagagaaccugaaguuacauguguaguaguagacguaucacaugaagacccagaaguaaaauucaauugguacguagacggaguagaaguacauaacgcaaaaacaaaaccaagagaagaacaauauaauagcacauaucgaguaguaucaguacuaacuguauuacaucaagacugguuaaaugguaaagaauauaaauguaaaguaucaaauaaagcacuaccagcacccauagagaaaacaauaucaaaagccaaaggccaaccacgagaaccucaaguauauacauuaccaccaucaagagaagaaaugaccaaaaaucaaguaucauuaacuugccuaguaaaaggauuuuauccaucugacauagcuguagaaugggaaaguaacggucaaccugaaaauaauuauaaaaccacaccacccguauuagauagugacggcucauucuuucuauauaguaaauuaacaguagauaaaaguagauggcaacaagguaauguauuuagcuguucaguaaugcaugaagcucuacacaaucacuauacucaaaaaucauuaagccuuucuccaggaaaa

SEQ ID NO: 46922 - RNA, 639 nt, Artificial Sequence
  derived and/or modified sequence opt6 from Suvratoxumab_LightChain
gacauacaaaugacacaauccccaagcacacuaucagcaucaguaggagacagaguaacaauaaccugcagagcaucacaaucaauaucaucauggcucgcaugguaccaacaaaaaccaggaaaagcaccaaaacuacuaauauacaaagcaucaucacuagaaucaggaguaccuucuagauucuccggaucaggauccggaacagaauuuacauuaacaauaucaucacuacaaccagacgacuucgcuacauacuacugcaaacaauacgcagacuacuggacauucggacaaggaacaaaagucgaaauaaaaagaacaguagcagcaccaucaguauucauauucccaccaucagacgaacaauuaaaaucaggaacagcaucagucguaugccuacuaaacaacuucuacccaagagaagcaaaaguacaauggaaaguagacaacgcacuccaaucaggaaacucacaagaaucaguaacagaacaagacucaaaagacucaacauacucacuauccucaacacuaacacuaagcaaagccgacuacgaaaaacacaaaguauacgccugcgaaguaacacaucaaggacuaucaucacccguaacaaaaucauucaacagaggagaaugc

SEQ ID NO: 46923 - RNA, 642 nt, Artificial Sequence
  derived and/or modified sequence opt6 from Tadocizumab_LightChain
gacauccaaaugacacaaaccccaucaacucuaucagcaucaguaggagacagaguaacaauaucaugcagagcaagccaagacauaaacaacuaccuaaacugguaccaacaaaaaccaggaaaagcaccaaaacuacuaauauauuacacaucaacauuacacucaggaguacccucaagauucucaggaucaggcucaggaacagacuacacucuaacaauaucaucucuacaaccagacgacuucgcaacauacuucugccaacaaggaaacacacuaccauggacauucggacaaggaacaaaaguagaagucaaaagaacaguagcagcaccaucaguauucauauucccaccaucagacgaacaacuaaaaucaggcacagcaucagucguaugcuuauuaaacaacuucuacccaagagaagcaaaaguacaauggaaaguagacaacgcacuacaaucaggaaacucacaagaaagcguaaccgaacaagauuccaaagacucaacauacucacuaagcucuacacuaacacuaucaaaagcagacuacgaaaaacacaaaguauacgcaugcgaaguaacacaccaaggauuaucaucaccaguaacaaaaucauucaacagaggagaaugc

SEQ ID NO: 46924 - RNA, 1341 nt, Artificial Sequence
  derived and/or modified sequence opt6 from Tanezumab_HeavyChain
caaguacaauuacaagaaagcggaccuggauuaguuaaaccuucagaaacauuaucccuaacaugcacagucuccggcuucucacuaauaggauacgacuuaaacuggauaagacaaccacccggcaaaggacuagaauggauaggaauaauauggggagauggaacaacagacuacaacucagcagucaaaagccgagucacuauaucuaaagacacuuccaaaaaucaauucucacuaaaacuuucaucagucacagcagccgacacagcaguuuacuacugcgcccgaggaggauauugguaugcaacaucauauuacuuugacuacuggggacaaggcacccuaguaacaguaucauccgcaucaacaaaaggccccucuguauuuccauuagcaccauguucacgaucaacauccgaaucaacagcagcacuaggaugccuaguaaaagacuacuucccagaaccagucaccguaucauggaacucaggagcacuaaccuccggaguacauacauucccagcaguauuacaaucaucaggacucuacucauuaagcucagucguaaccguaccaucaucuaauuucggaacacaaaccuauaccuguaaugucgaccacaaaccaucaaacacaaaaguagacaaaacuguagaaagaaaaugcuguguagaaugcccaccauguccagcaccaccagucgcaggaccaaguguauucuuauuuccaccaaaacccaaagacacccuaaugauaucacguacaccagaaguaacauguguagucguagacguaucccacgaagaucccgaaguacaauucaauugguacgucgacgguguugaaguacacaacgcuaaaacaaaaccaagagaagaacaauuuaacucaacauuccgaguuguaucaguauuaacaguaguccaucaagacuggcuaaacggaaaagaauauaaaugcaagguaucaaacaaaggauuaccaucaaguauagaaaagacuauaucaaaaacuaaaggacaacccagagaaccacaagucuacacacuaccaccaucacgagaagaaaugacuaaaaaccaaguaucacuaacaugccuagucaaaggauucuauccaucagauaucgcagucgaaugggaaucaaacggacaacccgaaaauaauuacaaaacaacaccaccaauguuagauucggacggaucauuuuucuuauacuccaaacuaacaguagacaaaucacguuggcaacaaggaaacgucuucuccugcucaguaaugcaugaagcauuacacaaucacuauacacaaaaaucauuaucacuaagcccuggaaaa

SEQ ID NO: 46925 - RNA, 642 nt, Artificial Sequence
  derived and/or modified sequence opt6 from Tanezumab_LightChain
gacauccaaaugacacaaucacccucaucacuaucagcaucaguaggagaccgaguaacaauaacaugcagagcaucucaauccauaucaaacaaccuaaacugguaccaacaaaaaccuggaaaagcaccaaaacucuuaauauacuacacaucuagauuccacucaggagucccaucaagauucucaggcucaggaucaggaacagacuucaccuucacaauaucaucauuacaaccagaagacauagcaacauacuacugccaacaagaacacacacucccauacacauucggacaaggaacaaaacuagaaaucaaacgaacaguagcagccccaucaguauucauauucccaccaucagacgaacaacuaaaauccggaacagcaucaguaguaugccuacuaaacaacuucuacccacgcgaagcaaaaguccaauggaaaguagacaaugcacuacaaucaggaaacucacaagaaucaguaaccgaacaagacucaaaagacucaacauacucccuaucaucaacacuaacacuaucaaaagcagacuacgaaaaacacaaaguauacgcaugcgaaguaacacaccaaggacuauccucaccaguaaccaaaucauucaacagaggagaaugc

SEQ ID NO: 46926 - RNA, 1353 nt, Artificial Sequence
  derived and/or modified sequence opt6 from Tavolixizumab_HeavyChain
caaguacaauuacaagaaucaggaccuggacuaguaaaacccucccaaacacucucacuaacaugcgcaguauacggcggauccuucuccucaggauauuggaauuggauaagaaaacacccaggaaaaggacuagaauacauagguuacauauccuacaacggcauaacauaucauaacccaucccuaaaaucaagaauaacaauaaaccgagacacaucaaaaaaccaauacucauuacaacuaaacagcguuacucccgaagauaccgcagucuacuacugcgcacgauauaaauacgacuaugauggagggcaugcaauggauuacuggggacaaggaacauuagucacaguaagcucagcaaguacaaaaggcccaucaguauucccacuagcaccaucaucuaaaucuacaucaggcggaacagccgccuuaggaugccucguaaaagauuacuucccagaaccuguuaccguaucauggaacucaggagcccuaacaucuggaguacauacauuuccagcagucuuacaaucaucaggacuauacucccuaucaucaguaguaacaguaccuucaucaucacuaggcacccaaacauauaucugcaacgucaaccacaaaccaaguaacaccaaaguagacaaaagagucgaaccuaaaucuugcgauaaaacucacacaugcccaccaugcccagccccagaacuacuaggcggaccaucaguuuuccuauucccacccaaaccaaaagauacauuaaugauaucaagaaccccugaaguaacauguguaguaguugacguaucacacgaagauccagaaguaaaauucaauugguauguagacggcguagaaguccacaacgcaaaaaccaaaccucaagaagaacaauauaacucuacauaccgaguaguaucaguuuuaacaguauuacaccaagacuggcuaaacgguaaagaauacaaaugcaaagucucaaauaaagcauuaccagcaccaauagaaaaaaccauaucuaaagccaaaggucaaccacgcgaaccccaaguuuacacccuaccaccaucaagagaagaaaugaccaaaaaccaagucucacuaacauguuuagucaaaggauucuaccccucagacauugcaguagaaugggaaucaaacggccaaccagaaaauaacuauaaaacaaccccaccuguucuagauucagauggaaguuuuuucuuauacuccaaacucacaguagacaaaucaagauggcaacaaggaaauguauucuccugcucuguaaugcaugaagcacuacauaaccauuauacccaaaaaucacuuucucuaucuccaggaaaa

SEQ ID NO: 46927 - RNA, 642 nt, Artificial Sequence
  derived and/or modified sequence opt6 from Tavolixizumab_LightChain
gacauacaaaugacccaaucaccaucaucccucuccgcaucaguaggcgacagaguaacaauaaccugcagagcaucacaagauauaucaaacuaccuaaacugguaccaacaaaaaccaggaaaagcacccaaacuacuaauauacuacacaucaaaacuacacucaggagucccaucaagauucucaggcucaggaucaggaacagacuacacacuaacaauaucaucacuccaaccagaagacuucgcaacauacuacugccaacaaggaucagcacuaccauggacauucggacaaggaacaaaaguagaaauaaaaagaacaguagcagcaccaucaguauucauauucccacccucagacgaacaacuaaaaucaggcacagcaucaguaguaugccuacuaaauaacuucuacccaagagaagcaaaaguacaauggaaaguagacaacgcauuacaaucagguaacucacaagaaucaguaaccgaacaagacucaaaagacucaacauacucccuaucaucaacacuaacacuaucaaaagcagacuacgaaaaacacaaaguauacgcaugcgaaguaacacaccaaggccuaucaucaccaguaacaaaaucauucaacagaggagaaugu

SEQ ID NO: 46928 - RNA, 1335 nt, Artificial Sequence
  derived and/or modified sequence opt6 from Telisotuzumab_HeavyChain
caaguccaacuaguacaaucuggcgcagaaguaaaaaaaccaggcgcaucaguuaaaguaucaugcaaagcaucaggguacauauucacugcauacaccaugcauuggguaagacaagcacccggacaaggacuagaauggaugggguggauaaaaccaaacaacggacucgcuaacuaugcacaaaaauuucaaggcagagucacaaugacucgcgacacaucaauuucaacugcuuauauggaacuaucaagacuaagaucagacgacaccgcaguuuacuauugcgcaagaucugaaauaaccaccgaauucgauuacuggggccaaggaacucuaguuacuguaucaucagcauccacaaaagguccuucagucuucccacuagcaccaucaucaaaaucaaccucaggagguacagccgcacuaggaugccucguaaaagacuacuucccugaaccuguaaccguaucuuggaauucuggcgcacuuacaucaggcguacauacauuuccagcaguauuacaaucuagcgguuuauacucacucucauccguuguaacaguaccaagcucaucucuaggaacacaaacguacauaugcaacguaaaccauaaaccaucaaauacuaaaguagacaaaagaguagaaccaaaaagcugcgacugccacuguccaccaugcccagcaccagaauuauuaggaggacccucaguuuucuuauuuccaccaaaaccaaaagauacccuaaugauaucuagaacacccgaaguaacaugcguaguaguagacguuucacaugaagauccugaaguaaaauucaauugguacguugacggaguagaaguccauaacgcaaaaacaaaaccacgagaagaacaauauaauucaacauacagagucguaucaguauuaacaguacuacaucaagacuggcuaaacggcaaagaauacaaauguaaagucucuaauaaagccuuaccagcacccauagaaaaaacaauaucaaaagcuaaaggacaaccaagagaaccacaaguuuauaccuuaccaccaucacgagaagaaaugaccaaaaaccaaguuagcuuaacaugucuaguaaaaggauuuuauccaucagacauugcagucgaaugggaaucaaauggacaaccugaaaauaauuauaaaaccacaccccccguacuagacucagacggaucauuuuuccucuauagcaaauuaaccguagacaaauccagauggcaacaaggcaaugucuucucaugcucaguuaugcaugaagcucuacacaaccacuauacacaaaaauccuuaucauuaucuccaggu

SEQ ID NO: 46929 - RNA, 654 nt, Artificial Sequence
  derived and/or modified sequence opt6 from Telisotuzumab_LightChain
gacauaguaaugacacaaagcccagacagccuagcaguaagccuaggagaaagagcaacaauaaacuguaaaucaagcgaaucaguugacucauacgcaaacucauuccuacacugguaccaacaaaaaccaggacaaccacccaaacuauuaauauauagagcaagcacaagagaaagcggagucccagacagauucucaggaucaggaucaggaacagacuuuacauuaacaauaaguucauuacaagcagaagacguagcuguauacuacugucaacaaucaaaagaagauccacuaacauucggaggaggaacaaaaguagaaauaaaaagaacaguagcagcaccaagcguauucauauucccaccaucagacgaacaauuaaaaucgggaacagcaucaguaguaugcuuacuaaauaacuuuuacccgagagaggcaaaaguacaauggaaaguagauaacgcccuacaaagcggaaacucacaagaaaguguaaccgaacaagacagcaaagauucaacauauagccuaucaucaacauuaacauuaagcaaagcagauuacgaaaaacauaaaguauacgcaugcgaaguaacacaccaaggauuaagcucaccaguaacaaaaucauuuaacagaggagaaugc

SEQ ID NO: 46930 - RNA, 1335 nt, Artificial Sequence
  derived and/or modified sequence opt6 from Telisotuzumab_vedotin_HeavyChain
caaguccaauuaguacaaucaggagcagaagucaagaaaccuggagccucaguaaaagucucaugcaaagcaucuggguauauauuuacagcauacacaaugcacuggguaagacaagccccaggacaaggacuagaauggauggguuggauaaaaccaaacaauggacuagcaaacuacgcucaaaaauuccaaggacgaguaacaaugacuagagacacaucaauuuccaccgcauacauggaauuaucaagacucagaucagaugacacagccguauacuacugugcacgaucagaaauuacuacagaauuugauuacuggggccaaggcacguuaguaacaguauccuccgcuucaacaaaaggaccuuccguauucccuuuagcaccaucuucuaaaucaacaagcggaggaacagcggcccuaggauguuuaguaaaagacuacuucccagaaccaguaaccgucagcuggaacucaggagcauuaacuucaggaguccauaccuucccagcaguccuacaaagcuccggauuauacucauuaucaucaguaguaacaguaccaucaaguucauuaggaacucaaaccuacaucuguaacguaaaccacaaaccaaguaacacaaaaguagacaaacgaguagaaccaaaaucaugcgacugccauugcccaccauguccagcaccagaacuacuaggaggaccaucaguauuccuauuuccaccaaaaccaaaagacacacuaaugauaucaagaacaccagaaguaacuugcguuguaguagauguuucacaugaagacccagaaguuaaauucaauugguacguagacggaguagaaguccacaacgcaaaaacaaaaccacgagaagaacaauauaacucaacuuacaggguaguuucaguacucacaguacuucaucaagacuggcuaaauggaaaagaauauaaaugcaaagucucaaacaaagcacuaccugcaccaaucgagaaaacaaucucaaaagcgaaaggacaaccacgagaaccucaagucuauacacuaccaccaucaagagaagaaaugaccaaaaaccaaguauccuuaacauguuuaguaaaaggauucuauccaagugauauagcaguagaaugggaauccaauggacaaccagaaaauaauuacaaaacaacaccaccaguacuagacucagauggaucauucuuuuuauacucaaaauuaacagucgacaaaucaagauggcaacaaggaaacguauuuucaugcucaguaaugcacgaagcucuacauaaucauuauacacaaaaaucacuaagccuaucaccaggu

SEQ ID NO: 46931 - RNA, 654 nt, Artificial Sequence
  derived and/or modified sequence opt6 from Telisotuzumab_vedotin_LightChain
gacauaguaaugacacaaucaccagacagcuuagcaguaagccuaggagaacgagcaacaauaaacuguaaaucaagugaaagcguagacucauacgcaaacucauucuuacacugguaccaacaaaaaccaggacaaccaccaaaauuauuaaucuaccgagcauccacaagagaaagcggaguaccagacagauucucaggaucaggaucaggcacagacuuuacauuaacaauaagcucacuacaagcagaagacguagcaguauacuauugccaacaaucaaaagaagacccacuuacauucggaggaggaacaaaaguagaaauaaaaagaacaguugcagcaccaaguguauucauauucccaccaucagacgaacaauuaaaaucgggaacagcaucaguaguaugcuuacucaacaacuuuuacccaagagaagcaaaaguacaauggaaaguagauaacgcacuacaaaguggaaacucacaagaaagcguaacagaacaagacaguaaagacucaacauacagcuuaagcucaacauuaacauuaagcaaagccgauuaugaaaaacauaaaguauacgcaugcgaaguaacacaccaaggacuaagcucaccaguaacaaaaucauuuaacagaggagaaugc

SEQ ID NO: 46932 - RNA, 1350 nt, Artificial Sequence
  derived and/or modified sequence opt6 from Timigutuzumab_HeavyChain
gaaguccaguuaguagaaucaggaggaggcuuaguacaaccagguggcucucuaagacuauccugugcagcaucaggauuuaacauaaaagauaccuauauacauuggguacgccaagcaccaggaaaaggauuagaauggguugccagaauauacccuacaaaugguuacacaagauacgcagacucuguaaaaggaagguucacaauaucagcagacaccucgaaaaauacagcauacuuacaaaugaauaguuuacgcgcagaagauacugcaguauacuauugcucaagauggggaggagacgguuucuacgcaauggacuauuggggacaaggaacauuaguaacagucucuuccgcaaguacaaaaggaccauccguauuuccacuagcaccaucaucaaaaagcacgucuggaggaacagcagcauuaggaugccuuguaaaagacuacuuucccgaaccaguaacaguaucauggaauucaggagcuuuaacaaguggaguacauacauuuccugcuguauuacaaucaagcggauuauauucauuaucaucaguagucacaguaccauccuccucauuaggaacacaaaccuauauauguaauguuaaccauaaaccuagcaacacaaaaguagauaaaaaaguugaaccaaaaagcugugacaaaacccauacaugcccuccuuguccagcaccagaauuacuaggaggacccuccguauucuuauucccaccuaaaccaaaagacaccuuaaugauaucaagaacaccagaagucacaugcguaguaguagacgucucacaugaagacccugaaguaaaauucaauugguauguagauggagucgaaguacauaacgcaaaaacaaaaccaagagaagaacaauauaauucaacauauagaguaguaucaguauuaaccguauugcaucaagacugguuaaauggaaaagaauauaaauguaaaguaucaaauaaagcuuuaccagcaccaaucgaaaaaacaauaucuaaagcuaaaggucaaccacgagaaccacaaguauacacauuaccaccaaguagagacgaacuaacaaaaaaccaaguuucauuaacaugccuaguuaagggauucuauccauccgauauagcaguagaaugggaaaguaauggacaacccgaaaacaauuacaaaacaacaccaccaguacuagacuccgacgguaguuuuuucuuauacucaaaauuaacagucgacaaaucaagauggcaacaagguaauguauucucaugcucuguaaugcaugaaggacuacacaaucauuacacacaaaaaagccuuucacuauccccaggaaaa

SEQ ID NO: 46933 - RNA, 642 nt, Artificial Sequence
  derived and/or modified sequence opt6 from Timigutuzumab_LightChain
gacauccaaaugacacaaucaccaucaucacuaucagcauccguaggcgaccgaguaacaauaacaugcagagcaucacaagacguaaacacagccguagcaugguaccaacaaaaaccaggaaaagcacccaaacuacuuauauacucagcaucauuccuauacucaggaguaccaucaagauucucaggaucaagaucaggaacagacuucacauuaacaauaucauccuuacaaccagaagacuucgcaacauacuacugccaacaacauuacacaacaccaccaacauucggacaaggaaccaaaguagaaauaaaacgaacaguagcagccccaucaguauucauauucccaccauccgacgaacaacuaaaaucaggcacagccucaguaguaugccuacuaaacaacuucuacccacgagaagcaaaaguacaauggaaaguagacaacgcacuacaaucaggaaacucacaagaaucuguaacagaacaagacuccaaagacucaacauacucccuaucaucaacacuaacauuaucaaaagcagacuacgaaaaacacaaaguauacgcaugcgaaguaacacaccaaggacuaucaucaccaguaacaaaauccuucaacagaggagaaugc

SEQ ID NO: 46934 - RNA, 1332 nt, Artificial Sequence
  derived and/or modified sequence opt6 from Timolumab_HeavyChain
caaguacaacuaguagaaucaggaggaggaguaguacaaccaggaagaucacucagauuaagcugugcagccucaggauucaccuucuuuucguaugcaaugcacuggguacgccaaacuccaggaaaaggacuagaauggguagcagucauaugguucgacgguucuaaugaaaacuaugucgacuccguaaaaggacgcuuuaccauuucccgagauaauucaaaaaacacucuauauuuacaaaugaacacacuuagagcagaagauacagcaguauacuauugcgcacgugacgcauggucuuacuuugacuauuggggacaaggaaccuuaguaacaguaagcucagccucuacaaaaggcccaucaguauuuccuuuagccccuuguucucgauccacaucagaaucaacagcugcacuuggaugucuaguaaaagacuacuuccccgaaccaguuaccguaucauggaacucuggcgcacuaacaucaggaguccauacauuccccgccguacuacaaucaucaggauuauacucacuaucaucaguaguaacugucccaucuucaucacuaggaacaaaaacuuacacauguaacguugaucauaaaccaucaaauacaaaaguagacaaaagaguagaaucaaaauauggaccaccuugcccaccaugucccgcaccagaauucgcaggaggaccaucaguauuuuuauucccaccaaaaccuaaagauacauuaaugauaucuaggacaccagaaguuacaugugucguuguagacguaucacaagaagacccugaaguucaauucaauugguacguugacggagucgaaguacacaaugcuaaaacaaaacccagagaagaacaauucaauuccacauaccgaguaguauccguauuaacaguacuacaccaagauugguuaaacggaaaagaauauaaaugcaaaguaagcaauaaaggacuaccuuccucaauagaaaaaacaauaucuaaagcaaaaggacaaccaagagaaccccaaguauauacauuaccaccaucacaagaagaaaugacaaaaaaccaaguaucauuaacauguuuaguaaaaggauuuuaucccucagauauagcaguagaaugggaaucaaacggacaaccugaaaauaauuauaaaacaacaccuccaguccuagauucagauggaucauucuuuuuauauuccagacuaacuguagauaaaucaagauggcaagaaggcaaugucuuuucauguuccguaaugcacgaagcacuucacaaccauuacacacaaaaaucuuuaucccuuucacucggaaaa

SEQ ID NO: 46935 - RNA, 642 nt, Artificial Sequence
  derived and/or modified sequence opt6 from Timolumab_LightChain
guaauacaacuaacacaaucaccaucuucacuauccgcaucaguaggagacagaguaacaauaacaugcagagcaucccaaggaauaucaagagcacucgcaugguaccaacaaaaaccaggaaaaggaccaaaacuacuaauauacgacgcaucaucacuagaaucaggaguaccaucccgauucucaggaucaggcucaggaacagacuucacacuaacaauaucaucauuacaaccagaagacuucgcaacauacuacugccaacaauucaacucauacccucuaacauucggaggaggcacaaaagucgaaauaaaaagaacaguagcagcaccaucaguauucauauucccaccaucagacgaacaacuaaaaucaggaacagcuucaguaguaugccuacucaacaacuucuacccaagagaagcaaaaguacaauggaaaguagacaacgcacuacaaucaggaaacucacaagaauccguaacagaacaagacucaaaagacucaacauacucacuaucaucaacacuaacacuaucaaaagcagacuacgaaaaacacaaaguauacgcaugcgaaguaacacaccaaggccuaucaucaccaguaacuaaauccuuuaacagaggagaaugc

SEQ ID NO: 46936 - RNA, 1347 nt, Artificial Sequence
  derived and/or modified sequence opt6 from Tomuzotuximab_HeavyChain
caaguacaacuaaaacaaucaggaccaggcuuaguacaaccuucccaaucacuuucaauaacauguaccguaucaggauucucauuaacaaauuacgguguacauuggguucgacaaucaccaggaaaaggacuagaauggcuaggagucaucugguccggcggcaacacagacuauaacaccccauuuacuucaagauuaucaauuaacaaagauaacucaaaaucacaaguuuucuucaaaaugaauagucuccaaucaaaugauacagcaauauauuacugcgcacgagcacuuaccuacuacgauuacgaauucgcauacuggggacaagguacacuaguuaccguaucaacagcuucaaccaaaggaccaucaguauucccacucgcaccaucauccaaaucaacaucaggaggcacugcagcccuagguugcuuagucaaagacuauuuccccgaaccaguaacggucucuuggaauucaggcgcuuuaacauccggaguacacacauuccccgcaguauuacaaucaucaggccucuacucacuauccaguguaguuacagucccaucauccucacuaggaacacaaacauauauaugcaacguaaaccauaaaccaagcaacacaaaaguagacaaaaaaguagaaccuaaaucaugcgacaaaacacauacaugcccaccaugccccgcaccagaacuacuaggagguccauccguauuuuuauuccccccuaaaccuaaagacacauuaaugauaagcagaacgccagaaguaacauguguaguaguagacguaucacaugaagacccagaaguaaaauuuaacugguacgucgaugguguagaaguacacaaugcaaaaaccaaaccaagagaagaacaauacaacuccacuuacagaguaguaucaguacuaacuguauuacaccaagacuggcuaaacggaaaagaauacaaaugcaaaguuucaaauaaggcacucccagccccuaucgaaaaaacaaucucuaaagcaaaaggccaaccucgagaaccacaaguauacacauuaccaccaucccgugacgaauuaacaaaaaaucaaguaucacuuacauguuuagucaaaggcuuuuauccaucugacauagcaguagaaugggaaucaaacggacaacccgaaaacaauuacaaaacaacaccaccuguacuagauucagacgguucauucuuucuauacucaaaacuaaccguagacaaaucuagauggcaacaagguaacguauucucaugcuccgucaugcaugaaggacuacacaaccacuacacccaaaaaucacuaucauuaucaccaggaaaa

SEQ ID NO: 46937 - RNA, 642 nt, Artificial Sequence
  derived and/or modified sequence opt6 from Tomuzotuximab_LightChain
gauauauuauuaacacaaagcccaguaauacuaagcguaagcccaggagaacgaguaucauuuagcuguagagcaagccaaagcauaggaacaaacauacacugguaccaacaaagaacaaauggaagcccaaggcucuuaauuaaauacgcaagcgaaagcauaaguggaauaccaagcagauuuucaggaucaggaucaggaacagacuuuaccuuaagcauaaacucaguagaaagcgaagacauagcagauuacuacugccaacaaaauaacaauuggccaaccacauucggagcaggaacaaaacuagaauuaaaaagaacaguagcagcaccaagcguauucauauucccaccaucagacgaacaauuaaaaucaggaacagcaucaguaguaugcuuacuaaauaacuuuuauccaagagaagcaaaaguacaauggaaaguagauaacgcacuacaaagcggaaacucacaagaaagcguaacagaacaagauagcaaagacucaacauauucauuaagcucaacauuaacacuaucaaaagcagauuacgaaaaacauaaaguauacgcaugcgaaguaacacaccaaggauuaagcucacccguaacaaaaucauuuaacagaggagaaugc

SEQ ID NO: 46938 - RNA, 1347 nt, Artificial Sequence
  derived and/or modified sequence opt6 from Trastuzumab_duocarmazine_HeavyChain
gaaguacaauuaguugaaucaggcggaggccuaguacaaccuggaggaucacuaagacuaagcugcgcagccucaggauucaauaucaaagacacauacauacauuggguaagacaagcaccaggaaaaggacucgaauggguagcucgaauauauccaacaaauggauauacucgauaugcagacucaguaaaaggaagauuuacaauaucagccgacacaaguaaaaacacagcauaccuucaaaugaacucacuaagagcugaagauacagcagucuauuacuguucaagauggggcggagauggauucuacgcaauggacuacugggggcaagguaccuuaguaacuguaucaucagcaucaacaaaaggaccauccguauucccauuagcacccagcucaaaaucaaccucaggaggaacagcagcauuaggaugccuaguaaaagauuauuucccagaaccaguaacaguauccuggaacuccggagcccuaaccucaggaguccauacauucccagcuguucuacaaaguuccggauuauauucauuaucaucagucguaacaguaccaucaucaucucuagguacacaaacauacauaugcaauguaaaucacaaaccauccaauaccaaaguagauaagaaagucgaacccaaaucaugugauaaaacccacacauguccacccugcccagcaccggaacuacuaggaggaccaucaguauuccuauuuccaccaaaaccuaaagacacacuaaugauuucacgcacacccgaaguaacaugugucguaguagacguaagucacgaagacccagaaguaaaauucaacugguaugucgacggaguagaaguacacaacgcaaaaacaaaaccaagagaagaacaauacaauucuacauacagagucguaucaguauuaacuguacuacaccaagauugguugaauggaaaagaauacaaaugcaaaguauccaacaaggcauuaccagcaccaauagaaaagacaauaagcaaagcuaaaggucaaccaagagaaccacaaguauacacacuaccacccucccgagaagaaaugacuaaaaaucaagucucauuaacaugucuaguuaaagguuuuuacccuucggacauagcuguagaaugggaaaguaauggucaacccgaaaacaacuacaaaacaacaccaccaguucuagacucagauggaucauucuuucuauacucaaaauuaacaguagauaaauccagauggcaacaagguaacguauuuucuugcucaguaaugcaugaagcucuacacaaccauuacacacaaaaaucauuaucauuaucaccagga

SEQ ID NO: 46939 - RNA, 642 nt, Artificial Sequence
  derived and/or modified sequence opt6 from Trastuzumab_duocarmazine_LightChain
gacauacaaaugacacaaucaccaucaucucuaucagcaucaguaggagaucgaguaacaauaacaugcagagcaucacaagacguaaacacagcaguagcaugguaccaacaaaaacccggaaaagcaccaaaacuacuaauauacucagcaucauuccuauacucaggcgucccaucaagauucucaggaucaagaucaggaacagacuucacacuaacaauaucaucacuacaaccagaagacuucgcaacauacuacugccaacaacacuacaccacaccaccaacauucggacaaggaaccaaagucgaaauaaaacgcacaguagcagcaccaagcguauucauauucccaccaucagacgaacaacuaaaaucaggaaccgccucagucguaugccuacuaaacaacuucuacccaagagaagcuaaaguacaauggaaagucgacaacgcacuacaaucaggaaacucacaagaauccguaacagaacaagacuccaaagacucaacauacucauuaucaucaacccuaacccucucaaaagccgacuacgaaaaacacaaaguauacgcaugcgaaguaacacaucaaggacuaucaucaccaguaacaaaaucuuuuaacagaggagaaugc

SEQ ID NO: 46940 - RNA, 1368 nt, Artificial Sequence
  derived and/or modified sequence opt6 from Varisacumab_HeavyChain
caaguacaauuaguccaauccggcgcagaaguaaaaaaaccuggagccucaguaaaaguaucaugcaaagcaucaggaggaacauucucaucauaugcaauauccuggguaagacaagcaccuggacaaggacucgaauggaugggaggauuugacccugaagacggagaaaccauauacgcacaaaaauuucaaggucgaguaacaaugacagaagauacaucaacagacacagcauacauggaacuauccuccuuaagaucagaagacacugcaguuuacuacugcgcuaccggaagaucaaugguaagaggaguaaucauaccauucaauggaauggacguauggggacaaggaacaacuguaacuguaucaucagcaucaaccaaaggaccaagcguauucccccuagcaccaucaucaaaaucaacaucaggaggaacagccgcacuaggauguuuagucaaagauuauuuccccgaacccguuacaguaucauggaauaguggcgcacuaacaaguggaguacacacuuuuccagcuguacuucaaucauccgguuuauauuccuuaucaucagucgucacaguaccaucuucuuccuuagguacacaaacuuauauaugcaacguaaaccauaaacccuccaauacaaaaguagauaaaaaagucgaacccaaaucaugugacaaaacacauacauguccaccuugcccugcaccagaauuacuaggaggccccucaguauuucuauuuccuccaaaaccuaaagacacauuaaugauaucacgcacaccagaaguaacaugcguuguaguagacguaucacaugaagacccagaaguuaaauucaauugguacgucgacggaguagaaguacacaaugcaaaaacaaaaccaagagaagaacaauauaacucaacauauagaguaguauccgugcuuacugucuuacaucaagacugguuaaacggaaaagaguacaaauguaaaguaucaaacaaagcucuuccagcaccaauagaaaaaaccauaucaaaagcaaaaggacaacccagagaaccacaaguuuacacucucccaccaucccgagaugaauugaccaaaaaccaaguaucucuuacaugccuaguaaaaggauucuacccuuccgauaucgcaguagaaugggaaagcaacggccaacccgaaaacaauuacaaaacaacuccuccaguacucgauucugauggaucauucuuucuuuacucaaaauuaacaguagacaaaaguagauggcaacaagguaacguauuuucuuguuccguaaugcacgaagcauuacacaaccacuauacccaaaaaucauuaucacucucacccggaaaa

SEQ ID NO: 46941 - RNA, 642 nt, Artificial Sequence
  derived and/or modified sequence opt6 from Varisacumab_LightChain
gacauaagaaugacacaaucaccaucuucacuaucagcaucaguaggagaccgaguaacaauaacaugcagagcaucacaaucaauaucaucuuaccuaaacugguaccaacaaaaaccaggaaaagcaccuaaacuacuuauauaugcagcaucaucucuacaaucaggaguaccauccagauucaguggauccggaucaggaacagacuucacacuaacaauaucaucacuacaaccagaagacuucgcaacauacuauugccaacaaucauacucaaccccauuaacauucggaggaggaacaaaaguagaaauaaaaagaacaguagcagcaccauccguauucauauucccaccaucagacgaacaacuaaaaucaggaacagcaucaguaguaugccuauuaaauaacuuuuacccacgagaagcaaaaguacaauggaaagucgacaacgcacuacaaucaggaaacucacaagaaucaguaacagaacaagacucaaaagacucaacauacagccuauccucaacacuaacccuaucaaaagccgacuacgaaaaacacaaaguauacgcaugcgaaguaacccaccaaggacuaaguucacccguaacuaaaucauucaacagaggagaaugc

SEQ ID NO: 46942 - RNA, 1359 nt, Artificial Sequence
  derived and/or modified sequence opt6 from Vunakizumab_HeavyChain
gaaguacaauuaguucaaucaggagcugaagucaaaaaaccaggagcaucuguaaaaguaucauguaaagcaucuggauacacauucacagacuacgaaguccauuggguaagacaagcaccaggacagggccuagaauggaugggaguaauagauccaggcacagguggaguagcauacaaccaaaaauucgaaggaagggucacaaugacagcugauacaucaaccucaacagcauauauggaacuacguucacucagaucagacgacacugcagucuauuacugcacaagauauucacucuucuacggauccaguccauacgcaauggacuacuggggacaaggaacacuuguaaccguuucaucagcaucaacaaaaggaccaucaguauucccacuagcacccucaucaaaaucaacaucaggaggaaccgccgccuuaggaugcuuaguaaaagacuauuucccagaaccugucacuguaucauggaauuccggugcacuuacaagcggaguacacacauuuccagcaguacuacaaucauccggacuauacucccuuucaucaguaguaacaguaccaagcucaagccuaggaacacaaacuuauauaugcaacguaaaucacaaaccaucaaacacaaaaguagacaaaaaaguagaacccaaaucaugcgauaaaacccacacuugcccaccauguccagcaccugaacuauuaggaggaccuucaguauuccuauucccaccuaaaccaaaagauacacuaaugauaaguagaaccccagaaguaacaugcgucguaguagauguaucacacgaagacccagaaguaaaauuuaacugguauguggauggaguagaaguacauaaugcuaaaacaaaaccacgagaagaacaauauaauucaacauauagaguaguauccguacuuacaguccugcaccaagacuggcuaaacgguaaagaauauaaauguaaaguaaguaauaaagccuuaccagcaccaauagaaaaaacaauauccaaagcaaaaggacaaccaagagaaccacaaguauauacacucccaccuucgagagaagaaaugaccaaaaaucaaguaucacuaacaugucuaguuaaaggauucuauccaucagauauugcaguagaaugggaaucaaauggacaaccagaaaauaauuauaaaacgacaccaccaguauuagacucagauggaucauucuucuuauauucaaaacuuacaguugauaaaucaagauggcaacaaggaaacguauucaguuguuccguaaugcaugaagccuuacauaaccacuauacacaaaaaaguuuaagccuaaguccaggaaaa

SEQ ID NO: 46943 - RNA, 639 nt, Artificial Sequence
  derived and/or modified sequence opt6 from Vunakizumab_LightChain
gaaauaguucuaacacaaucaccagacuuccaaucaguaacaccaaaagaaaaaguaacaauaacaugcucagcaucaucaucaguaaacuacaugcauugguuccaacaaaaaccagaccaauccccaaaauuauggauauacagaacaucaaaccuagcaucaggaguaccaucaagauuuucaggaucaggauccggaacagacuacacacuaacaauaaacucacuagaagcugaagacgcagccacauacuacugucaacaaagauccuccuacccauggacauucggacaaggaacaaaacuagaaaucaaaagaacaguagcagcaccaucaguauucauauucccaccaucagacgaacaacuaaaaucaggcacagcaucagucguaugccuacuaaacaacuucuacccacgcgaagcaaaaguacaauggaaaguagauaacgcacuacaaucaggaaacucacaagaaucaguaacagaacaagacucaaaagacucaacauacucacuaucaucaacacuaacccuaucaaaagcagacuacgaaaaacacaaaguauaugcaugcgaaguaacacaccaaggauuaucaucaccaguaacaaaaucauucaacagaggagaaugc

SEQ ID NO: 46944 - RNA, 1341 nt, Artificial Sequence
  derived and/or modified sequence opt6 from Xentuzumab_HeavyChain
caaguagaauuaguagaaucaggaggaggauuaguucaacccggaggaucacuaagauuaucaugcgcagcaucaggauuuacauucacaucauauuggaugucauggguaagacaagcaccaggcaaaggucuagaauuagucucaucaaucacuucauacggaucauucaccuacuacgcagacaguguaaaaggacguuucacaauuucaagagacaacuccaaaaacacccuuuauuuacaaaugaauucuuuaagagcugaagauaccgcugucuacuacugcgcaagaaacauguauacacauuuugauucuuggggacaaggaacacuaguaacaguuucaucugccucaacaaaaggaccaucuguauuuccauuagcaccuucaucaaaaucaaccucaggaggaacagccgcauuaggauguuuaguaaaagauuacuucccagaaccaguaacaguaucauggaacucuggagcccuaacaucagguguacacacuuuuccagcuguacuacaauccaguggacuauauucacuaucaucuguaguaacaguaccaucaagcucacuaggaacacaaacuuacauauguaacguaaaucacaaaccuucaaacacaaaaguugauaaaaaaguagaaccaaaaaguugcgauaaaacccauacuugccccccauguccagccccugaauuauuaggaggcccaucaguauuccucuucccuccaaaacccaaagacacccuaaugauaucaagaacaccagaaguaaccuguguaguaguagacguaucacacgaagauccagaaguaaaauuuaauugguacgucgacggaguggaaguacacaaugcaaaaacaaaaccuagagaagaacaauacaauuccaccuauagagucgucucuguucuaaccguauuacaccaagacuggcuaaacggcaaagaauacaaaugcaaaguaucaaacaaagcacuaccagcaccuaucgaaaaaacaauauccaaagccaaaggccaacccagagaaccacaaguauauacacuuccacccucaagagacgaacuuacaaaaaaccaaguuucucuaacauguuuagucaaaggauucuaccccuccgacauagcaguagagugggaaucaaacggacaaccagaaaacaacuacaaaacaacaccuccaguacuagacucugacggcucauucuucuuauacucaaaacucacuguagacaaaucaagauggcaacaaggcaaugucuucucaugcucuguaaugcaugaagcacuacacaaucacuacacacaaaaaucacuaucucucucaccaggaaaa

SEQ ID NO: 46945 - RNA, 648 nt, Artificial Sequence
  derived and/or modified sequence opt6 from Xentuzumab_LightChain
gacauaguacuaacacaaccaccaucaguaucaggagcaccaggacaaagaguaacaauaucaugcucaggcucaagcucaaacauaggaucaaacucuguauccugguaccaacaacucccaggaacagcacccaaauuacuaauauacgacaacucaaaaagaccaucaggaguaccagacagauucaguggaucaaaaucaggaacaucagcaucacuagcaauaacaggacuacaaucagaagacgaagcagacuacuacugucaaucaagagacacauacggauacuacuggguauucggaggaggaacaaaauuaacaguccucggacaaccaaaagcagcaccaucaguaacacuauucccaccaucaagcgaagaacuacaagcaaacaaagcaacacucguaugccuaauaucagacuuuuacccaggagcaguaacaguagcauggaaaggagacucaucaccaguaaaagcaggaguagaaacaaccacaccaucaaaacaaucaaacaacaaauacgcagcaucaucauaccuaucauuaacaccagaacaauggaaaucacacagaaguuauagcugccaaguaacacacgaaggaagcacaguagaaaaaacaguagcaccaaccgaaugcuca

SEQ ID NO: 46946 - RNA, 726 nt, Artificial Sequence
  derived and/or modified sequence opt6 from anti-rabies_SO57_LightChain
augucaguaccaacaauggcaugggcauuacuacuauuaucacuacuaacacaaggaacaggcaguugggcacaaucagcacuaacacaaccaagaucaguauccggaucaccaggacaauccguaacaauaucaugcacaggaacaucaucagauauaggaggauacaauuuuguaucaugguaccaacaacacccaggaaaagcaccaaaacuaaugauauacgacgccacaaaaagaccaagcggaguaccagauagauuuucaggaucaaaaucaggcaacacagcaucacuaacaauaucaggauuacaagcagaagacgaagcagacuacuacugcugcucauaugcaggagacuacacaccaggagucguauucggaggaggaacaaaacuaacaguacuaggacaaccaaaagcagcaccaucaguaacacuauucccaccaucaucagaagaauuacaagcaaacaaagcaacacuaguaugccuaauaucagacuucuacccaggagcaguaacaguagcauggaaagcagauagcucaccaguaaaagcaggaguagaaacaacaacaccaucaaaacaaagcaacaauaaauacgcagcaucaucauacuuaucuuuaacaccagaacaauggaaaucacacagaucauacagcugucaaguaacacacgaaggaucaacagucgaaaaaacaguagcaccaacagaaugcuca

SEQ ID NO: 46947 - RNA, 1428 nt, Artificial Sequence
  derived and/or modified sequence opt6 from anti-rabies_SO57_HeavyChain
auggacuggacauggcgauuuuuauuuguuguagcugcagccacaggaguccaaucacaaguacaauuagugcaaucaggagcugaaguaaaaaaaccagguucaucaguaaaaguaaguugcaaagccucaggaggaaccuucaauagauacacaguaaacuggguaagacaagcaccaggacaaggacuagaauggaugggcggaauaaucccaaucuuugguacagcaaacuaugcacaaagauuucaaggacgauuaacuauaacagcagaugaaagcaccucaacagcauacauggaauuaucaucacuacgaucagacgacacagcaguauauuucugcgcacgagaaaaucuagauaauucagguacauauuauuacuucaguggaugguuugauccauggggccaaggaacauuaguaacagugucaucagcaucaacaaaaggaccuucagucuuccccuuagcaccaucaagcaaauccacaucaggaggaacugcagcacuaggaugcuuagucaaagauuauuucccagaacccguaacaguaucauggaacucaggagcacuaacaagugggguacauacauucccagcaguacuacaaucaucaggacuauacucauuaucaucaguaguaaccgucccaaguagcagucuaggaacucaaaccuauauaugcaacguaaaccacaaaccgucaaauaccaaagucgacaaaagaguagaaccaaaaaguugcgacaaaacucacacauguccaccuugcccagcaccagaauuacuuggaggaccaucaguauuuuuauuuccaccaaaaccaaaagauaccuuaaugauaucacgcacaccugaaguaacaugcguaguaguagacguaagccaugaagacccugaaguaaaauuuaauugguacguugauggaguagaaguucacaacgcaaaaacaaaaccaagagaagaacaauacaacucaacauauagaguagucucaguauuaacagucuuacaccaagacugguuaaacggaaaagaauauaaaugcaaaguauccaauaaagcauuaccagcacccauagaaaagacaauaagcaaagcaaaaggacaaccuagagaaccacaaguauacacauuaccacccagcagagaagaaaugacaaaaaaccaaguaagccuaacaugucucgucaaaggauucuacccaucagacaucgcaguagaaugggaaucaaacggacaacccgaaaacaacuauaaaacaacaccuccaguacuagacucagacggaucauucuucuuauacucaaaacuaacagucgauaaaucaagauggcaacaaggaaauguauuuucaugcaguguaaugcacgaagcacuacauaaucacuauacccaaaaaucauuaucauuaagucccggaaaa

SEQ ID NO: 46948 - RNA, 696 nt, Artificial Sequence
  derived and/or modified sequence opt6 from anti-rabies_SOJB_LightChain
auggcauggaccguauuacuauuaggacuacuaagccacugcacaggaucaguaacaagcuacguccuaacacaaccaccaucaguaucaguugccccagguaaaacagcaagaauaaacugcggaggaaauaacauagaauacagaucaguacauugguaucaacaaaaaagcggacaagcacccguagcaguaauauacgacaacagcgacagaccaagcggaauaccagaaagauucucaggcucaaaaucaggaaauacagcaacacuaacaauaucaagagucgaagcaggagaugaagccgacuauuauugccaaguaugggacauaucaucagacguaguauucgguggaggaacaaaauuaacaguacuaggacaaccaaaagcagcaccaaguguaacauuauucccaccaucaucagaagaauuacaagcaaacaaagcaacacuaguaugccuaauaucagacuuuuacccaggagcaguuacaguagcauggaaagcagacucaucaccaguaaaagcaggaguagaaacaaccacacccucaaaacaaagcaacaacaaauacgcagcaucaucauaccuaucauuaacaccagaacaauggaaaucacacagaucauacaguugccaaguaacacacgaaggaucaacaguugaaaaaacaguagcaccaacagaaugcagu

SEQ ID NO: 46949 - RNA, 1554 nt, Artificial Sequence
  derived and/or modified sequence opt6 from anti-rabies_SOJB_HeavyChain
auggacacauuaugcucgacauuacuccucuuaaccauaccaucuuggguacuaucacaaauuacacuuaaagaaacaggaccaacauuaguaaaaccaacucaaacauuaacacuaaccugcacauucuccggauuuucacuaucaacaucaggaguuggaguuggauggaucagacaacccccagguaaagcccuagaauggguaacauuaauauacugggacgaugauaaaagauacucaccaucuuuagaaaacagaguaacaauacgaaaagacacaucaaaaaaucaaguagcauuaacaaugacuaauauggauccacucgauacuggaacauacuacugugcccaucgacaacauauauccuccuuuccuugguucgacagcuggggacaagguacacuaguaacagucucaucugcaucaaccaaaggaccaucuguauucccacuagcaccuugcucccgauccacauccggaggcacagcagcacuugguuguuuaguaaaagauuauuucccagaaccaguaacaguaucauggaauucaggagcccuaacaucagguguccacaccuuucccgcuguauuacaaaguuccggauuauauucacuuucaaguguuguaacaguuccuucaucaucucuaggaacucaaacuuacacaugcaacgucaaccauaaacccucaaauacaaaaguagauaaaagaguagaauuaaaaacaccacuaggcgauacaacacacaccuguccucgcuguccagaaccaaaaucaugugacacaccaccaccaugcccaagauguccagaaccaaaaucaugcgacacaccaccaccauguccuagaugcccagaacccaaauccugcgacacuccaccaccaugcccaagaugccccgccccagaacuacuaggaggcccaagcguuuuucuauuccccccuaaaccuaaagacacauuaaugauaucaagaaccccagaaguaaccugcguaguaguugacguuucacacgaagacccagaaguccaauucaaaugguacguugacggcguagaaguacauaacgcaaaaacaaaaccaagagaagaacaauuuaacucuacuuucagaguagucucaguacucacaguuuuacaccaagacuggcuaaacggaaaagaauacaaauguaaaguaucuaacaaagcacuuccagccccaauagaaaaaaccauaucuaaaacaaaaggacaaccuagagaaccacaaguuuauacacuacccccaucacgagaagaaaugacaaaaaaccagguuucauuaaccugccuaguaaaagguuucuauccaucagacauagcaguagaaugggaaucaucaggccaacccgaaaacaauuacaacacuacaccuccaaugcucgacucagacggauccuuuuuccuauauucaaaacucacaguagauaaaucacgauggcaacaaggaaauaucuucuccugcucaguaaugcaugaagcccuacacaaccgauucacccaaaaauccuuaucucuaucgccaggaaaa

SEQ ID NO: 46950 - RNA, 702 nt, Artificial Sequence
  derived and/or modified sequence opt6 from anti-rabies_SOJA_LightChain
auggaagcacccgcacaacuacuauuccuacuacuccuauggcuaccagacacaacaggagaaauaguacuaacucaaucaccagcaacauuauccuuaucaccaggagaaagagcaacauuagcaugcagagcaucacaaacagcaucaagauacuuagcaugguaccaacaaaaaccaggacaagcaccaagacuauuaauauacgacacaucaaacagagcaacaggaauaccagccagauucuccggaucaggaucaggaacagacuucacauuaucaauaucaucacuagaacccgaagacuucgcaguauauuacugccaacaaagauucaacuggccauggaccuucggacaaggaacaaaaguagaauuuaaaagaacaguagcagcaccaucaguauucauauucccaccaucagacgaacaacuaaaaucuggcacagcaucuguagucugcuuacuaaacaacuucuaccccagagaagccaaaguccaauggaaaguagacaacgcacuacaaucaggaaacucacaagaaucaguaacugaacaagacucaaaagacucaacauacagccuaucaucaacccuaacacuaucaaaagcugacuacgaaaaacacaaagucuaugcaugugaaguaacacaccaaggacuaucauccccaguaacaaaaucuuuuaacagaggagaaugc

SEQ ID NO: 46951 - RNA, 1422 nt, Artificial Sequence
  derived and/or modified sequence opt6 from anti-rabies_SOJA_HeavyChain
auggaauuuggucucucaugguuauuccuagucgcaauauuaaaaggaguacaaugcgaaguacaacuacuagaauccggcggaggauuaguucaaccuggaggaagucuaagacuaucaugugcagcaucaggauuuacauucaguaacuaugcaaugucuuggguacgacaagcaccaggaaaaggucuagaauggguaagugcaaucagugccucaggacauagcacauaucuagcugacucaguaaaaggacguuucacuauauccagagacaauaguaaaaacacucuauaccuacaaaugaauaguuuacgagccgaagacacagcaguauacuauugugcaaaagacagagaaguaacaaugauaguagucuuaaacggaggauucgacuauuggggacaaggaacaagaguaacaguaucaucagcuucaacaaaaggaccaagcguauucccauuagcuccaucauccaaaucuaccucaggaggaacagccgcuuuagguugcuuaguuaaagacuauuucccagaaccuguaaccguaucauggaauagcggagcacugaccucaggcguacauacuuuuccagcuguacuacaaucaaguggauuauauagucuaucuagcguaguaaccguuccaagcucaucauuaggaacacaaaccuauauauguaauguuaaucauaaaccaucuaauacaaaagucgauaaacgagucgaaccaaaaucaugugacaaaacacauacaugcccacccugucccgcuccagaauuacuagguggucccucaguauucuuauucccaccaaaaccaaaagauacuuuaaugauaucaagaacaccagaagucacuugcguaguaguugaugucucacacgaagacccagaaguaaaauuuaacugguacguagacggaguagaaguacauaaugcaaaaacaaaaccaagagaagaacaauacaacagcacauacagaguaguauccguauuaacaguacuucaccaagacuggcuaaacggaaaagaauauaaauguaaaguaucaaacaaagcauuaccugcaccaauagagaaaacaaucucaaaagccaaaggucaaccacgagaaccacaaguauauacucuacccccaucacgugaagaaaugacuaaaaaucaaguaagucuuacaugcuuagucaaagguuucuauccuucugauauagccguagaaugggaaucaaacggacaaccagaaaacaauuacaaaacaacaccaccaguauuagauagcgaugguuccuucuuuuuauacagcaaauuaacugucgacaaaucaagauggcaacaaggaaauguauucucauguucaguaaugcaugaagcacuacacaaucacuauacucaaaaaucauuaucacuaagcccaggcaaa

SEQ ID NO: 46952 - RNA, 321 nt, Artificial Sequence
  derived and/or modified sequence opt6 from anti-rabies_LightChain
guaaugacacaaucaccagcaacauuaucauuaagcccaggagaaagagcaacauuaagcuguagagcaagccaaagcguaagaaauuacuuagcaugguaccaacaaaaaccaggacaagcaccaagacuauuaauauauggagcaagcaauagagcaacaggaauaccagcaagauucagcggaucaggaucaggaacagacuuuacauuaacaauaagcucacuagaaccagaagacuuugcaguauacuauugccaacaaagaucagauuggccacuaucauucggacaaggaacaaaacuagaaauaaaaagaaca

SEQ ID NO: 46953 - RNA, 333 nt, Artificial Sequence
  derived and/or modified sequence opt6 from anti-rabies_HeavyChain
ggaccagcaugggaaguaccagaaacacuaccaguacaaccauuagacucaccaucaguagcaauggcaugcacaggaguaagacaagcaccaggaaaaggauuagaauggguagcaguaauaaguuaugacggaaguaauaaauauuacgcagacucaguaaaaggaagauuuacaauaucaagagauaauaguaaaaauacauuauauuuacaaaugaacucacuaagagcagaagacacagcaguauacuauugugcaaaagauucaaauaguggaaguuauuaugcacaugauuuaggauacuggggacaaggaacauuaguaacagua

SEQ ID NO: 46954 - RNA, 342 nt, Artificial Sequence
  derived and/or modified sequence opt6 from anti-rabies_LightChain
gaauuaguaaugacacaaucaccacuaucacuaccaguaacacuaggacaaccagcaucaauaucaugcagaucaucacaaucacuaauacacucaaacggaaacacauaccuaaacugguuccaacaaagaccaggacaaucaccaagaagacuaauauacaaaguaucagacagagacucaggaguaccagacagauucucaggaucaggaucaggaacagacuucacacuaaaaauaucaagaguagaagcagaagacguaggaguauacuacugccuacaaggaacacacuggccaagaacauucggacaaggaacaaaacuagaaauaaaaagaaca

SEQ ID NO: 46955 - RNA, 351 nt, Artificial Sequence
  derived and/or modified sequence opt6 from anti-rabies_HeavyChain
guaguacaaccaggaagaucacuaagacuaucaugcgcagcaucaggauuuacauuuagcucauacgcaaugcauuggguaagacaagcaccaggaaaaggacuagaauggguagcaguaauaagcuaugacggaagcaauaaauauuacgcagacucaguaaaaggaagauucacaauaucaagagauaacagcaaaaauacauuauacuuacaaaugaacucacuaagagcagaagacacagcaguauacuauugcgcaagagauaaagcacuagcagcaagaagaggauacuauuacuauuacggaacagauguauggggacaaggaacauuaguaacaguaucauca

SEQ ID NO: 46956 - RNA, 648 nt, Artificial Sequence
  derived and/or modified sequence opt6 from anti-RSV_5ITB_LightChain
ucagacauacaaaugacacaauccccaucaacauuaucagcaucaguaggagacagaguaacaauaacaugcagagcaucacaaucaauaucaucauggcuagcaugguaccaacaaaaaccaggaaaagcaccaaaauuacucauauacgacgcaucaucacuagaaucaggaguaccaucuagauucuccggaucaggaucaggaacagaauucacacuaacaauaucaucauuacaaccagacgacuucgcaacauacuacugccaacaauacaacacauacucaugguggacauucggacaaggaacaaaaguagacauaaaaagaacaguugcagcaccaucaguauucauauucccaccaucagacgaacaacuaaaaucaggaacagcaucaguaguaugcuuauuaaacaacuucuacccaagagaagcaaaaguacaauggaaaguagacaacgcacuacaaucaggaaacucacaagaauccguaacagaacaagacucaaaagacucaacuuacagccuaagcucaacccuaacacuauccaaagcagacuacgaaaaacacaaaguauacgcaugcgaaguaacacaccaaggccuaucaucaccaguaacaaaaucauucaacagaggagaaugc

SEQ ID NO: 46957 - RNA, 660 nt, Artificial Sequence
  derived and/or modified sequence opt6 from anti-RSV_5ITB_HeavyChain
guagaaaguggaggaggauuaauacaacccggaggaucauuaagauuaucaugcgcaguaucaggauucacaguaucaucaaaauauaugacauggguaagacaagcaccaggaaaaggacuagaauggguaucaguuauuuacggaggaggaucaacauauuaugcagauucaguaguaggaagauucacaauaucaagagauaacaguaaaaauacauuauacuuacaaaugaacucauuaagagcagaagauacugcaguauacuacugcgcaagcagauuaggaguaagagcaacaacaggagauuuagacuauuggggacaagguacauuaguaacuguaucaagcgcaucaacuaaaggaccaucaguauuuccauuagcaccaucaucaaaaucaacaucaggaggaacagcagcauuaggauguuuaguaaaagauuacuuuccugaaccaguuacaguaaguuggaauaguggugcacuaacaucaggaguacauacauucccagcaguauuacaaucauccgguuuauauucauuaaguucaguaguaacaguaccaaguagcucacuaggaacacaaacauauauauguaauguaaaucauaaaccaucaaauacaaaaguagauaaaagaguagaaccaaaaucaugu

SEQ ID NO: 46958 - RNA, 639 nt, Artificial Sequence
  derived and/or modified sequence opt6 from anti-alpha-toxin_4U6V_LightChain
gacauacaaaugacacaaucaccaucaacacuaucagccucaguaggagacagaguaacaauaacaugcagagcaucacaaucaauaucauccuggcuagcaugguaccaacaaaaaccaggaaaagcaccaaaacuacucauauacaaagcaaguucacuagaaucaggaguaccaucaagauucucaggaucaggcucaggaacagaauuuacauuaacaauaucaucacuacaaccagaugacuucgcaacauacuacuguaaacaauaugcagacuacuggacauucggacaaggaacaaaaguagaaauaaaaagaacaguagcagcaccaucagucuucauauucccacccucagacgaacaacuaaaaucaggaacagcaucaguaguaugucuauuaaacaacuuuuacccaagagaagcaaaaguccaauggaaaguagacaacgcacuacaaucaggaaacucacaagaaucaguaaccgaacaagacucaaaagacucaacauacucauuaucaucaacacuaacacuaucaaaagcagacuacgaaaaacacaaaguauacgcaugcgaaguaacacaccaaggacuaucaucaccaguaacaaaaucauucaacagaggagaaugc

SEQ ID NO: 46959 - RNA, 675 nt, Artificial Sequence
  derived and/or modified sequence opt6 from anti-alpha-toxin_4U6V_HeavyChain
gaaguacaauuaguagaaagcggaggaggauuaguacaaccaggaggaaguuuaagauuaaguugugcagcaaguggauuuacauuuaguagucaugauaugcauuggguuagacaagcaacaggaaaaggacuagaauggguaucaggaauaggaacagcaggagauacauauuauccagacucaguaaaaggaagguuuacaauaucaagagaaaaugcgaaaaauaguuuauaucuacaaaugaauaguuuaagagcaggagauacagcaguauauuauugugcaagagauagauauucaccaacaggacauuauuauggaauggauguauggggacaaggaacaacaguaacaguaagcagugcaucaacaaaaggaccaaguguauuuccgcuagcaccaucaaguaaaaguacaucaggaggaacagcagcauuaggaugcuuaguuaaagauuauuuuccagaaccaguuacaguuucauggaauaguggggcauuaacaaguggaguacauacauucccagcaguacuacaaagcucaggacuauauucauuaaguaguguaguaacaguaccaaguucaaguuuagguacacaaacauauauauguaauguaaaucacaaaccaucaaauacaaaaguagauaaaagaguagaaccaaaaucaugu

SEQ ID NO: 46960 - RNA, 879 nt, Artificial Sequence
  derived and/or modified sequence opt6 from anti-alpha-toxin_4U6V_Chain-A
gcagacagugacauaaacauaaaaacaggaacaacagacauaggaucaaacacaacaguaaaaacaggagacuuaguaacauacgacaaagaaaacggaaugcacaaaaaaguauucuacagcuucauagaugacaaaaaccacaacaaaaaacuacuaguaauaagaacaaaaggaacaauagcaggacaauauagaguauacucagaagaaggugcaaacaaaucaggacuagcauggccaagcgcauucaaaguccaacuacaacuaccagauaacgaaguagcacaaauaagugacuacuacccacgaaacucaauagauacaaaagaauacaugucaacacuaaccuacggauuuaacggaaacguaaccggagacgacaccggaaaaauaggaggacuaauaggagcaaaugucaguaucggacacacacuaaaauacguacagccagacuucaaaacaauauuagaaagcccaacagacaaaaaaguaggauggaaaguaauauucaacaacaugguaaaucaaaacuggggaccauacgauagagauucauggaauccaguauacggaaaucaacucuucaugaaaacaagaaacggcucaaugaaagcagcagauaacuucuuagaccccaacaaagccucaucacucuuaucaucaggauucucaccagacuuugcaacaguaauaacaauggacagaaaagcaagcaaacaacaaacaaacaucgacguaauauacgaaagagucagagacgacuaccaauuacacuggacaucaacaaacuggaaaggaacaaacacuaaagacaaauggauagauagaucaucagaaagauacaaaauagacugggaaaaagaagaaaugacaaau

SEQ ID NO: 46961 - RNA, 879 nt, Artificial Sequence
  derived and/or modified sequence opt6 from anti-alpha-toxin_4U6V_Chain-B
gcagacucagacauaaacaucaaaacaggaacaacagacauaggaucaaacaccacaguaaaaacaggagaucuaguaacauaugacaaagaaaauggaaugcacaaaaaaguauucuacucauuuauagacgacaaaaaucacaacaaaaaauuacuaguaauuagaacaaaaggaacaauagcaggacaauacagaguauacucagaagaaggagcaaacaaaucaggacuagcauggccaucagcauucaaaguacaacuacaacuaccagacaacgaaguagcacaaauaagcgacuacuacccaagaaacucaauagacacaaaagaauacaugaguacauuaacauacggauucaacggaaacguaacaggagacgacacaggaaaaauaggaggacuaauaggagccaacguaucaauaggacacacccuaaaauacguacaaccagacuucaaaacaauacuagaaagucccacagacaaaaaaguaggauggaaaguaauauucaacaacaugguaaaccaaaacuggggaccauacgacagagacagcuggaacccaguauacggaaaccaacuauucaugaaaacaagaaacggaucaaugaaagcagcagauaacuucuuagauccaaacaaagccagcucacuacuaaguucaggauucaguccagacuucgccacaguaauaacaauggacagaaaagcaucaaaacaacaaacaaacauagauguaauauacgaaaggguaagagacgacuaccaacuucacuggacaucaacaaacuggaaaggaacaaauacaaaagacaaauggauagaccgauccagcgaaagauacaaaauagauugggaaaaagaagaaaugacaaac

SEQ ID NO: 46962 - RNA, 642 nt, Artificial Sequence
  derived and/or modified sequence opt6 from anti-IsdB_5D1Q_Chain-A
gacauacaacuaacacaaucaccaucaucaguauccgcaucagucggcgacagaauaacaauaacaugcagagcaucacaagacauauccaacuggguagccugguaccaacaaaaaccaggaaaagcaccaaaacucuuaauauacucagcaucaucacuacaaucaggaguaccaucaagauucucaggaucaggaucaggaacagacuucacccuaaccauaucaucacuacaaccagaagacuucgcaacauacuacugccaacaagcaaacacauucccauggacauuuggacaaggaacaaaagucgaaauaaaaagaacaguagcagcaccaucaguauucauauucccacccucagacgaacaacuaaaaucaggaacagcaucaguaguaugucuacucaacaacuucuacccaagagaagcaaaaguacaauggaaagucgacaacgcacuacaaucaggaaacucacaagaaucaguaacagaacaagauucaaaagacucaacauacucccuauccucaacauuaacacuaucaaaagcagacuacgaaaaacacaaaguauacgcaugcgaaguaacacaucaaggacuaucaucaccaguaacaaaaucauucaacagaggagaaugc

SEQ ID NO: 46963 - RNA, 783 nt, Artificial Sequence
  derived and/or modified sequence opt6 from anti-IsdB_5D1Q_Chain-B
caaguacaauuaguacaaucaggugcagaaguaaaaaaaccagcaucaaguguaaaaguaucaugucaagcaucaggaggaucauucucaacaagaacaauaucauggcuaagacaagcccccggacaaggccuagaauggaugggaggaauaucaccaauauuuggagcagcaaacuacgcacaaagauuucaaggaagaguaacaauaacagcagauaaaucaacaucaacagcauauauggaacuaacaucauuaacaucagaagauacagcaguauauuacugcgcaagagacagaccaccaggagcacaauuugacacauggggacaagguacauuaguaacaguaucaucagcaucaacuaaaggcccaagcguauucccauuagcaccaucaucaaaaagcaccucaggaggaacagcagcauuaggaugccuaguaaaagauuacuuuccagaaccaguuacaguuucauggaacagcggagcacuaacaucaggaguacacacauuuccugcaguauuacaaucaucaggccuauacucauuaucaucaguaguaacaguaccaaguucaagucuaggaacacaaacauacauauguaacguaaaccauaaaccauccaauacaaaaguagacaaaaaaguagaaccaaaaucauguggaggaggauccggacaccaccaucaccaucaccaucaccaucacggcggagacuauaaagaccaugacggagacuauaaagaucaugacauagauuacaaagaugaugacgauaaa

SEQ ID NO: 46964 - RNA, 822 nt, Artificial Sequence
  derived and/or modified sequence opt6 from anti-IsdB_5D1Q_Chain-C
gaaguacaauuaguugaaucaggaggaggacucguacaaccaggaggaucauuaacacuaaguugcgcagcaaguggauuaauuuuuucagauucaacaaugcauuggguaagacaagcaucaggaagaggauuagaaugggucgcaagaauuagaaguaaagcaaacaauuacgcaacaucaucagacaaaucagcaacagcauaccuagcaucaguaaaaggaagauuuacaauuucaagagacgauucaaaagacacuacauuuuuagaaaugaguucauuaaaaauagaagauacagcaguauauuacuguauagcaaguucaacaacaggaugguacguaagagaagauuucgacuauuggggacauggaacauuaguaacaguaaguagcgcaucaacaaaaggaccaucaguauuuccacuagcaccuagcagcaaaagcacaaguggaggcacagcagccuuaggaugucuaguaaaagauuacuuuccagaaccagucacaguaucauggaauucaggagcauuaacaucagguguacauacauuuccagcaguacuacaaaguucaggauuauauucacuaucaucaguaguaacaguuccaucaagcagucuaggaacacaaacauauauauguaacguaaaccauaaaccaucaaacacaaaaguagauaaaaaaguagaaccaaaaucauguggaggaggaucaggacaucaccaucaccaucaccaucaccaucacggaggagauuauaaagaccaugacggagacuauaaagaucaugauauagauuauaaagacgaugaugacaaa

SEQ ID NO: 46965 - RNA, 648 nt, Artificial Sequence
  derived and/or modified sequence opt6 from anti-IsdB_5D1Q_Chain-D
gaaauaguacucacacaaagcccaggaacauuaagccuaagcccaggcgaacgagcaacacuaucaugucgagcaucacaaagcguaagcucaagcuauuuagcaugguaccaacaaaaaccaggacaagcaccaagauuacuaauauacggagcuucaagcagagcaacaggaauaccagauagauuuucaggaagcggaagcggaacagauuucacacuaucaauaucaagacucgaaccagaagauuucgcaguauauuauugucuacauuauggaaccucaccaauguacacauucggacaaggaacaaaacuagaaauaaaacgaacaguagcagcaccaucaguauucauauucccaccaucagacgaacaauuaaaaucuggaacagcaucaguaguaugccuccuaaacaacuuuuacccaagagaagccaaaguacaauggaaaguagauaacgcacuccaaucaggaaacucacaagaaucaguaacagaacaagauucaaaagacucaacauauucauuaagcucaacacuaacauuaagcaaagcagauuacgaaaaacauaaaguauacgcaugcgaaguaacacaccaaggacuaucaucaccaguaaccaaaucauuuaacagaggagaaugc

SEQ ID NO: 46966 - RNA, 360 nt, Artificial Sequence
  derived and/or modified sequence opt6 from anti-IsdB_5D1Q_Chain-E
ccaggaaaaaugacagaccuacaagacacaaaauacguaguauacgaaucaguagaaaacaacgaaucaaugauggacacauucguaaaacacccaauaaaaacaggaaugcuaaacggaaaaaaauacaugguaauggaaacaacaaacgacgacuacuggaaagacuucaugguagaaggacaaagaguaagaacaauaagcaaagacgcaaaaaacaacacaagaacaauaauauucccauacguagaaggaaaaacacuauacgacgcaauaguaaaaguacacguaaaaacaauagacuacgacggacaauaccacguaagaauaguagacaaagaagcauucacaaaagcaaac

SEQ ID NO: 46967 - RNA, 657 nt, Artificial Sequence
  derived and/or modified sequence opt6 from anti-IsdB_5D1X_Chain-A
gacauagucaugacacaaucaccauuaucacuaccaguaacauuaggacaacccgccucaauaucaugcucaucagcacaaucccuaguacacucagacggagacucauacuuaacaugguuccaccaaagaccaggacaaucaccaagaagauuaaucuauaaaguaucaauaagagacgcuggaguaccagacagauucucaggaucaggaucaggaacagacuucacauuaaaaauaucaagaguagaagcagaagacguaggaguauacuacugcaugcaagcaacacacuggccauacacauucggacaaggaaccaaauuagaaauaaaaagaacaguagcagcaccaucaguauucauauucccaccaucagacgaacaacuaaaaucaggaacagcaucaguaguaugcuuauuaaacaacuucuacccaagagaagcaaaaguacaauggaaaguagacaacgcacuacaaucaggaaacucacaagaaucaguaacagaacaagauucaaaagacucaacauacucacuaagcucaacacuaacacucucaaaagcagacuacgaaaaacauaaaguauacgcaugcgaagucacacaccaaggacuaucaucaccaguaaccaaaucauuuaacagaggagaaugc

SEQ ID NO: 46968 - RNA, 777 nt, Artificial Sequence
  derived and/or modified sequence opt6 from anti-IsdB_5D1X_Chain-B
caaguacaacuaguacaaucaggaucagaaguaaaaaaaccaggaucaucagucacacucucauguaaagcaucaggcgacacauucaauacacacacauacucuuggguaagacaagcaccaggacaaagacuagaauggauuggaggaauaaugccaauauucgcagcaucaaaaucagcaccacauuuacaagacagacuuacaauaacagcaaauaaagccacaagaacugcauacauggaauuaacuucacucacaucagacgacucagguguauacuacugugcaagagacggaagaggagcacuacaauacuggggacaaggaacauuaguaacaguaucaagcgcaucaacaaaaggaccaucaguauucccauuagcaccaucaaguaaaucaacaucaggaggaacagcagcacuaggcugccuagucaaagauuacuuuccagaaccaguaacaguaucauggaacucaggagcacuaacaucaggaguacauacauuuccugcaguacuacaaaguucaggccuauauucauuaucaucaguaguaacaguaccaucauccagucuaggaacacaaacauauauauguaacguaaaccacaaacccucaaacacaaaaguagauaaaaaaguagaaccaaaaucaugcggaggaggaucaggacaccaccaucaccaccaccaccaccaucacggcggagacuacaaagaccaugacggagacuauaaagaccacgacauagauuacaaagaugacgaugacaaa

SEQ ID NO: 46969 - RNA, 822 nt, Artificial Sequence
  derived and/or modified sequence opt6 from anti-IsdB_5D1X_Chain-C
gaaguacaacuaguagaaucuggagguggacuaguacaacccggaggaucacuaacauuaaguugugcagcaucaggcuuaauauuuagcgauucaacaaugcauuggguaagacaagcaaguggaagaggacuagaauggguagcaagaauaagaucuaaagcaaacaauuacgcuacaucaucagacaaaucagcaacagcauaucuagcaucaguaaaaggaagauuuacaauaucaagagacgauucaaaagacacaacauuuuuagaaaugucaucauuaaaaauagaagauacagcaguauauuacuguauagcaucaucaacaacuggaugguacguaagagaagacuuugacuauuggggacauggaacacuaguaacaguaucaucagcuucaaccaaaggaccaucaguauucccauuagcaccaucauccaaaucaacaucaggaggaacagcagcauuaggaugucuaguaaaagauuacuuucccgaaccaguaacaguaucauggaacucaggagcacuaacaucaggaguacacacauuuccagcuguauuacaaucaucaggucuauauaguuuaaguucaguaguaacagucccaucuaguucauuaggcacacaaacauauauauguaacgucaaccauaaaccaucaaauacaaaaguagauaaaaaaguagaaccaaaaucauguggaggaggaucaggccaccaucaucaccaucaccaucaccaucacggaggagauuauaaagaccaugacggagacuauaaagaucacgacauagauuacaaagacgaugacgauaaa

SEQ ID NO: 46970 - RNA, 648 nt, Artificial Sequence
  derived and/or modified sequence opt6 from anti-IsdB_5D1X_Chain-D
gaaauaguuuuaacacaaacaccagcaacauuaaguuuaacaccaggagaaagagcaacauuaaccuguagagcaagccaaucaguaucaucaucauaucuagcaugguaucaacaaaaaccaggacaagcaccaagacuacuaaucuacggagcaucaucaagagcaacaggaauaccagauagauucucaggcagcggaucaggaacagauuucacauuaucaauaucaagacuagaaccagaagauuucgcaguauauuacugccuacauuacggaacaucaccaauguacuuuuucggaagaggaacaguacucgauauaaaaagaacaguagcagcaccaagcguauucauauucccaccaucagacgaacaauuaaaaucaggaacagcaucaguaguaugccuacuuaauaauuuuuacccaagagaagcaaaaguacaauggaaaguagauaacgcacuacaaucaggaaacucacaagaaucaguaacagaacaagauucaaaagacucaacauacucauuaagcucaacauuaacauuaagcaaagccgauuacgaaaaacauaaaguauacgcaugcgaaguaacacaccaaggauuaucaucaccaguaaccaaauccuuuaacagaggagaaugc

SEQ ID NO: 46971 - RNA, 354 nt, Artificial Sequence
  derived and/or modified sequence opt6 from anti-IsdB_5D1X_Chain-E
aaaaugacagaccuacaagacacaaaauacguaguauacgaaucaguagaaaacaacgaaucaaugauggacacauucguaaaacacccaauaaaaacaggaaugcuaaacggaaaaaaauacaugguaauggaaacaacaaacgacgacuacuggaaagacuucaugguagaaggacaaagaguaagaacaauaagcaaagacgcaaaaaacaacacaagaacaauaauauucccauacguagaaggaaaaacacuauacgacgcaauaguaaaaguacacguaaaaacaauagacuacgacggacaauaccacguaagaauaguagacaaagaagcauucacaaaagcaaac

SEQ ID NO: 46972 - RNA, 792 nt, Artificial Sequence
  derived and/or modified sequence opt6 from anti-IsdB_5D1Z_Chain-B
gcagaaguacaauuaguagaaucaggaggagguguaguacaaccaggaggaagucuaagauuaucaugugcagcaucagguuucacauuuaauaaauuuuggaugaacuggguaagacaagcaccaggaaaaggauuagaauggguagcagauauacaaguagauggaucagaaaaaaauuacguagauucaguaaaaggaagauuuaccauaucaagagauaauggaaaaaauucacuauaucuacaaaugaauucauuaagagcagaagauacaggaguauauuauugugccagaggaagauacgauuacuggucaggauaccuaucaccuuggggacaaggaacauuaguaacaguaucaagcgcaucaacaaaagguccaucaguauuuccacuugccccuaguaguaaaucaacaaguggaggaaccgcagcauuaggaugucuaguaaaagauuauuuuccagaaccaguaacaguaagcuggaacucaggagcucuaacuucaggaguacauacauuuccagccguauuacaaucaaguggacuauauucauuaagcucaguaguaaccguuccaucaucaucauuagguacacaaacauauauaugcaacguaaaucauaaaccaaguaauacaaaaguagauaaaaaaguagaaccaaaaagcuguggaggaggaaguggacaucaccaucaucaucaccaucaucaucauggaggagauuacaaagaucaugacggagacuauaaagaucacgauauagauuacaaagacgaugacgauaaa

SEQ ID NO: 46973 - RNA, 642 nt, Artificial Sequence
  derived and/or modified sequence opt6 from anti-IsdB_5D1Z_Chain-C
gauauacaacucacacaaucaccaucauucuuauccgcauccguagcagacagaguaacaauaacaugcagagcaagccaagcaguaagaucaucacuagcaugguaccaacaaaaaccaggaaaagcaccacaacuacuaauauacucagcaucaacacuagaaaacggagucucaucaagauucucaggaucaggaccaggaacagaauuuacacuaacaauaucaucacuccaaccagaagacguaggaacauacuacugccaacaacuaaacacauaccccuucacauucgguccaggaacaaaaguugaaauaaaacgaaccguagcagcaccaucuguauucauauucccaccaucagacgaacaauuaaaaucaggaacagcaucaguaguaugcuuacucaacaacuucuacccacgagaagcaaaaguacaauggaaagucgacaacgcacuacaaucaggaaacucacaagaaucaguaacagaacaagauucaaaagacucaacauacagccuaucaucaacacuaacauuauccaaagcagacuacgaaaaacacaaaguauacgcaugcgaaguaacacaccaaggacuauccucacccguaacaaaaucauuuaacagaggcgaaugc

SEQ ID NO: 46974 - RNA, 810 nt, Artificial Sequence
  derived and/or modified sequence opt6 from anti-IsdB_5D1Z_Chain-D
caaguacaacuacaagaaucagguccaggauuaguaaaaccaucagaaacacuaucauuaauauguacagucucaggaggaucaauaucaucaucaucauacuauugggguuggauaagacaaacacccgaaagaaaccuagaauggauaggaauaauauacuucucaggaacaacauauuacaacccaucacuacaauccagaguaucaaugucauuagacagauccaccaacagauucagccuaagauuaucaucaguaacugccgcagacacagcaauauacuacugcgccaaaccaaaaucaagagacagaggaggaccaggagacgacuacuucggaauggacgucuggggacaaggaauaauggucacaguaagcucagcaucaacaaaaggcccaagcguauucccacuagcaccaucaucaaaaucaacuucaggaggaacagcagcacuaggaugccuaguaaaagauuauuucccagaacccguaacagucucauggaacucaggagcauuaaccucaggaguacacacauuuccagcaguacuacaaucaucaggauuauacucacuaucaucaguaguaacuguaccaaguucaucauuaggaacacaaacuuacauaugcaacguaaaucacaaaccaucaaacacuaaaguagacaaaaaagucgaaccaaaaucauguggaggaggaucaggucaccaccaccaccaccaccaccaucaccacggaggagacuacaaagaccacgacggagauuacaaagaucacgauauagacuacaaagacgacgacgacaaa

SEQ ID NO: 46975 - RNA, 810 nt, Artificial Sequence
  derived and/or modified sequence opt6 from anti-IsdB_5D1Z_Chain-F
caaguacaacuacaagaaucaggaccaggacuaguaaaaccaucagaaacacuaucacuaauaugcacaguaucaggaggaucaaucucaaguucaaguuacuauuggggauggauaagacaaacaccagaaagaaaccuagaauggauaggaauuauauauuuuucaggaacaacauacuacaauccaucacuacaaaguagaguaucaaugucauuagaccgaaguacaaaccgauucucacuaagauuaucaucagucacagcagcagacacagcaauauacuacugugcaaaaccaaaaucaagagacagaggaggaccaggagacgacuauuucggaauggauguauggggacaaggcauaaugguaacaguaaguucagcaucaacaaaaggaccaagcguauucccacuagcaccaucaucaaaaucaacaucaggaggaacagcagcccuaggauguuuaguaaaagacuacuucccagaaccaguuacaguaucauggaacucaggagcauuaacaucuggaguacacacauucccagccguccuacaaagcucaggauuauacucuuuaucaucaguagucacaguaccaucaucaucauuaggaacacaaacuuacauaugcaauguaaaccacaaaccaucaaacacaaaaguagacaaaaaaguagaaccaaaauccugcggaggaggaucaggacaccaucaccaccaccaccaccaccaccauggaggagacuacaaagaccacgacggagacuacaaagaccaugacauagacuacaaagacgacgaugacaaa

SEQ ID NO: 46976 - RNA, 792 nt, Artificial Sequence
  derived and/or modified sequence opt6 from anti-IsdB_5D1Z_Chain-G
gcagaaguacaacuaguggaaagcggaggaggaguaguucaaccaggaggaucacuuagauuaucaugugcagcaucaggauuuacauuuaauaaauuuuggaugaauuggguaagacaagcaccaggaaaaggacuagaauggguagcagacauacaaguagauggaagugaaaaaaauuauguagauucaguuaaaggaagauuuacaauaucaagagauaauggaaaaaauagcuuauauuuacaaaugaacagcuuaagagcagaagauacagguguauauuauugugcaagaggaagguaugauuauuggucaggauauuuaaguccauggggacaaggaacauuaguaacaguaagcucugcuucaacaaaaggaccaaguguauucccauuagcgccaucaagcaaaaguacgucaggaggaacagccgcauuaggauguuuaguaaaagacuauuucccagaaccaguaacaguuucauggaauaguggagcauuaacaucaggaguacauacauuuccagcgguauuacaaagcucaggauuauacucauuaucaaguguaguaacgguaccaucaucaagcuuaggaacacaaacauauauauguaauguaaaucacaaaccaucgaauacaaaaguagauaaaaaaguagaaccaaaaucauguggaggaggaaguggacaccaucaucaccaucaucaucaccaucaugguggagauuauaaagaucaugauggagacuauaaagaucaugauauagauuacaaagaugaugaugauaaa

SEQ ID NO: 46977 - RNA, 642 nt, Artificial Sequence
  derived and/or modified sequence opt6 from anti-IsdB_5D1Z_HeavyChain
gacauacaaaugacacaaucaccaucauucuuaagcgcauccguaggagaccgaguaacaauaacaugccgagcaucacaaggaauaacaacauaccuaggcugguaccaacaaagaccaggaaaagcaccccaacuauuaauauacgcagcaucaucacuacaaucaggaguacccccaagauucucaggaucaggauccggaacagaauuuacacuaacaaucuccucacuccaaccagaagacuucgccacauacuacugccaacaacuaaacacauacccauacacauucggaccaggaacaagacucgaaauaaaacgaacaguagcagcaccauccguauucauauucccaccaucagacgaacaacuaaaaucaggaacagcaucaguaguaugccuacuaaacaacuucuacccaagagaagccaaaguacaauggaaaguagacaaugcacuacaaucaggaaacucacaagaaucaguaacagaacaagacucaaaagacucaacauacucacuaucaucuacauuaaccuuaucaaaagcagauuacgaaaaacacaaaguauacgcaugcgaagucacacaccaaggauuaucaucacccguaacaaaauccuucaauagaggcgaaugc

SEQ ID NO: 46978 - RNA, 471 nt, Artificial Sequence
  derived and/or modified sequence opt6 from anti-IsdB_5D1Z_Chain-I
ggacccgcaaaagcaacaaacaacacauacccaauacuaaaccaagaacuaagagaagcaauaaaaaacccagccauaaaagacaaagaccacucagcaccaaacucaagaccaauagacuucgaaaugaaaaaaaaagacggaacacaacaauucuaccacuacgcaucaucaguaaaaccagcaagaguaauauucacagacucaaaaccagaaauagaacuaggacuacaaucaggacaauucuggagaaaauucgaaguauacgaaggagacaaaaaacuaccaauaaaacuaguaucauacgacacaguaaaagacuacgccuacauaagauucucaguauccaacggaacaaaagcaguaaaaauaguaucaucaacacacuucaacaacaaagaagaaaaauacgacuacacacuaauggaauucgcacaaccaauauacaacucagcagacaaauucaaaaca

SEQ ID NO: 46979 - RNA, 324 nt, Artificial Sequence
  derived and/or modified sequence opt6 from anti-HIV_b12_LightChain
gaaauaguacuaacacaaucaccaggaacacuaucacuaucaccaggagaaagagcaacauucucaugcagaucaucacacucaauaagaucaagaagaguagcaugguaccaacacaaaccaggacaagcaccaagauuaguaauacacggaguaucaaacagagcaucaggaauaucagacagauucucaggaucaggaucaggaacagacuucacacuaacaauaacaagaguagaaccagaagacuucgcacuauacuacugccaaguauacggagcaucaucauacacauucggacaaggaacaaaacuagaaagaaaa

SEQ ID NO: 46980 - RNA, 381 nt, Artificial Sequence
  derived and/or modified sequence opt6 from anti-HIV_b12_HeavyChain
caaguacaauuagaacaaaguggagcagaaguaaaaaaaccaggagcgaguguaaaaguaaguugucaagcaaguggauauagauuuagucauuuuacaguacauuggguaagacaagcaccaggacaaagauuugaauggaugggauggauaaauccauauaauggaaauaaagaauuuagugcaaaauuucaagauagaguaacauuuacagcagauacaagugcaaauacagcauauauggaauuaagaaguuuaagaucagcagauacagcaguauauuauugugcaagaguaggagaauggggaugggaugauaguccauaugauaauuauuauauggauguauggggaaaaggaacaacaguaauaguaaguagu

SEQ ID NO: 46981 - RNA, 633 nt, Artificial Sequence
  derived and/or modified sequence opt6 from anti-HIV_2G12_LightChain
guaguaaugacacaaucaccaucaacauuaucagcaucaguaggagacacaauaacaauaaccugcagagcaucacaaucaauagaaacauggcuagcaugguaccaacaaaaaccaggaaaagccccaaaauuacuaauauacaaagcaucaacauuaaaaacaggaguaccaucuagauucucaggaucaggaucaggaacagaauuuacauuaaccauaucaggacuacaauucgacgacuucgcaacauaccacugccaacacuaugcaggcuacucagcaacuuucggacaaggaaccagaguagaaauaaaaagaacaguugcagcaccauccguauucauauucccacccucagacgaacaacuaaaaucaggaacagcaucaguaguaugcuuauuaaauaauuucuacccaagagaagccaaaguacaauggaaaguagauaacgcacuacaaucaggaaacucacaagaaucaguaacagaacaagacucaaaagacucaacauacuccuuauccucaacacuaacacuaucaaaagcagacuacgaaaaacacaaaguauacgcaugcgaaguaacacaccaaggacuaagcuccccaguaacaaaaucauucaacagagga

SEQ ID NO: 46982 - RNA, 672 nt, Artificial Sequence
  derived and/or modified sequence opt6 from anti-HIV_2G12_HeavyChain
gaaguacaacuaguagaaucaggaggaggucuaguaaaagcuggaggcucauuaauacuaaguuguggaguaucaaauuucagaauaucagcacauacaaugaacuggguaagaagaguaccaggaggaggacuagaauggguagcaucaauaaguacaucaucaacauacagagacuaugcagaugcaguaaaaggaagauuuacaguaucaagagaugaccuagaagacuuuguauaucuacaaaugcauaaaaugagaguagaagauacagcaauauauuacugcgcaagaaaaggaucagaccgauuaucagauaaugauccauucgacgcauggggaccaggaacaguaguaacaguaucaccagcaagcacaaaaggaccaaguguauuuccacuagcaccaucaucaaaaaguacaucaggaggaacagcagcauuaggauguuuaguaaaagauuacuuucccgaaccaguaacaguuagcuggaauucaggagcucuaacaagcggaguacauacauuuccagcaguacuacaaaguaguggacuauauucauuaucaaguguaguaacaguaccaaguucaucacuaggaacacaaaccuauauauguaacguaaaccacaaacccucaaauacaaaaguagauaaaaaagucgaaccaaaa

SEQ ID NO: 46983 - RNA, 642 nt, Artificial Sequence
  derived and/or modified sequence opt6 from anti-HIV_4E10_LightChain
gaaauaguacuaacacaaucaccaggcacacaaucauuauccccaggagaaagagcaacacuaagcugcagagcaucacaaucaguaggaaacaacaaauuagcuugguaccaacaaagaccaggacaagcaccaagacuacuaaucuacggagcaucuucaagacccuccggaguagcagacagauucucaggcucaggaucaggaacagacuucacacuaacaauaucaagacuagaaccagaagacuucgcaguauauuacugccaacaauacggacaaucacuauccacauucggacaaggaacaaaaguagaaguaaaaagaacaguagcagcaccaucaguauuuauauucccaccaucagacgaacaacuaaaauccggaaccgcaucaguuguaugcuuacuaaacaacuucuacccaagagaagcaaaaguacaauggaaaguugacaacgcacuacaaucaggaaauucacaagaaucuguaacagaacaagauucaaaagacucaacauacucccuaucaucaacacuaacacuaucaaaagcagacuaugaaaaacacaaaguauacgcaugcgaaguaacacaccaaggacuaucauccccaguaaccaaaucauucaacagaggagaa

SEQ ID NO: 46984 - RNA, 684 nt, Artificial Sequence
  derived and/or modified sequence opt6 from anti-HIV_4E10_HeavyChain
caaguacaauuaguacaaucaggagcagaagucaaaagaccaggaucaucaguaacaguaucauguaaagcaucaggaggaaguuucucaacauaugcauuaucauggguaagacaagcaccaggaagaggauuagaauggaugggaggaguaauaccacuauuaacaauaacaaacuaugccccaagauuucaaggaagaauaacaauaacagcagauagaucaacaucaacagcauaucuagaacuaaauucacuacgaccagaagacacagcaguauauuacugugcaagagaaggaacaacaggauggggaugguuaggaaaaccaauaggagccuuugcccauuggggacaaggaacauuaguaacaguuaguucagcaucaacaaaaggaccaaguguauuuccauuagcaccaagcucaaaaucaacaaguggaggaacagcagcauuaggaugucuaguaaaagauuauuucccagaaccaguaacaguaucauggaacucaggagcucuaacuucaggaguacauacauuuccagcaguuuuacaaaguaguggauuauauucauuaucaucaguaguaacaguaccaucaagcucacuaggaacccaaacauauauauguaacguaaaccauaaaccaucaaauacaaaaguagauaaaaaaguagaaccaaaa

SEQ ID NO: 46985 - RNA, 312 nt, Artificial Sequence
  derived and/or modified sequence opt6 from anti-HIV_VRC01_LightChain
gaaauaguacuaacacaaucaccaggaacauuaagccuaagcccaggagaaacagcaauaauaagcuguagaacaagccaauacggaucauuagcaugguaccaacaaagaccaggacaagcaccaagauuaguaauauauagcggaagcacaagagcagcaggaauaccagacagauucagcggaucgagauggggaccagacuauaacuuaacaauaagcaaucuagaaagcggagacuuuggaguauacuauugccaacaauaugaauuuuucggacaaggaacaaaaguacaaguagauauaaaaaga

SEQ ID NO: 46986 - RNA, 363 nt, Artificial Sequence
  derived and/or modified sequence opt6 from anti-HIV_VRC01_HeavyChain
caaguacaauuaguacaaaguggaggacaaaugaaaaaaccaggagaaaguaugagaauaaguuguagagcaaguggauaugaauuuauagauuguacauuaaauuggauaagauuagcaccaggaaaaagaccagaauggaugggaugguuaaaaccaagaggaggagcaguaaauuaugcaagaccauuacaaggaagaguaacaaugacaagagauguauauagugauacagcauuuuuagaauuaagaaguuuaacaguagaugauacagcaguauauuuuuguacaagaggaaaaaauugugauuauaauugggauuuugaacauuggggaagaggaacaccaguaauaguaaguagu

SEQ ID NO: 46987 - RNA, 330 nt, Artificial Sequence
  derived and/or modified sequence opt6 from anti-HIV_PG9_LightChain
caaagcgcacuaacacaaccagcaagcguaucaggaucaccaggacaaucaauaacaauaucaugcaauggaacaagcaaugacguaggaggauacgaaaguguaagcugguaccaacaacauccaggaaaagcaccaaaagucguaauauaugacguaaguaaaagaccaagcggaguaucaaacagauucucaggaucaaaaucaggaaauacagcaucauuaacaauaagcggacuacaagcagaagacgaaggagauuacuauugcaaaucauuaacaagcacaagaagaagaguauuuggaacaggaacaaaauuaacaguacua

SEQ ID NO: 46988 - RNA, 408 nt, Artificial Sequence
  derived and/or modified sequence opt6 from anti-HIV_PG9_HeavyChain
caaagauuaguagaaaguggaggaggaguaguacaaccaggaaguaguuuaagauuaaguugugcagcaaguggauuugauuuuagcagacaaggaaugcauuggguaagacaagcaccgggacaaggauuagaauggguagcauuuauaaaauaugauggaagugaaaaauaucaugcagauagcguauggggaagauuaaguauaaguagagauaauaguaaagauacauuauauuuacaaaugaauaguuuaagaguagaagauacagcaacauauuuuugugugagagaagcagggggaccagauuauagaaauggauauaauuauuaugauuuuuaugauggauauuauaauuaucauuauauggauguauggggaaaaggaacaacaguaacaguaagcagu

SEQ ID NO: 46989 - RNA, 630 nt, Artificial Sequence
  derived and/or modified sequence opt6 from anti-HIV_VRC07_LightChain
gaaaucguacuaacacaaucaccaggaacccuaucauuaagcccaggagaaacagcaauaauaucaugcagaacaucacaauacggaagccuagcaugguaccaacaaagaccaggacaagcaccaagauuaguaauauacucaggaucaacacgagcagcaggaauaccagauagauucucaggaucaagauggggaccagacuacacacuaaccauaucaaaccuagaaucaggagacuucggaguauacuauugccaacaauacgaauuuuucggacaaggaaccaaaguacaaguagacauaaaaagaacagucgcagcaccaagcguauucauauucccaccaucagacgaacaacuaaaaucaggaacagccucaguaguaugccuacuaaacaacuucuacccaagagaagcaaaaguccaauggaaaguagacaacgcacuacaaagcggaaacucacaagaaucaguaacagaacaagacucaaaagacucaacauacagucuaucaucaacacuaacauuaucaaaagcagacuacgaaaaacacaaaguauacgcaugcgaaguaacacaccaaggacuaagaucacccguaacaaaaucauucaacagaggagaaugc

SEQ ID NO: 46990 - RNA, 375 nt, Artificial Sequence
  derived and/or modified sequence opt6 from anti-HIV_VRC07_HeavyChain
caaguacaauuaguacaaucaggaggacaaaugaaaaaaccaggagaaucaaugagaauaucauguagagcaucaggauaugaauuuauagauugcacauuaaauuggauaagauuagcaccaggaaaaagaccagaauggaugggaugguuaaaaccaagaggaggagcaguaaauuaugcaagaccacuacaaggaagaguaacaaugacaagagauguauauagugauacagcauuuuuagaauuaagaucauuaacaagugaugacacagcaguauauuuuuguacaagaggaaaauauuguacagcaagagacuauuauaauugggauuuugaacacuggggacaaggaacaccaguaauaguaaguagu

SEQ ID NO: 46991 - RNA, 315 nt, Artificial Sequence
  derived and/or modified sequence opt6 from anti-HIV_3BNC117_LightChain
gacauacaaaugacacaaucaccaucaucacuaucagcaucaguaggagacacaguaacaauaacaugccaagcaaacggauaccuaaacugguaccaacaaagaagaggaaaagcaccaaaacuacuaauauacgacggaucaaaacuagaaagaggaguaccaucaagauucucaggaagaagauggggacaagaauacaaccuaacaauaaacaaccuacaaccagaagacauagcaacauacuucugccaaguauacgaauucguaguaccaggaacaagacuagaccuaaaaagaacaguagcagcacca

SEQ ID NO: 46992 - RNA, 387 nt, Artificial Sequence
  derived and/or modified sequence opt6 from anti-HIV_3BNC117_HeavyChain
caaguacaauuauuacaaagcggagcagcaguaacaaaaccaggagcaaguguaagaguaaguugugaagcaaguggauauaauauaagagauuauuuuauacauugguggagacaagcaccaggacaaggauuacaauggguaggauggauaaauccaaaaacaggacaaccaaauaauccaagacaauuucaaggaagaguaaguuuaacaagacaugcaagcugggauuuugauacauuuucauuuuauauggauuuaaaagcacuaagaucagaugauacagcaguauauuuuugugcaagacaaagaagugauuauugggauuuugauguauggggaaguggaacacaaguaacaguaucaagugcaaguacaaaaggacca

SEQ ID NO: 46993 - RNA, 324 nt, Artificial Sequence
  derived and/or modified sequence opt6 from anti-HIV_10-1074_LightChain
aguuauguaagaccauuaaguguagcauuaggagaaacagcaagaauaaguuguggaagacaagcauuaggaaguagagcaguacaaugguaucaacauagaccaggacaagcaccaauauuauuaauauauaauaaucaagauagaccaaguggaauaccagaaagauuuucaggaacaccagauauaaauuuuggaacaagagcaacauuaacaauaucaggaguagaagcaggagaugaagcagauuauuauugucauaugugggauaguagaaguggauuuucauggaguuuuggaggagcaacaagauuaacaguauua

SEQ ID NO: 46994 - RNA, 396 nt, Artificial Sequence
  derived and/or modified sequence opt6 from anti-HIV_10-1074_HeavyChain
caaguacaauuacaagaaagcggaccaggauuaguaaaaccaagcgaaacauuaagcguaacauguagcguaagcggagacucaaugaauaacuauuacuggacauggauaagacaaucaccaggaaaaggacuagaauggauaggauauauaucagacagagaaucagcaacauacaauccaucacuaaauagcagaguaguaauaucaagagauacaagcaaaaaucaauuaagccuaaaauuaaacucagucacaccagcagacacagcaguauacuauugcgcaacagcaagaagaggacaaagaauauacggaguaguaucauuuggagaauuuuucuacuauuacucaauggauguauggggaaaaggaacaacaguaacaguaagcuca

SEQ ID NO: 46995 - RNA, 633 nt, Artificial Sequence
  derived and/or modified sequence opt6 from anti-HIV_PGT121_LightChain
agugacauaucaguagcaccaggagaaacagcaagaauaucauguggagaaaaaagccuaggcucaagagcaguacaaugguaccaacacagagcaggacaagcaccaagccuaauaauauacaauaaccaagacagaccaucaggaauaccagaaagauucucaggaucaccagacucaccauucggaacuacagcaacacuaaccauaacauccguagaagcaggagacgaagcagacuacuacugccauauaugggauucaagaguaccaacaaaauggguauucggaggcggaacaacacuaacaguacuaggacaacccaaagcagcuccaagcguaaccuuauucccaccaucaucagaagaacuacaagcaaacaaagcaacacuaguaugcuuaauaucagacuucuacccaggagcaguaacaguagcauggaaagcagacucaucaccaguaaaagcaggaguagaaacaacaacaccaucaaaacaaucaaacaacaaauacgcagcaucaucauaccuaucacuaacaccagaacaauggaaaucacacaaaucauacucaugccaaguaacacaugaaggaucaacaguagaaaaaacaguagcaccaacagaauguuca

SEQ ID NO: 46996 - RNA, 705 nt, Artificial Sequence
  derived and/or modified sequence opt6 from anti-HIV_PGT121_HeavyChain
caaaugcaacuacaagaaucaggacccggauuaguaaaaccaucagaaacacuaucacuaacaugcucaguaucaggagcauccauaucagacucauacuggucauggauaagaagaucaccaggaaaaggauuagaauggauagguuacguacacaaaucaggagacacaaacuacucacccucauuaaaaucaagaguaaaucuaucacuagacaccuccaaaaaccaaguaucacuaucucuaguagcagccacagcagcagacucaggaaaauacuauugcgcaagaacacuccacggcagaagaauauacggaauaguagcauucaaugaaugguucacauacuucuacauggacguaugggguaacggaacacaaguaacaguaucaucagcaucaacaaaaggaccaucaguauucccacuagccccaucuucaaaaucaacauccggcggaacagcagcccuaggaugccuaguaaaagacuacuucccagaaccaguaacaguaucauggaacucaggagcauuaacaucaggaguacacacauuuccagcaguacuacaaucaucaggauuauacucacuaucauccguaguaacaguaccuucaucaucauuaggaacacaaacauacauaugcaacguaaaccacaaaccaagcaauacaaaaguagacaaaagaguagaaccaaaaucaugc

SEQ ID NO: 46997 - RNA, 657 nt, Artificial Sequence
  derived and/or modified sequence opt6 from anti-HIV_PGDM1400_LightChain
gacuucguacucacacaaucaccacacucauuaucaguaacaccaggagaaucagcaucaauaucaugcaaauccucccacucccuuauacacggagacagaaauaacuaccuagcaugguacguacaaaaaccaggcagaucaccacaauuauuaauauaccuagcaucaucaagagcaucaggaguacccgacagauucucaggaucaggaucagacaaagacuucacauuaaaaauaucaagaguagaaaccgaagacguaggaacauacuacugcaugcaaggcagagaaucaccauggacauucggacaaggaacaaaaguagacauaaaaagaacaguagcagcaccauccguauucauauucccaccaucagacgaacaauuaaaaucaggcaccgcaucagucguaugccuauuaaacaacuucuacccaagagaagcaaaaguacaauggaaaguagacaacgcauuacaaucaggaaacucacaagaauccguaaccgaacaagacucaaaagacucaacauacucacuaucaucaaccuuaacacuaucaaaagcagacuacgaaaaacacaaaguauacgcaugcgaaguaacacaccaaggacucucaucaccaguaacaaaaucauucaacagaggcgaaugc

SEQ ID NO: 46998 - RNA, 735 nt, Artificial Sequence
  derived and/or modified sequence opt6 from anti-HIV_PGDM1400_HeavyChain
caagcacaacucguacaaucaggaccagaaguaagaaaaccaggaacaucaguaaaaguaucauguaaagcaccaggaaacacacuaaaaacauaugauuuacauuggguaagaucaguaccgggccaaggacuacaauggaugggauggauaucacacgaaggagauaaaaaaguaauaguagaaagauuuaaagcaaaaguaacaauagacugggacagaucaacaaacacagcauauuuacaacuaucaggauuaacaucaggagacacagcuguauauuacugugcaaaaggaaguaaacauagauuaagagacuacgcacuauaugacgaugacggagcauuaaacugggcaguagacguagacuacuuaucaaacuuagaauuuuggggacaaggaacagcaguaacaguaucaucagcaucaacaaaaggaccaucaguauuuccauuagcaccaucaagcaaaucaacaucaggagguacagcugcauuaggauguuuaguaaaagauuacuuucccgaaccaguaacaguuucauggaacucaggagcauuaacauccggaguacauacauuuccagcaguauuacaaucaagcggcuuauauucauuaucaucaguaguuacaguaccaagcucaucacuaggaacacaaacauauauauguaacguaaaccauaaaccaucaaauacaaaagucgacaaaaaaguagaaccaaaaagcugugau

SEQ ID NO: 46999 - RNA, 630 nt, Artificial Sequence
  derived and/or modified sequence opt6 from anti-HIV_N6_LightChain
uacauacacgucacacaaucaccaucaucacuuuccguaucaauaggagauagaguaacaauuaacugccaaacaucacaaggaguaggcucagaucuacauugguaccaacauaaaccaggcagagcaccaaaacuacuaauacaccacacaucaucaguagaagauggaguaccaucaagauucucaggaucaggauuccacacaucauucaaccuaacaauaucagacuuacaagcagacgacauagcaacauacuauugccaaguauuacaauucuucggaagaggauccagacuacacauaaaaagaacaguagcagcaccaucaguauuuauauucccaccuucagacgaacaacuaaaaucaggaacagcaucaguaguaugcuuauuaaacaacuucuacccaagagaagcaaaaguacaauggaaaguagacaacgcacuacaaucaggaaacucacaagaaucaguaacagaacaagacucaaaagacucaacauauucccuauccucaacauuaacacuaucaaaagcagacuacgaaaaacacaaaguauacgcaugcgaagucacacaucaaggacuaucaucaccaguaacaaaaucauucaaccgaggagaaugc

SEQ ID NO: 47000 - RNA, 675 nt, Artificial Sequence
  derived and/or modified sequence opt6 from anti-HIV_N6_HeavyChain
agagcacaucuaguacaaagcggaacagcaaugaaaaaaccaggagcaaguguaagaguaucaugucaaacgagcggauauacauuuacagcacauauauuauuuugguuuagacaagcaccaggaagaggauuagaauggguaggauggauaaaaccacaauauggagcaguaaauuuuggaggaggauuuagagauagaguaacauuaacaagagauguguauagagaaauagcauauauggauauaagaggauuaaaaccagaugauacagcaguauauuauugugcaagagaucgaaguuauggagauaguucaugggcauuagacgcauggggucaaggaacaacagugguaguuagugcagcaucaacaaaaggaccaagcguauuuccacuagcaccaaguaguaaaaguacaaguggaggaacagcugcauuaggauguuuaguaaaagauuauuuuccagaaccaguaacaguaucauggaauaguggagcauuaacaucaggaguacacacauuuccagcaguacuacaaaguagcggauuauauucauuaucaagcguaguaacaguaccaucaucaagcuuaggaacacaaacauacauauguaauguaaaccauaaaccaucaaacacaaaaguagauaaaaaaguagaaccgaaaaguugu

SEQ ID NO: 47001 - RNA, 1080 nt, Artificial Sequence
  derived and/or modified sequence opt6 from anti-HIV_N6_GChain
gcuugggaagaugcagacacaacacuauucugcgcaagcgacgcaaaagcauacucaacagaaaaacacaacguaugggcaacccacgcaugcguacccacagaccccgacccacaagaaauaccuuuagaaaacguaaccgaaaacuucaacauguggaaaaauaacaugguagaacaaaugcacgaagacauaauuucauuaugggacgaaucauuaaaacccugcguaaugcuaacgggaggaucaaccauaaaacaagcaugcccaaaagugacauucgaaccaauaccaauacacuacugcgccccagcaggauucgcaauauuaaaaugccgagacgaagacuucaacggaacaggaccauguaaaaacgucagcacaguacaauguacacacggaauaaaaccaguaguaucaacacaauuacuacuaaacggaucauuagcaaaaggagacauaguaauaagaucagaaaacuuaacaaacaacgcaaaaguaauaaucguccaauuaaacgaaccaguacaaauuguaugcauaagaccaaauaauggaggaucaggaucaggaggagacauaagacaagcacauugcaacguaacgagaggaaaauggguaaacauaaccaaaaacguaaaagaacaacucuggaaaauauucaacaaaacaacaaacauaacauucaauaacaccauauucaacucaccagccgguggagacuuagaaauaacaacacacucauucaauugcggaggagaauuuuucuacugcaacacaagugacuuauucaacgaaacaaaccuaucagcaaaucacacagacacaaacgaaaacauaacauuacaaugcagaauaaaacaaauaguaagaauguggcaaagaguaggacaagcaauguacgcaccaccaaucgccggaaacauaacaugcauaucaaacauaaccgguuuauuauuaacaagagacggaguaaaugauacccacgauaaagaaaaugaaacauuccgacccacaggaggagacaugagagacaacuggaggucagaauuauauaaauacaaaguaaucaaacuaaaa

SEQ ID NO: 47002 - RNA, 645 nt, Artificial Sequence
  derived and/or modified sequence opt6 from anti-HIV_10E8_LightChain
ucauacgaacuaacccaagaaacaggaguaagcguagcacuaggacgaacaguaacaauaacaugcagaggagauucauuaagaucccacuacgcaucaugguaucaaaaaaaaccaggacaagcaccaauacuacuauucuauggaaaaaacaauagaccaucagguguaccagacagauucucaggaucagcaucaggaaacagagcaucauuaacaauaucaggagcacaagcagaagaugacgcagaauacuacugcucaucaagagacaaaucaggaucaagacuaucaguauucggaggaggaacaaaauuaacaguacuaucacaaccaaaagcagcaccaucaguaacacuauucccaccaucaucagaagaacuacaagcaaauaaagcaacauuaguaugccuaauaucagacuucuauccaggagcuguaacaguagcauggaaagcagacucaucaccaguaaaagcaggaguagaaacaacaacaccaucaaaacaaucaaacaacaaauacgcagcaucaucauaucuaagccuaacaccagaacaauggaaaucacacagaucauacaguugccaaguaacccacgaaggaucaacaguagaaaaaacaguagcaccaacagaaugcagc

SEQ ID NO: 47003 - RNA, 708 nt, Artificial Sequence
  derived and/or modified sequence opt6 from anti-HIV_10E8_HeavyChain
gaaguacaauuaguagaaucaggaggaggucuaguaaaaccaggaggaucauuaagauuaaguuguucagcaucaggauuugauuuugauaacgcauggaugacauggguaagacaaccaccaggaaaaggauuagaauggguaggaagaauaacaggaccaggagaaggauggucaguagauuaugcagcaccaguagaaggaagauuuacaauaucaagauuaaauucaauaaacuuuuuauauuuagaaaugaauaauuuaagaauggaagacaguggauuauauuuuugugcaagaacaggaaaauauuacgauuucuggagcggauauccaccaggagaagaauacuuucaagauugggguagaggaacauuagugacaguaaguucagcaagcacaaaaggaccaucaguauuuccauuagcaccuucaucaaaaaguacaaguggaggaacagcagcauuaggguguuuaguaaaagauuacuuuccagaaccaguuacaguaucauggaauagcggagcacuaacuucaggaguacauacauuuccagcuguauuacaaaguagcggauuauauagucuuagcaguguuguaacaguaccaaguucaucauuaggaacacaaacauauauauguaauguaaaucauaaaccaucaaacacaaaaguagauaaaagaguagaaccaaaaagcugugauaaa

SEQ ID NO: 47004 - RNA, 333 nt, Artificial Sequence
  derived and/or modified sequence opt6 from anti-HIV_12A12_LightChain
gacauacaaaugacacaaucaccaucaucauuaucagcaucaguaggagacagaguaacaauaacaugucaagcaggacaaggaauaggaucaucauuacaaugguaccaacaaaaaccaggaaaagcaccaaaacuauuaguacacggagcaucaaaucuacacagaggaguaccaucaagauucucaggaucaggauuucacacaacauuuucauuaacaauaucaggacuacaaagagacgacuucgcaacauacuuuugcgcaguauuagaauuuuucggaccaggaacaaaaguagaaauaaaaagaacaguagcagcaccaucagua

SEQ ID NO: 47005 - RNA, 381 nt, Artificial Sequence
  derived and/or modified sequence opt6 from anti-HIV_12A12_HeavyChain
agucaacauuuaguacaaaguggaacacaaguaaaaaaaccaggagcaaguguaagaauaaguugucaagcaagcggauauaguuuuacagauuauguauuacauugguggagacaagcaccaggacaaggauuagaauggaugggauggauaaaaccaguauauggagcaagaaauuaugcaagaagauuucaaggaagaauaaauuuugauagagauauauauagagaaauagcauuuauggauuuaaguggauuaagaagugaugauacagcauuauauuuuugugcaagagauggaaguggagaugauacaaguuggcauuuagauccauggggacaaggaacauuaguaauaguaagugcagcaaguacaaaagga

SEQ ID NO: 47006 - RNA, 315 nt, Artificial Sequence
  derived and/or modified sequence opt6 from anti-HIV_12A21_LightChain
gauauacaaaugacacaaucaccaucaagcuuaagcgcaaguguaggagauagaguaacaauaaacugucaagcaggacaaggaauaggaucaagcuuaaacugguaccaaaaaaaaccaggaagagcaccaaaacuauuaguacauggagcaagcaaucuacaaagaggaguaccaagcagauucucaggaucaggauuucacacaacauuuacauuaacaauaagcucacuacaaccagaugacguagcaacauacuuuugcgcaguauuucaaugguucggaccaggaacaaaaguagauauaaaaagaaca

SEQ ID NO: 47007 - RNA, 384 nt, Artificial Sequence
  derived and/or modified sequence opt6 from anti-HIV_12A21_HeavyChain
agucaacauuuaguacaaaguggaacacaaguaaaaaaaccaggagcaaguguaagaguaaguugucaagcaaguggauauacauuuacaaauuauauauuacauugguggagacaagcaccaggacaaggauuagaauggaugggauuaauaaaaccaguauucggagcaguaaauuaugcaagacaauuucaaggaagaauacaauuaacaagagauauauauagagaaauagcauuuuuagauuuaucaggauuaagaucagaugauacagcaguauauuauugugcaagagacgaaagcggagaugauuuaaaauggcauuuacauccauggggacaaggaacacaaguaauaguaaguccagcaucaacaaaaggacca

SEQ ID NO: 47008 - RNA, 648 nt, Artificial Sequence
  derived and/or modified sequence opt6 from anti-HIV_35022_LightChain
caaucaguauuaacacaaucagcaucaguaucaggaucacuaggacaaucaguaacaauaucaugcacaggaccaaacucaguauguugcucacacaaaagcauaucaugguaccaauggccaccaggaagagcaccaacauuaauaauauacgaagacaacgaaagagcaccaggaauaucaccaagauucuccggauauaaaucauacuggucagcauacuuaacaauauccgaccuacgaccagaagaugaaacaacauacuauuguugcucauacacccacaacucaggaugcguauucggaacaggaaccaaaguaagcguacuaggacaaucaaaagcaaacccaucaguaacacuauuccccccaucaucagaagaacuacaagcaaacaaagcaacauuaguaugccuaauaucagacuucuacccaggagcaguuacagucgcauggaaagcagacucaucaccaguaaaagccggaguagaaacaacaacaccaucaaaacaaucaaacaacaaauacgccgcaucaucauacuuaucacuaacaccagaacaauggaaaucacauagaagcuacuccugccaaguaacacacgaaggaucaacaguagaaaaaacaguagcaccaacagaaugcuca

SEQ ID NO: 47009 - RNA, 729 nt, Artificial Sequence
  derived and/or modified sequence opt6 from anti-HIV_35022_HeavyChain
gaaggacaacuaguacaaucaggagcagaacuaaaaaaaccaggagcaucaguaaaaauaucaugcaaaacaagcggauacagauucaacuucuaccacauaaacuggauaagacaaacagcaggaagaggaccagaauggaugggauggauaucaccauauaguggagacaaaaaccuugcaccagcauuucaagauagagucauaaugacaacagacacugaaguaccaguaacaucauucacaucaacaggagccgcauacauggaaauaagaaaccuaaaauucgacgacacaggaacauauuucugugcaaaaggcuuauuaagagauggaucaucaaccuggcuacccuaccuauggggacaaggaacacuacuaacaguaagcucagcaucaacaaaaggaccaucaguauucccacuagcaccaucaucaaaaucaaccucaggaggaacagcagcauuaggaugccuaguaaaagacuacuuccccgaaccaguaacaguaagcuggaacucaggagcacuaaccucaggaguacacacauucccagcaguacuacaaucaucaggucuauacucacuaucaucaguuguaacaguaccaucaagcucauuaggaacacaaacauauauaugcaacguaaaucauaaaccaucaaacacuaaaguagacaaaagaguagaaccaaaaucaugcgacaaaggauuagaaguacuauuccaa

SEQ ID NO: 47010 - RNA, 648 nt, Artificial Sequence
  derived and/or modified sequence opt6 from anti-HIV_3BC176_LightChain
caaucaguauuaacacaaccagcaucugucucagcaucaccuggccaaucaauaacagucucaugcacaggaucaagaaacgacguaggcggauacgacuucguaagcugguaccaaagacaucccggaggaguaccaaaauuaauaaucuaugaaauaagcaaaagaccaagcggaauaccacaaagauucucaggaucaagaucaggcaauaccgcaucauuaacaauaagcggauuacaagaugaugacgaagccgacuacuauugcugcucauacgcaucuuacgacagacuaauauuuggaggaggcacaagaguaucaguccuaagacaaccaaaagcagcaccaagcguaacauuauucccacccucaucagaagaacuacaagcaaacaaagcaacucuaguaugccuaauaucagacuucuacccaggagcaguaacaguagcauggaaagcagacggaucaccaguaaaagcaggcguagaaacaacaaaaccaucaaaacaaucaaauaacaaauacgcagcaucaagcuaucuuucauuaacaccagaacaauggaaaucacacagaucauacucaugucaaguaacacacgaaggaagcacaguagaaaaaacaguagcaccaacagaaugcuca

SEQ ID NO: 47011 - RNA, 699 nt, Artificial Sequence
  derived and/or modified sequence opt6 from anti-HIV_3BC176_HeavyChain
gaacaaguacaauuaaugcaaucaggagcacaauuaagagauccuggagacucacuaaaaauaucaugcaaagcaagcggauauaauuuuauagauuaccauauacauugggucagauuagcaccuggaagaggauuagaauggaugggauggauagacccagucggaggaauaacaaaauacgcaggacaauuccaaggaagauuaaguuuaacaagagauacaucaacaaauacauuauuuuuagaauuaucaagacuaacagcaggagacacagcaguauauuuuugugcaagaaguaugagaccaguagaccauggaauagacuauucaggacuauuuguauuucacuuuuggggacgagguucagauguauuaguaucuucagcaucaacaaaaggacccucaguauuuccacuagcaccaucaagcaaaucaacaucaggaggaacagcagcauuaggauguuuaguaaaagauuauuuuccagaaccaguaacuguuaguuggaacucaggagcacuaacaagcggaguacauacauuuccagcaguauuacaaucaaguggauuauauucauuaagcucaguaguaacaguaccaaguucaucauuaggaacacaaacauauauauguaauguaaaccauaaaccaucaaauacaaaaguagacaaaaaaguagaaccaaaaucaugugac

SEQ ID NO: 47012 - RNA, 621 nt, Artificial Sequence
  derived and/or modified sequence opt6 from anti-HIV_3BNC55_LightChain
gacauacaaaugacacaauccccaucaucauuauccgcaucagucggagacaaaguaacaauaacaugccaaacaucagcaggauaccuuaacugguaccaacaaagaagaggaagagccccaaaacuacuaauguacgacggaucaagacuaguaacaggaguaccaucaagauucucaggaagaagauggggaacacaauacaaucuaacaauaggaucauuacaaccagaagacauagcaacauauuacugucaaguauacgaauucuucggaccaggaacaagacuagaccuaaaaagaacaguagcagcaccaagcguauucauauucccaccaucagacgaacaacuaaaauccggaacagcaucaguaguaugcuuacuaaacaacuucuacccaagagaagcaaaaguacaauggaaaguagacaacgcacuacaaucaggaaacucacaagaaucaguaacagaacaagauucaaaagauucaacauauucacuaucaucaacacuaaccuuauccaaagcagacuacgaaaaacacaaaguauacgcaugcgaaguaacacaccaaggacucucaucaccaguaacaaaaagcuucaacagaggagaaugc

SEQ ID NO: 47013 - RNA, 675 nt, Artificial Sequence
  derived and/or modified sequence opt6 from anti-HIV_3BNC55_HeavyChain
caaguacaauuaguacaaucaggaacagcaguaaaaagaccaggagcaucaguaagaguaucaugucaagcaucaggauacacauucacugacuauuucauauacugguggagacaagcuccaggacaaggacuagaauggcuaggcuggauaaacccauuaacaagucaaccaaguuauccaucaagauuucaagguagauuaacauuaacaagagacacauucgaugaaaugcuauauauggaucuaagaggauuaagauccgacgauacaggaauauauuucugugcaagaagacacagcgauuacugugacuuugacauaugggguucaggaacacaaauaauagucucaucagcaucaacaaaaggaccaucaguauuuccauuagcaccuucaucaaaaucaacaucaggaggaacagcagcauuaggaugucuaguaaaagacuacuuuccagaaccaguaacaguaucauggaacucaggagcacuaacaagcggaguacauacauuuccagcaguauuacaaucaucaggacuauauucauuaucaucagucguaacaguaccaucaucaucauuaggaacacaaacauauauauguaacguaaaccauaaaccaucaaauacaaaaguagauaaacgaguagaaccaaaaucaugugacaaaaca

SEQ ID NO: 47014 - RNA, 618 nt, Artificial Sequence
  derived and/or modified sequence opt6 from anti-HIV_3BNC60_LightChain
gacauacaaaugacacaaucaccaucaagccuaucagcaagaguaggagacacaguaacaauaacaugccaagcaaacggauaccuaaacugguaccaacaaagaagaggaaaagcaccaaaacuacuaauauacgacggaucaaaacuagaaagaggcguaccagcaagauucucaggaagaagauggggccaagaauacaacuuaacaauaaacaaccuacaaccagaagacguagcaacauacuucugccaaguauacgaauucauaguaccaggaacaagacuagacuuaaaaagaacaguagcagcaccaucagucuucauauucccaccaucagacgaacaacuaaaaucaggcacagcaucaguuguaugccuacuaaacaacuucuacccaagagaagcuaaaguacaauggaaaguagacaaugcauuacaauccggaaacucacaagaaucaguaacagaacaagauucaaaagacucaaccuacucacuaucaucaacacuaacacuaucaaaagcagacuacgaaaaacacaaaguauacgcaugcgaaguaacacaccaaggacuaucaucaccaguaacaaaaucauucaauagaggcgaaugu

SEQ ID NO: 47015 - RNA, 687 nt, Artificial Sequence
  derived and/or modified sequence opt6 from anti-HIV_3BNC60_HeavyChain
caaguacaucuaucacaaucaggagcagcaguaacaaaaccaggagcaucaguaagaguaucaugugaagcaucaggauacaaaauaagugaccacuucauacauugguggagacaagccccaggucaaggauuacaauggguaggauggauaaacccaaaaacaggacaaccaaacaacccucgccaauuccaaggaagaguaucacuaacaagacaagcaucaugggacuucgacacauacucauucuauauggauuuaaaagcaguaagaucagacgacacagcaauauacuuuugcgcaagacaaagaucagacuuuugggacuucgacguauggggcucaggaacacaaguaacaguaucaucagcaucuacaaaaggaccaucaguauucccauuagcaccauccaguaaaucaacaagcggaggaacagcagcccuaggcugcuuaguaaaagacuauuuucccgaaccaguaacaguaucauggaacagcggagcacuaacaucaggaguacacacauuuccagcaguauuacaaucaucaggacuauacucacuaucaucaguaguaacaguaccaagcucaucacuaggaacacaaacauacauaugcaauguaaaucacaaaccaucaaacaccaaaguagacaaacgaguagaaccaaaaucaugugacaaaaca

SEQ ID NO: 47016 - RNA, 687 nt, Artificial Sequence
  derived and/or modified sequence opt6 from anti-HIV_3BNC60_HeavyChain
gaaguacaucuaagucaaucaggugcagcaguaacaaaaccaggagcaucaguaagaguaucaugugaagcaucagguuacaaaauaucagaccauuucauacacugguggagacaagcaccaggacaaggacuacaauggguaggauggauaaauccaaaaacaggacaaccaaacaaugcaagacaauuucaaggaagaguaucacuaacaagacaagcaucaugggacuuugacacauauagcuucuauauggauuuaaaagcaguaagaucagacgacacagcaauauauuucugugcaagacaaagaagugauuucugggauuuugacguauggggaucagguacccaagucacaguaagcucagcaucaacaaaaggaccaucaguauuuccacuagcaccaucaaguaaaaguacaucagguggaacagcagcauuaggaugucuaguaaaagauuacuuuccagaaccaguaacaguaucauggaacucaggcgcauuaacaucaggaguacauacauucccagcaguacuacaaagcaguggacuauauagccuaucaaguguaguaacagucccaaguucaucacuaggaacacaaacauauauauguaauguuaaccauaaaccaucaaauacaaaaguagacaaaagaguagaaccaaaaucuugugacaaaaca

SEQ ID NO: 47017 - RNA, 648 nt, Artificial Sequence
  derived and/or modified sequence opt6 from anti-HIV_447-52D_LightChain
caaucaguacuaacacaaccaccaucaguaucagccgcacccggacaaaaaguaacuauaucaugcucaggauccucaucaaacauaggcaacaacuacguacuaugguaccaacaauucccaggaaccgcaccaaaacuauuaauauacggaaacaacaaaagaccaucaggaauaccagacagauucucaggaucaaaaucaggaacaucagcaacacuaggaauaacaggauuacaaacaggagacgaagcagacuacuucugcgcaacaugggacucaggacucucagcagacuggguauuuggaggaggaacaaaacuaacaguacuaucacaaccaaaagcagcaccaucaguaacacuauucccaccaucuucagaagaacuacaagcuaacaaagcaacauuaguaugccuaauaucagacuucuauccaggagcaguaacaguagcauggaaagcagacuccucaccaguaaaagcaggaguagaaaccacaacaccaucaaaacaauccaacaacaaauacgcagcaucaucauaucuaucacucacaccugaacaauggaaaucacacagaucauacagcugccaaguaacccacgaaggauccacaguagaaaaaacaguagcaccaacagaaugc

SEQ ID NO: 47018 - RNA, 693 nt, Artificial Sequence
  derived and/or modified sequence opt6 from anti-HIV_447-52D_HeavyChain
gaaguacaauuaguagaaucaggaggagguuuaguaaaaccaggaggaucacuacgauuaacauguguagcaucaggauucacauuuagcgauguaugguuaaauuggguaagacaagcaccaggaaaaggauuagaauggguaggaagaauaaaaucaagaacagauggaggaacaacagauuaugcagcaagcguaaaaggaagauuuacaauaucaagagaugauaguaaaaauacauuauauuuacaaaugaauagucuaaaaacagaagauacagcaguauacucauguacgacagauggauuuauaaugauaagaggaguaucagaagauuauuauuauuauuauauggauguauggggaaaaggaacaacaguaacaguaagcucagcaaguacaaaaggaccaaguguauuuccauuagcaccauguaguagaagcacaaguggaggaacagcagcauuaggauguuuaguaaaagauuacuuuccagaaccuguaacggugucauggaauagcggagcauuaacuucaggaguacauacauuuccagcaguauuacaaagcucaggauuauauaguuuaucaaguguaguaacaguaccaaguucaucauuaggaacacaaacauauacauguaauguaaaucauaaaccaucaaauacaaaaguagauaaaagaguagaauua

SEQ ID NO: 47019 - RNA, 645 nt, Artificial Sequence
  derived and/or modified sequence opt6 from anti-HIV_447-52D_LightChain
caauccguacuaacacaaccaccauccguaucagcagcaccaggacaaaaaguaacaauauccugcucaggaucaucaucaaauauaggaaacaacuauguucuaugguaccaacaauucccaggaacagcaccaaaacuauuaauauauggaaacaacaaaagaccauccggaauaccugacagauucucaggaucaaaaucaggaacaucagcaacacucggaauaacaggacuacaaacaggcgacgaagcugacuacuucugcgcaacaugggacucaggauuaucagcagacuggguauucggaggaggaacaaaacuaaccguucuaucacaaccaaaagccgccccaucaguaacacuauucccacccucaucagaagaacuacaagcaaacaaagcaacauuaguauguuuaauaucagacuucuacccaggagcaguaacagucgcauggaaagcagacucaucaccaguaaaagcaggaguagaaacaacaacaccaucaaaacaauccaacaacaaauacgcagcaucaucauaccuaucauuaacaccagaacaauggaaaucacacagaucauacucuugccaaguaacacacgaaggaucaacaguagaaaaaacaguagcaccaacagaa

SEQ ID NO: 47020 - RNA, 705 nt, Artificial Sequence
  derived and/or modified sequence opt6 from anti-HIV_447-52D_HeavyChain
gaaguacaauuaguagaaucaggaggagggcuaguaaaaccaggaggaucauuacgacuaacauguguagcaucaggauucacauucagugacguaugguuaaacuggguaagacaagcaccaggaaaaggacucgaauggguaggaagaauaaaauccagaacagauggaggcacaacugacuaugcagcaucaguaaaaggaagauuuacaauaucaagagacgauagcaaaaacacacucuaucuacaaaugaauagccuaaaaacugaagauacagcaguauauucauguacaacagacggauucauaaugauaagaggcguaucagaagacuacuauuacuauuacauggacguauggggaaaaggaacaacaguaacaguaucaucagcaucaacuaaagguccaucaguauuuccauuagcaccauguucaagaucaacaucaggaggaacagcagcacuaggaugucuaguaaaagacuauuuuccagaaccaguaacaguuucauggaacucaggagcauuaacaucaggaguacauacauuuccagcaguauuacaaucuucaggauuauauucacuaucaucaguaguaacaguaccaaguucaucuuuaggaacacaaacauauacauguaacguuaaccauaaaccaucaaacacaaaaguagauaaaagaguagaacuaaaaacaccuaca

SEQ ID NO: 47021 - RNA, 624 nt, Artificial Sequence
  derived and/or modified sequence opt6 from anti-HIV_5H/I1-BMV-D5_LightChain
gacauccaaaugacacaaucaccaucaacacuaucagcaucaauaggagacagaguaacaauaaccugcagagcaucagaaggaauauaccacuggcuagcaugguaccaacaaaaaccaggaaaagcaccaaaacuccuaaucuacaaagcaucaucacuagcaucaggagcaccaucaagauucucaggaucaggaucaggaacagacuucacacuaacaauauccucacuccaaccagacgacuucgcaaccuacuacugccaacaauacucaaacuacccacuaaccuucggaggaggaacaaaacucgaaauaaaaagaacaguagcagcaccaucaguauucauauucccaccaucagacgaacaacuaaaaucaggaacagcaucaguaguaugccuacuaaacaacuucuacccacgagaagcaaaaguacaauggaaaguagacaacgcacuacaaucaggaaacucccaagaaucaguaacagaacaagacucaaaagacucaacauacucacuauccucaacacuaacacuaucaaaagcagacuacgaaaaacauaaaguauacgcaugcgaaguaacacaccaaggacuaucaucaccuguaacaaaauca

SEQ ID NO: 47022 - RNA, 651 nt, Artificial Sequence
  derived and/or modified sequence opt6 from anti-HIV_5H/I1-BMV-D5_HeavyChain
caaguacaauuaguacaaucaggagcagaaguaagaaaaccaggagcuucaguaaaaguaucauguaaagcaucaggagacacauuuaguagcuacgcaauaucauggguaagacaagcaccaggacaaggacuagaauggaugggaggaauaauaccaauauucggaacagcuaacuaugcacaagcauuucaagguagaguaacaauaacagcaaacgaaucaacaucaacagcauauauggagcuaucaucacucagaucagaagauacagcaauauauuacugugcaagagacaauccaacacuauuaggaucagauuauuggggagcaggaacccuaguaacaguaucaucagcaagcacaaaaggaccaucaguauucccacuagcaccaugcucaagaaguacaagcggaggaacagcagcacuaggauguuuaguaaaagauuacuuuccagaaccaguaacaguaucauggaacucaggagcacuaacaucaggaguacauacauuuccagcaguauuacaaucaucaggacuauauucacuaucaaguguaguaacaguaccaagcucaucacuaggaacacaaacauauaucugcaauguaaaccauaaaccaucaaauacaaaaguagauaaaagagua

SEQ ID NO: 47023 - RNA, 657 nt, Artificial Sequence
  derived and/or modified sequence opt6 from anti-HIV_5H/I1-BMV-D5_A-Chain
augcaacuacuaagcggaauaguacaacaacaaaacaaccuccuaagagcaauagaagcacaacaacaccuacuacaacuaacaguauggggaauaaaacaacuacaagcaagaauacuagcaggaggaagcggaggacacacaacauggauggaaugggacagagaaauaaacaauuacacaagccuaauacacagucuaauagaagaaucacaaaaccaacaagaaaaaaacgaacaagaacuacuagaaggaucaucaggaggacaacuacuaucaggaauaguccaacaacaaaacaaccuacuacgagcaauagaagcccaacaacaccuauuacaacuaacaguauggggaauaaaacaacuacaagcaagaauacuagcaggaggaagcggaggacacacaacauggauggaaugggacagagaaauaaauaacuacacaucauuaauccacucauuaauagaagaaucacaaaaccaacaagaaaaaaacgaacaagaacuacuagaaggaagcucaggaggacaacuauuaucaggaauaguucaacaacaaaacaauuuacuaagagcaauagaagcccaacaacaccuacuacaacuaacaguauggggaauaaaacaacuacaagcaagaauacuagcaggagga

SEQ ID NO: 47024 - RNA, 390 nt, Artificial Sequence
  derived and/or modified sequence opt6 from anti-HIV_8ANC195_LightChain
gauauacaaaugacacaaaguccaucaacauuaucagcaagcauaggagauacaguaagaauaagcuguagagcaagccaaucaauaacaggaaacuggguagcaugguaucaacaaagaccaggaaaagcaccaagauuacuaauauacagaggagcagcauuacuaggaggaguaccaucaagauuuagcggaagcgcagcaggaacagauuucacacuaacuauaggaaacuuacaagcagaagauuucggaacauuuuacugucaacaauacgauacauauccaggaaccuuuggacaaggaacaaaaguagaaguaaaaagaacaguagcagcaccaucaguauuuauauuuccaccaucagaugaacaacuaaaaagcggaaca

SEQ ID NO: 47025 - RNA, 423 nt, Artificial Sequence
  derived and/or modified sequence opt6 from anti-HIV_8ANC195_HeavyChain
caaauacaccuaguacaaucaggaacagaaguaaaaaaaccaggaucaucaguaacaguaucaugcaaagcauacggaguaaacacauucggacuauaugcaguaaacuggguaagacaagcaccaggacaaucacuagaauacauaggacaaauauggagauggaaaucaucagcaucacaccacuucagaggaagaguacuaauaucagcaguagaccuaaccggaucaucaccaccaauaucaucacuagaaauaaaaaacuuaacaucagacgacacagcaguauacuucugcacaacaacaucaacauacgacaaauggucaggacuacaccacgacggaguaauggcauucucaucuuggggacaaggaacacuaauaucaguaucagcagcaucaacuaaaggaccaucaguauuc

SEQ ID NO: 47026 - RNA, 333 nt, Artificial Sequence
  derived and/or modified sequence opt6 from anti-HIV_CAP256-VRC26.01_LightChain
caaucaguacuaacacaaccaccaucaguaucagcagcaccaggacaaaaaguaacaauaucaugcucaggaucaucaucaacaauaggaaacaacuacguaucaugguacagacuauuaccaggaacagcaccaaaauuacuaauauacaaaaacgacaacagaccaucaggaauaccagacagauucucaggaucaaaaucaggaacaucagcaacacuaggaauaucaggacuacaaacaggagacgaagcagacuacuacugcggaacaugggacacaucacuaucaggaggaggaguauucggaacaggaacaaaaguaacaguacua

SEQ ID NO: 47027 - RNA, 432 nt, Artificial Sequence
  derived and/or modified sequence opt6 from anti-HIV_CAP256-VRC26.01_HeavyChain
gaaguacaaguaguagaaagcggaggaggaguaguacaaccaggaagaaguuuaagauuaaguuguacagcaaguggauucacauucucaaacuuugcaaugggauggguaagacaagcaccaggaaaaggacuagaauggguagcauuuauaucaagcgauggaucaaacaaaaacuauggagauagcguaaaaggaagauuuaccauaaguagagacaauagcaaaaacacaguauuucuacaaaugaauagcuuaagaguagaagauacagcacuauauuacugugcaaaagacguaggagauuacaaaagcgaugaauggggaacagaauauuacgauauaucaauaucauacccaauacaagacccaagagcaaugguaggagcauucgaucuauggggacaaggaacaaugguaacaguaagccca

SEQ ID NO: 47028 - RNA, 324 nt, Artificial Sequence
  derived and/or modified sequence opt6 from anti-HIV_CAP256-VRC26.02_LightChain
caaucaguacuaacacaaccaccaucaguaucagcagcaccaggacaaaaaguaacaauaucaugcucaggaucaaacucaaacauaggaaacaaagacguaagcugguaccaacaaauaccagcaacagcaccaaaacuacuaauauacgaaaacaacaaaagaccaucaggaauaucagacagauucucaggaucaaaaucaggaacaucagcaacauuagcaauaacaggacuacaaacaggagacgaagcagacuacuacugcgcaacaugggacggaagaguaucaguaauaggaacaggaacaaacguaauaguacua

SEQ ID NO: 47029 - RNA, 432 nt, Artificial Sequence
  derived and/or modified sequence opt6 from anti-HIV_CAP256-VRC26.02_HeavyChain
gaaguacaauuaguagaaagcggaggaggaguaguacaaccaggaagaaguuuaagauuaagcugugcagcaagucaauucucauucggaaauuauggaaugcacugggucagacaagcaccaggaaaaggauuagaauggguagcagcaauaucauuugcaggaacaaaaacaaauuaugcagauaguguaaaaggaagauuuacaauaaguagagacaauaguaaaaauacaguauaucuacaaaugaauagcuugagagcagaagauacagcacuauauuucugugcaaaagacauaagagaauaugaaugugaauacuggacaucagacuauuaugauuucggaagaccacaaccauguauagacucaagaggaguaguaggaacauucgauguauggggacaaggaacaaugguaacaguaaguuca

SEQ ID NO: 47030 - RNA, 333 nt, Artificial Sequence
  derived and/or modified sequence opt6 from anti-HIV_CAP256-VRC26.03_LightChain
caaucaguacuaacacaaccaccaucaguaucagcagcaccaggacaaaaaguaacaauaucaugcucaggaucaagcucaaacauaggaaacaacuucguaucaugguaccaacaaagaccaggaacagcaccaaaaauacuaauauacgaaaacaacaaaagaccaucagaaacaccagacagauucucaggaucaaaaucaggaacaucagcaacacuagcaauaacaggacuacaaacagcagacgaagcagaauacuacugcgcaacauggucagcaucacuaucaucagcaagaguauucggaacaggaacaagaauaacaguacua

SEQ ID NO: 47031 - RNA, 432 nt, Artificial Sequence
  derived and/or modified sequence opt6 from anti-HIV_CAP256-VRC26.03_HeavyChain
gaaguacaauuaguagaaaguggaggaggaguaguacaaccaggaaaaaguuuaagauuaagcugugcagcaagcagauuuaguuuuaauagauauggaaugcauuggguaagacaagcaccaggaaaaggauuagaauggguagcagcaauaaguuacgauggaacagauaaauaucaugcagauaaaguauggggaagauuuacaauaaguagagauaauaguaaaaauacauuauauuuacaaaugaauaguuuaagagcagaagauacagcauuauauuauugugcaaaagauuuaagagaagaugaaugugaagaaugguggagugauuauuaugauuuuggaaaacaauuaccauguagaaaaagcagaggaguagcaggaauauuugauggauggggacaaggaacaaugguaacaguaaguagu

SEQ ID NO: 47032 - RNA, 333 nt, Artificial Sequence
  derived and/or modified sequence opt6 from anti-HIV_CAP256-VRC26.04_LightChain
caaccaguacuaacacaaccaccaucaguaucagcagcaccaggacaaaaaguaacaauaucaugcucaggaucaucaucaaacauaggaaacaacuucguaucaugguaccaacaaagaccaggaacagcaccaucacuacuaauauacgaaacaaacaaaagaccaucaggaauaccagacagauucucaggaucaaaaucagcaacaucagcaacacuagcaauaacaggacuacaaacaggagacgaagcagacuacuacugcgcaacaugggcagcaucacuaacaucagcaagaguauucggaacaggaacaaaaguaauaguauca

SEQ ID NO: 47033 - RNA, 432 nt, Artificial Sequence
  derived and/or modified sequence opt6 from anti-HIV_CAP256-VRC26.04_HeavyChain
gaaguacaauuaguagaaagcggaggaggaguaguacaaccaggaaaaaguuuaagauuaagcugugcagcaagccaauucucauucaauagauauggaaugcacuggguaagacaagcaccaggaaaaggauuagaauggguagcagcaauaucauacgauggaacagacaaauaccaugcagauaaaguauggggaagauuuacaauaagcagagacaauagcaaaaacacacuauaucuacaaaugaauaguuuaagagcagaagauacagcacuauauuacugugcaaaagacuuaagagaagacgaaugcgaagaaugguggucagacuauuacgauuucggaaaacaacuaccaugcagaaaaucaagaggaguagcaggcauauucgauaaauggggacaaggaacaaugguaauaguaagcuca

SEQ ID NO: 47034 - RNA, 324 nt, Artificial Sequence
  derived and/or modified sequence opt6 from anti-HIV_CAP256-VRC26.05_LightChain
caaagcgcacuaacacaaccaccaagcguaucagcagcaccaggacaaaaaguaacaauaucaugcucaggaaauauaggaaacaauuacguaagcugguaccaacaaguaccaggaacagcaccaaaacuauuaauauaugaaaauaacaaaagaccaagcggaauaccagacagauucucaggaucaaaaucaggaacaagcgcaacauuaguaauaacaggacuacaaacaggagacgaagcagauuucuauugcggaacauggggaggaucauuaagaacaggaggaguauuaggaacaggaacaagaguaacaguacua

SEQ ID NO: 47035 - RNA, 432 nt, Artificial Sequence
  derived and/or modified sequence opt6 from anti-HIV_CAP256-VRC26.05_HeavyChain
gaaguacaauuaguagaaaguggaggaggaguaguacaaccaggaaggaguuuaagauuaaguugugcagcaagucauuuuucauuaucaaguuauggaaugcauuggguaagacaagcaccaggaaaaggacuagaauggguaacaggaauaaguuuugcaggaacaaaaacauauuauggagauaguguaagaggaagauuuacaguaaguagagauauaaguaaaaauacauuauuuuuacaaaugaauagucuaagaccagaugauacagcaauguauuauugugcaagagaucaaagauauuaugaaugugaagaaugggcaucagauuauuaugauuuuggaagagaacaaccauguuuagauccaagaggaguaguaggaauauuugauuuauggggacaaggaacaaugguaacaguaaguagu

SEQ ID NO: 47036 - RNA, 324 nt, Artificial Sequence
  derived and/or modified sequence opt6 from anti-HIV_CAP256-VRC26.06_LightChain
caaucaguacuaacacaaccaccaucaguaucagcagcaccaggacaaaaaguaacaauaucaugcucaggaucaacaucaaaaauaggacaaaacucaguaucaugguaccaacaacuaccaggaacagcaccaaaacuacuaauauacgaaaacgacagaagaccaucaggaacaccagacagauucucaggaucaaaaagcggaacaucagcaacacuagcaauaacaggacuacaaacaggagacgaagcagaauacuacugcgaaacaugggacggaucaggaggaguauucggaacaggaacaaaaguaacaguacua

SEQ ID NO: 47037 - RNA, 435 nt, Artificial Sequence
  derived and/or modified sequence opt6 from anti-HIV_CAP256-VRC26.06_HeavyChain
gaaguacaauuaauagaaaguggaggaggaguaguacaaccaggaagaaguuuaagauuaaguuguggagcaaguggauuuaguuuuaauaauuauggaaugcauuggguaagacaagcaccaggaaaaggauuagaauggguagcaggaauaaguuuugcaggaauaaaaaaauauuauggaacaaguguaaaaggaagauuuacaauaaguagagauaauaguaaaaauaauuuuuauuuacaaaugaauaguuuaagaguagaagauacagcauuauauuauugugcaagagauuuaagggaauuggaaugugaagaauggacauuauauaauuauuaugauuuuggaaguagaggaccauguguagauccaagaggaguggcaggaaguuuugauguauggggacaaggaacaaugguaacaguaaguagu

SEQ ID NO: 47038 - RNA, 333 nt, Artificial Sequence
  derived and/or modified sequence opt6 from anti-HIV_CAP256-VRC26.07_LightChain
caagcaguacuaacacaaccaccaucaguaucagcagcaccaggacaaaacguaacaauaucaugcucaggaucaggaucaaacauaggaaacaacuucguaucaugguaccaacaaagaccaggaacagcaccaaaacuacuaauauacgaaucaaacaaaagaccaucaggaauaccagacagauucucaggaucaaaaucaggaacaucagcaacacuagcaauaacaggacuacaaacaggagacgaagcauacuacuacugcgcaacaugggcagcaagacuaaacucagcaagaguauucggaacaggaacaaugguaacaguacua

SEQ ID NO: 47039 - RNA, 432 nt, Artificial Sequence
  derived and/or modified sequence opt6 from anti-HIV_CAP256-VRC26.07_HeavyChain
gaaguacaauuaguagaaaguggaggaggaguaguacaaccaggaagaaguuugagauugaguuguguaggaagucaauuuaguuuuaauagauauggaaugcauuggguaagacaagcaccaggaaaaggauuagaauggguggcaggaauaaguuuugauggaacagauagauaucaugcagauaauguauggggaagauuuacaauaaguagagauaauaguaaaaauacauuauauuuacaaaugaguaguuuaagagcagaagauacagcauuauauuauugugcaaaagauuuaagagaagaugaaugugaagaaugguggagugauuauuaugauuuuggaaaaaaauuaccauguagaaaaaguagaggaguagcaggaguauuugauaaauggggacaaggaacaaugguaacaguaaguagu

SEQ ID NO: 47040 - RNA, 333 nt, Artificial Sequence
  derived and/or modified sequence opt6 from anti-HIV_CAP256-VRC26.08_LightChain
caaucagcauuaacacaaccaccaagcguaagcgcagcaccaggacaaaaaguaacaauaaguuguagcggaaacucaaguaauauaggaaacaauuucguaagcugguaccaacaaguaccaggaacagcaccaaaacuauuacuauaugaaacauacagaagaccaagcggaauaccagacagauucucaggaucaaaaucaggaacaagcgcaacauuagcaauaacaggacuacaaacaggagacgaagcagauuacuauugcacaguauggggaguaagaaaaggaguaggagcaguauuuggaacaggaacaaaaguaacaguacua

SEQ ID NO: 47041 - RNA, 438 nt, Artificial Sequence
  derived and/or modified sequence opt6 from anti-HIV_CAP256-VRC26.08_HeavyChain
gaaguacaauuaguagaaaguggaggaggaguaguacaaccaggaagaaguuuaacauuaaguugugcagcaagucaauuuacauuuaguaauuauggaaugcauuggguaagacaagcaccaggaaaaggauuagaauggguagcaaguguaaguaaugauggaacaaaaaaauaucauggagauaguguauggggaagauuuacaauaaguagagauaauaguaaaaauacauuauuuuuacaaaugaguaguuuaagagcagaagauacagcaguauauuuuuguguaagagaucaaagagaagaugaaugugaagaaugguggagugauuauuaugauuuuggaagagaauuaccgugcagaaaauuuagaggauuaggauuagcaggaauauuugauauauggggacauggaacaaugguaacaguaaguagu

SEQ ID NO: 47042 - RNA, 333 nt, Artificial Sequence
  derived and/or modified sequence opt6 from anti-HIV_CAP256-VRC26.09_LightChain
caaucagcacuaacacaaccaccaagcguaagcgcagcaccaggacaaaaaguaacaauaagcuguagcggaaacucaagcaauauaggaaacaauuucguaagcugguaccaacaauuaccaggaacagcaccaaaacuauuaauauaugaaaauaacagaagaccaagcggaauaccagacagauucucaggaucaaaaucaggaacaagcgcaacauuagcaauaagcggacuacaaacaggagacgaagcagauuacuggugcgcaguauggggaguaagaagaggagcaggagcaguauuuggagcaggaacaaaaguaacaguacua

SEQ ID NO: 47043 - RNA, 438 nt, Artificial Sequence
  derived and/or modified sequence opt6 from anti-HIV_CAP256-VRC26.09_HeavyChain
gaaguacaauuaguagaaagcggaggaggaguaguacaaccaggaagaaguuuaacauuaaguugugcagcaagccaauucaauuucgcaaacuauggaaugcacuggguaagacaagcaccaggaaaagggcuagaauggguagcaucaauaucaaacgauggaacaaaaaaauaccaugaagaaagcguauggggaagauuuacaauaagcaaagacaauagcaaaagcacacuauuuuuacaaaugaauagcuuaagaauagaagauacagcacuauauuucuguguaaaagaccaacgagaagacgaaugcgaagaaugguggucagacuauuacgauuucggaagagaauuaccaugcagaaaaucaagaggacuaggacuagcaggaauauucgauauguggggacauggaacaaugguaacaguaaguuca

SEQ ID NO: 47044 - RNA, 333 nt, Artificial Sequence
  derived and/or modified sequence opt6 from anti-HIV_CAP256-VRC26.10_LightChain
caaucaguacuaacacaaccaccaucaguaucagcagcaccaggacaaaaaguaacaauaucaugcucaggaucaucaucaaacauaggagacaacuacguaucaugguaccaacaccuaccaggaacagcaccaaaacuacuaauauacgaaaacacaagaagaccaucaggaauaccagacagauucucaggaucaaaaucaggaacaucagcaacacuagcaauaacaggacuacaaacaggagacgaagcagacuacuacugcggaacaugggacguaagaccaaacagaggagcaguauucggaacaggaacaaaaguaacaguacua

SEQ ID NO: 47045 - RNA, 432 nt, Artificial Sequence
  derived and/or modified sequence opt6 from anti-HIV_CAP256-VRC26.10_HeavyChain
caagcaauauuaguagaaaguggaggaggaguaguacaaccaggaagaaguuuaagauuaaguugugcagcaagucaauuuacauuuaguggacauggauuacauuggguaagacaagcaccaggaaaaggacuagaauggguagcaaguauaaguuuugcaggaacaaaaauggauuaugcagauaguguaaaaggaagauuugcaauaaguagagauaauaguaaaaauacauuauauuuacaaaugaauaguuuaagaguagaagauacagcauuauauuauugugcaaaagauaugagagaauaugaaugugaauauuggacaucagauuauuaugauuuuggaagaccacaaccauguauagauagaagaggaguaguaggaauauuugauauguggggacaaggaacaaugguaacaguaaguaca

SEQ ID NO: 47046 - RNA, 321 nt, Artificial Sequence
  derived and/or modified sequence opt6 from anti-HIV_CAP256-VRC26.11_LightChain
caaucaguauuaacacaaccaccaucaguaucagcagcaccaggacaaaacguaacaauaucauguucaggaccaccaucacauauagaaaaaaaugacguaucaugguaccaaagacuaccaggaauggcaccaaaaaugguaauauaugaaucaaaaagaagaccacuaggaauaccaguaagauucucagcaucaagaucaggaucaucagcaacauuaguaauaacaggacuacaaacagcagacgaagcagauuacuacugcggaacaugggacggaagaaugaacuuuggcacaggaacaacaguaucaguacua

SEQ ID NO: 47047 - RNA, 429 nt, Artificial Sequence
  derived and/or modified sequence opt6 from anti-HIV_CAP256-VRC26.11_HeavyChain
gaaguacaauuaguggaaaguggaggaggaguaguaccaccaggaaaaaguuuaacauuaaguuguguagcaaguagauuuacauuuagugcauuuggaaugcauuggguaagacaagcaccaggaaaaggauuagaauggguagcaaguauaaguuuugcaggaauaaaaaaauauuaugcagauaguguaaaaggaagauuuaguauaaguagagauaauaguaauacauuauuuuuacaaaugaauggauuaagaggagaagauacaggauuauaucauuguguaaaagauaugagagaauuagaaugugaagaaugggcaagcgauuauuaugauuuuggaaaaccacaaccauguuuagauagaagaggaguaaguggaauaagugcaugguggggaccaggaacaaugguaacaguaaguagu

SEQ ID NO: 47048 - RNA, 321 nt, Artificial Sequence
  derived and/or modified sequence opt6 from anti-HIV_CAP256-VRC26.12_LightChain
caaucaguacuaacacaaccaccaucaguaucaacagcaccaggacaaacaguaacaguaucaugcucaggaggaacaucaaacacaggaaacaacuucguaucaugguaccaacaccuaccaggaacagcaccaaaacuauuaauauacgaaaacaacaaaagaccacuaggaguaccagacagauucucaggagcaaaaucaggaacaucagcaacacuagcaauaacaggacuacaaacaggagacgaaggagacuacuacugcgcaacauggucaggaagccuaaacauaggaacaggaacaaaaguaucaguacua

SEQ ID NO: 47049 - RNA, 432 nt, Artificial Sequence
  derived and/or modified sequence opt6 from anti-HIV_CAP256-VRC26.12_HeavyChain
gaaguacaauugguacaaaguggaggaggaguaguacaaccaggaagaagcuuaagauuaaguugugcagcaccauauuuugaauuuggaagauauggauuucauuggguaagacaagcaccaggaaaaggauuagaauggguggcaaguauaaguuuugcaggaagagauuauuaucauaguccaaguguaugggggagauuuacaauaaguagagauaauaguaaaaauacauuauauuuacaaaugaauaguuuaagaauagaagauacagcacuauauuuuugugcaagagauuuaagagaaagcgaaugugaagaaugggaaagugauuauuaugauuuuggaaaaaaaggaccauguguaaaaccaagaggaguagcaggaggauuagaucuauggggacaaggaacaaugguaauaguaaguagu

SEQ ID NO: 47050 - RNA, 333 nt, Artificial Sequence
  derived and/or modified sequence opt6 from anti-HIV_CAP256-VRC26.I1_LightChain
caaagcguauuaacacaaccaccaagcguaagcgcagcaccaggacaaaaaguaacaauaagcuguagcggaagcucaagcaauauaggaaacaauuacguaagcugguaccaacaauuaccaggaacagcaccaaaacuauuaauauauaaaaauaacgaaagaccaagcggaauaccagacagauucucaggaucaaaaucaggaacaagcgcaacauuaggaauaacaggacuacaaacaggagacgaagcagauuacuauugcggaacaugggacacaucauuaagcgcaggaggaguauuuggaacaggaacaaaaguaacaguacua

SEQ ID NO: 47051 - RNA, 432 nt, Artificial Sequence
  derived and/or modified sequence opt6 from anti-HIV_CAP256-VRC26.I1_HeavyChain
caaguacaauuaguagaaaguggaggaggaguaguacaaccaggaagaucauuaagauuaagcugugcagcaagcggauucacauucagcaacuaugcaauggacuggguaagacaagcaccaggaaaaggacuagaauggguagcaguaauaucaagugauggaucaaacaaaaacuaugcagauagcguaaaaggaagauuuacaauaagcagagacaauaguaaaaacacacuauauuuacaaaugaauagcuuaagagcagaagauacagcaguauauuacugugcaaaagacuuaggagaaaacaaaaacgaugaaugggcaacagacuauuacgaucuaucaauagcauacccaguacaagacccaagagcaguaguaggagcauucgauauauggggacaaggaacaaugguaacaguaagcuca

SEQ ID NO: 47052 - RNA, 333 nt, Artificial Sequence
  derived and/or modified sequence opt6 from anti-HIV_CAP256-VRC26.I2_LightChain
caaucaguacuaacacaaccaccaucaguaucagcagcaccaggacaaaaaguaacaauaucaugcucaggaucaucaucaacaauaggaaacaacuacguaucaugguaccaacuauuaccaggaacagcaccaaaacuacuaauauacaaaaacgacaaaagaccaucaggaauaccagacagauucucaggaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 47053 - RNA, 432 nt, Artificial Sequence
  derived and/or modified sequence opt6 from anti-HIV_CAP256-VRC26.I2_HeavyChain
caaguacaauuaguagaaagcggaggaggaguaguacaaccaggaagaagccuaagauuaagcugugcagcaagcggauucacauucucaaacuuugcaaugggauggguaagacaagcaccaggaaaaggacuagaauggguagcauuuauaucgagcgauggaucaaauaaaaacuauggagauagcguaaaaggaagauuuacaauaagcagagacaauagcaaaaacacacuauuucuacaaaugaauagcuuaagagcagaagauacagcacuauauuacugugcaaaagacguaggagaauacaaaagcgaugaaugggcaacagacuauuacgaucuaucaauagcauacccaauacaagacccacgagcaaugguaggagcauucgauauauggggacaaggaacaaugguaacaguaagcuca

SEQ ID NO: 47054 - RNA, 333 nt, Artificial Sequence
  derived and/or modified sequence opt6 from anti-HIV_CAP256-VRC26.UCA_LightChain
caaucaguacuaacacaaccaccaucaguaucagcagcaccaggacaaaaaguaacaauaucaugcagcggcucaucaagcaauauaggaaacaauuacguaucaugguaccaacaauuaccaggaacagcaccaaaacuauuaauauacgaaaauaacaaaagaccaucaggaauaccagacagauucucaggaagcaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 47055 - RNA, 432 nt, Artificial Sequence
  derived and/or modified sequence opt6 from anti-HIV_CAP256-VRC26.UCA_HeavyChain
caaguacaauuaguagaaagcggaggaggaguaguacaaccaggaagaaguuuaagauuaagcugugcagcaaguggauuuacauuuaguaguuauggaaugcauuggguaagacaagcaccaggaaaaggauuagaauggguagcaguaauaaguuaugauggaaguaauaaauauuaugcagauaguguaaaagggagauuuacaauaaguagagauaauaguaaaaauacacuauauuuacaaaugaauaguuuaagagcagaagauacagcaguauauuauugugcaaaagaucuaggagaaagugaaaaugaagaaugggcaacagauuauuaugauuuuaguauaggauauccaggacaagauccaagaggaguaguaggagcauuugauauauggggacaaggaacaaugguaacaguaaguagu

SEQ ID NO: 47056 - RNA, 324 nt, Artificial Sequence
  derived and/or modified sequence opt6 from anti-HIV_CH01_LightChain
gaaauaguacuagcacaaucaccaggaacauuaucauuaagcccaggagaaagagcaacauuaagcuguagagcaagccauaacguacacccaaaauauuucgcaugguaucaacaaaaaccaggacaaagcccaagauuacuaauauacggaggaagcacaagagcagcaggaauaccaggaaaauuuagcggaagcggaagcggaacagauuucacacuaacaauaucaagaguagacccagaagauuucgcaguauauuacugucaacaauacggaggaucaccauauacauuuggacaaggaacaaaaguagaaauaaaa

SEQ ID NO: 47057 - RNA, 399 nt, Artificial Sequence
  derived and/or modified sequence opt6 from anti-HIV_CH01_HeavyChain
gaaguacaauuaguagaaaguggagcaaauguaguaagaccaggaggaaguuuaagauuaagcuguaaagcaaguggauuuauauuugaaaauuuuggauuuaguuggguaagacaagcaccaggaaaaggauuacaauggguagcaggauuaaauuggaauggaggagauacaagauaugcagauaguguaaaaggaagauuuagaaugaguagagauaauaguagaaauuuuguauauuuagauauggauaaaguaggaguagaugauacagcauuuuauuauugugcaagaggaacagauuauacaauagaugaugcaggaauacauuaucaaggaaguggaacauuuugguauuuugauuuauggggaagaggaacauuaguaaguguaaguagu

SEQ ID NO: 47058 - RNA, 324 nt, Artificial Sequence
  derived and/or modified sequence opt6 from anti-HIV_CH02_LightChain
gaaauaguacuaacacaaucaccagcaacauuaagcguaagcccaggagaaagagcaacauuaagcuguagagcaagccaaaacguacacccaagauauuucgcaugguaucaacaaaaaagaggacaaagcccaagauuacuaauacacucaggaucaacaagagcagcaggaauagcagauagauuuaguggaggaggaagcggaaugcauuucacacuaacaauaacaagaguagaaccagaagauuucgcaguauauuucugucaacaauacggaggaucaccauauacauuuggacaaggaacaagaguagaauuaaga

SEQ ID NO: 47059 - RNA, 399 nt, Artificial Sequence
  derived and/or modified sequence opt6 from anti-HIV_CH02_HeavyChain
gaaguacaauuaguagaaaguggaggaaguguaguaagaccaggaggaaguuuaagauuaaguuguagagcaaguggauuuauauuugaaaauuauggauuaacauggguaagacaaguaccaggaaaaggguuacauuggguaagcggaaugaauuggaauggaggagauacaagauaugcagauaguguaagaggaagauuuaguaugaguagagauaauaguaauaauauagcauauuuacaaaugaauaauuuaagaguagaagauacagcauuauauuauugugcaagaggaacagauuauacaauagaugaucaaggaagauuuuaucaaggaucaggaacauuuugguauuuugauuuuuggggaaggggaacauuaguaacaguaagcagu

SEQ ID NO: 47060 - RNA, 324 nt, Artificial Sequence
  derived and/or modified sequence opt6 from anti-HIV_CH03_LightChain
gaaauaguacuaacacaaucaccagcaacauuaucuuuaagcccaggagaaagagcaacauuaagcuguagagcaagccaaagcguacacccaaaauauuucgcaugguaucaacaaaaaccaggacaaagcccaagauuauuaauauacagcggaucaacaagagcagcaggaauagcagauagauuuagcggaggaggaagcggaauacauuucacacuaacaauaacaagaguagaaccagaagauuucgcaguauauuucugucaacaauacggaggaucaccauauacauuuggacaaggaacaaaaguagaauuaaga

SEQ ID NO: 47061 - RNA, 399 nt, Artificial Sequence
  derived and/or modified sequence opt6 from anti-HIV_CH03_HeavyChain
gaagugcaauuaguagaaaguggaggaggaguaguaagaccaggaggaaguuuaagauuaaguugugcagcaaguggauuuauauuugaaaauuauggauuaacauggguaagacaaguaccaggaaaaggauuacauuggguaaguggaaugaauuggaauggaggagauacaagauaugcagauaguguaagaggaagauuuaguaugaguagagauaauagcaauaauauagcauauuuacaaaugaaaaauuuaagaguagaugauacagcauuauauuauugugcaagaggaacagauuauacaauagaugaucaaggaauauuuuauaaaggaaguggaacauuuugguauuuugauuuauggggaagaggaacauuaguaacaguaaguagu

SEQ ID NO: 47062 - RNA, 324 nt, Artificial Sequence
  derived and/or modified sequence opt6 from anti-HIV_CH04_LightChain
gaaauaguacuaacacaaucaccagauacauuaucauuaagcccaggagaaagagcaacauuaagcuguagagcaagccaaagcguacacagcagauauuucgcaugguaucaacauaaaccaggacaaccaccaagauuacuaauauacggaggaucaacaagagcaacaggaauaccaaauagauuuagcgcaggaggaagcggaacacaauucacacuaacaguaaauagauuagaagcagaagauuucgcaguauauuacugucaacaauacggaagaucaccauauacauuuggacaaggaacaaaaguagaaauaaga

SEQ ID NO: 47063 - RNA, 399 nt, Artificial Sequence
  derived and/or modified sequence opt6 from anti-HIV_CH04_HeavyChain
gaaguacaauuaguagaaaguggaggaggauuaauaaggccgggaggaaguuuaagauuaaguuguaaaggaaguggguuuauauuugaaaauuuuggauuuggauggguaagacaaggaccaggaaaaggauuagaauggguaaguggaacaaauuggaauggaggagauaguagauauggagauaguguaaaaggaagauuuacaauaaguagagauaauaguaauaauuuuguauauuuacaaaugaauaguuuaaggccagaagauacagcaauauauuauugugcaagaggaacagauuauacaauagaugaucaaggaauaagauaucaaggaaguggaacauuuugguauuuugauguauggggaagaggaacauuaguaacaguaaguagu

SEQ ID NO: 47064 - RNA, 627 nt, Artificial Sequence
  derived and/or modified sequence opt6 from anti-HIV_CH103_LightChain
uacgaacuaacacaaccaccaucaguaucagucucaccaggccaaacagcaacaauuacgugcucaggagcaucaacaaacguaugcugguaccaaguaaaaccaggacaaucaccagaaguaguaauauucgaaaacuacaaaagaccaucaggaauaccagacagauucucaggaucaaaaucaggaucaacagcaacacuaacaauaagaggaacacaagcaauagaugaagccgacuacuacugccaaguuugggacucauucucaacauucguauucggaucaggaacacaaguaacaguauuaagacaaccaaaagcaaacccaacaguaacacuauucccaccaucuuccgaagaacuacaagcaaacaaagccacacuaguaugccuuauaucagacuucuaccccggagcaguaacaguagcauggaaagcagacucaucaccaguaaaagcaggaguagaaaccacaacacccucaaaacaaucuaacaacaaauacgcagcaucaucauaucuaucacuaacaccagaacaauggaaaucccacagaucauacuccugccaaguaacacacgaaggaagcacaguagaaaaaacaguagcaccaacagaaugcuca

SEQ ID NO: 47065 - RNA, 678 nt, Artificial Sequence
  derived and/or modified sequence opt6 from anti-HIV_CH103_HeavyChain
caaguacaauuacaagaaagcggaccagguguaguaaaaucaucagaaacacuaucauuaacauguacagucaguggaggaucuaugggaggaacauacuggucauggcuaagauuaucuccagguaaaggauuagaauggauuggauauauauuucacacaggagaaacaaauuacucaccaucacuaaaaggacgaguaucaauaucaguagauacaucugaagaucaauuuucauuaagauuaagaucaguaacagcagcagacacagcaguauacuuuugcgcuagcuuaccaagaggacaacuaguaaacgcauacuuuagaaauuggggaagaggaucauuaguaucaguaacagcagcaucaacaaaaggaccaucaguuuucccauuagcaccaaguucaaaaucuaccucuggaggaacagcagcacuaggaugccuaguaaaagauuauuuuccagaaccaguaacaguaagcuggaacucaggagcauuaacaucaggaguacacaccuuuccagcaguacuacaaucaucaggacuauauucacuaagcucaguaguaacaguaccaucuucaucacuaggaacacaaacauauauauguaacguaaaccauaaaccaucaaauacaaaaguagauaaaaaaguagaaccaaaaucaugugacaaa

SEQ ID NO: 47066 - RNA, 321 nt, Artificial Sequence
  derived and/or modified sequence opt6 from anti-HIV_M66.6_LightChain
gacauacaacuaacacaaucaccaucaucacuaucagcaucaguaggagauagaguaacaauaacaugcagagcaucacaaucaauaggaucauaccuaaacugguaccaacaaaaaccaggaaaagcaccaaaacuacuaauauacgcagcaucaacacuacaaucaggaguaccaucaagauucucaggcucaggaucaggaacagacuucacacuaacaauaucaucacuacaaccagaagacucagcaacauacuacugccaacaaucauacucaacaccauucacauucggaccaggaacaaaaguagacauaaga

SEQ ID NO: 47067 - RNA, 390 nt, Artificial Sequence
  derived and/or modified sequence opt6 from anti-HIV_M66.6_HeavyChain
caaguacaauuaguacaaagcggagcagaaguaaaaaaaccaggagaaagcuuaaaaauaagcuguaaaguaagcggauacaauuucgcaagcgaauggauaggauggguaagacaaaugccaggaaaaggacuagaauggaugggaauaauauauccaggagacucagacacaaaauauagcccaagcuuucaaggacaaguaauaauaagugcagacaaaagcauaaacacagcauaucuacaauggucaagcuuaaaagcaagcgauacagcaauauauuacugugcaagacaaaaucacuauggaucaggaucauacuuuuacagaacagcauacuauuacgcaauggauguauggggacaaggaacaacaguaacaguaagcuca

SEQ ID NO: 47068 - RNA, 327 nt, Artificial Sequence
  derived and/or modified sequence opt6 from anti-HIV_NIH45-46_LightChain
gaaauaguacuaacacaaucaccagcaacauuaagccuaagcccaggagaaacagcaauaauaagcuguagaacaagucaaagcggaucauuagcaugguaccaacaaagaccaggacaagcaccaagauuaguaauauauagcggaagcacaagagcagcaggaauaccagacagauucagcggaucaagauggggagcagacuauaacuuaagcauaaguaaucuagaaagcggagacuuuggaguauacuauugccaacaauaugaauuuuucggacaaggaacaaaaguacaaguagauauaaaaagaacaguagcagcacca

SEQ ID NO: 47069 - RNA, 399 nt, Artificial Sequence
  derived and/or modified sequence opt6 from anti-HIV_NIH45-46_HeavyChain
caaguaagauuaagucaaagcggaggacaaaugaaaaaaccaggagaaagcaugagauuaaguuguagagcaagcggauaugaauuuuuaaauuguccaauaaauuggauaagauuagcaccaggaagaagaccagaauggaugggauggcuaaaaccaagaggaggagcaguaaauuaugcaagaaaauuucaaggaagaguaacaaugacaagagauguauauagugauacagcauuuuuagaauuaagaaguuuaacaucagaugauacagcaguauauuuuuguacaagaggaaaauauuguacagcaagagauuauuauaauugggauuuugaacauuggggaagaggagcaccaguaacaguaaguagugcaaguacaaaaggaccaagugua

SEQ ID NO: 47070 - RNA, 330 nt, Artificial Sequence
  derived and/or modified sequence opt6 from anti-HIV_PG16_LightChain
caaagcgcacuaacacaaccagcaucaguaucaggaucaccaggacaaacaauaacaauaucaugcaauggaacaagcucagacguaggaggauucgauagcguaagcugguaccaacaaucaccaggaaaagcaccaaaaguaaugguauuugacguaagccauagaccaagcggaauaucaaacagauucucaggaucaaaaucaggaaauacagcaucauuaacaauaagcggacuacauauagaagacgaaggagauuacuuuugcagcagcuuaacagauagaucacacagaauauuuggaggaggaacaaaaguaacaguacua

SEQ ID NO: 47071 - RNA, 411 nt, Artificial Sequence
  derived and/or modified sequence opt6 from anti-HIV_PG16_HeavyChain
caagaacaauuaguagaaaguggaggaggaguaguacaaccaggaggaagcuuaagauuaaguuguuuagcaaguggauuuacauuucauaaauauggaaugcauuggguaagacaagcaccaggaaaaggauuagaauggguagcauuaauaagugaugauggaaugagaaaauaucauagugauaguauguggggaagaguaacaauaaguagagauaauaguaaaaauacauuauauuuacaauuuaguaguuuaaaaguagaagauacagcaauguuuuuuugugcaagagaagcaggaggaccaauauggcaugaugauguaaaauauuaugauuuuaaugauggauauuauaauuaucauuauauggauguauggggaaaaggaacaacaguaacaguaaguagu

SEQ ID NO: 47072 - RNA, 315 nt, Artificial Sequence
  derived and/or modified sequence opt6 from anti-HIV_PGT122_LightChain
acauucguaaguguagcaccaggacaaacagcaagaauaacauguggagaagaaucauuaggaagcagaagcguaauaugguaucaacaaagaccaggacaagcaccaucacuaauaauauauaacaauaacgacagaccaagcggaauaccagacagauucucaggaucaccaggaagcacauucggaacaacagcaacacuaacaauaacaagcguagaagcaggagaugaagcagacuauuacugucacauaugggacagcagaagaccaacaaauuggguauucggagaaggaacaacacuaauaguauua

SEQ ID NO: 47073 - RNA, 396 nt, Artificial Sequence
  derived and/or modified sequence opt6 from anti-HIV_PGT122_HeavyChain
caaguacaccuacaagaaucaggaccaggauuaguaaaaccaucagaaacacuaagccuaacauguaacguaucaggaacauuaguaagagacaauuacuggucauggauaagacaaccacuagguaaacaaccagaauggauaggauauguacacgacucaggagacacaaacuacaacccaucacuaaaaucaagaguacaccuaucacuagacaaaagcaaaaaucuaguaucacuaagacuaacaggaguaacagcagcagacucagcaauauacuacugcgcaacaacaaaacacggaagaagaauauacggaguaguagcauucaaagaaugguucacauauuucuacauggacguauggggaaaaggaacaucaguaacaguaucauca

SEQ ID NO: 47074 - RNA, 315 nt, Artificial Sequence
  derived and/or modified sequence opt6 from anti-HIV_PGT123_LightChain
agcagcaugucaguaucaccaggagaaacagcaaaaauaucaugcggaaaagaaagcauaggaucaagagcaguacaaugguaucaacaaaaaccaggacaaccaccaucauuaauaauauacaauaaccaagacagaccagcaggaguaccagaaagauuuagcgcaagcccagacuuuagaccaggaacaacagcaacacuaacaauaacaaauguagaugcagaagacgaagcagauuacuauugccauauauaugacgcaagaggaggaacaaacuggguauuugacagaggaacaacauuaacaguacua

SEQ ID NO: 47075 - RNA, 396 nt, Artificial Sequence
  derived and/or modified sequence opt6 from anti-HIV_PGT123_HeavyChain
caauuacacuuacaagaaucaggaccaggacuaguaaaaccaccagaaacauuaagcuuaacauguagcguaagcggagcaucaauaaaugacgcauacuggagcuggauaagacaaucaccaggaaaaagaccagaauggguaggauauguacaucacucaggagacacaaauuacaauccaucacuaaaaagaagaguaacauucucauuagauacagcaaaaaaugaaguaucauuaaaauuaguagauuuaacagcagcagacucagcaacauacuuuugcgcaagagcacuacauggaaaaagaauauacggaauaguagcauuaggagaacuauuuacauauuucuauauggauguauggggaaaaggaacagcaguaacaguaagcuca

SEQ ID NO: 47076 - RNA, 315 nt, Artificial Sequence
  derived and/or modified sequence opt6 from anti-HIV_PGT125_LightChain
caaucagcauuaacacaaccaccaucagcaucaggaucaccaggacaaucaauaacaauaucauguaacggaacagcaacaaauuucguaucaugguaccaacaauuuccagauaaagcaccaaaacuaauaauauucggaguagacaaaagaccaccaggagucccagacagauucucaggaucaagaucaggaacaacagcaucacuaacaguaucaagacuacaaacagacgacgaagcaguauacuacugcggaucauuaguaggaaacugggacguaauauucggaggaggaacaacacuaacaguacua

SEQ ID NO: 47077 - RNA, 411 nt, Artificial Sequence
  derived and/or modified sequence opt6 from anti-HIV_PGT125_HeavyChain
caaucacaacuacaagaaucaggaccaagauuaguagaagcaucagaaacacuaucauuaacaugcaauguaucaggagaaucaacaggagcaugcacauacuuuuggggauggguaagacaagcaccaggcaaaggacuagaauggauaggaagcuuaucacauugccaaucauuuuggggaucaggauggacauuccauaacccaucauuaaaaucaagauuaacaauaucauuagacacaccaaaaaaccaaguauuucuaaaacuaacaucauuaacagcagcagauacagcaacauauuacugugcaagauucgacggagaaguauuaguauauaaccauuggccaaaaccagcauggguagaucuauggggaagaggaauaccaguaacaguaacaguaucauca

SEQ ID NO: 47078 - RNA, 315 nt, Artificial Sequence
  derived and/or modified sequence opt6 from anti-HIV_PGT126_LightChain
caaucagcacuaacacaaccaccaucagcaucaggaucaccaggacaaucaauaucaauaucaugcacaggaacaucaaacagauucguaucaugguaccaacaacacccaggaaaagcaccaaaacuaguaauauacggaguaaacaaaagaccaucaggaguaccagacagauucucaggaucaaaaucaggaaacacagcaucacuaacaguaucaggacuacaaacagacgacgaagcaguauacuacugcucaucacuaguaggaaacugggacguaauauucggaggaggaacaaaacuaacaguacua

SEQ ID NO: 47079 - RNA, 411 nt, Artificial Sequence
  derived and/or modified sequence opt6 from anti-HIV_PGT126_HeavyChain
caaccacaacuacaagaaucaggaccaggauuaguagaagcaucagaaacacuaucauuaacaugcacaguaucaggagauucaacagcagcaugcgauuacuuuuggggauggguaagacaaccaccaggaaaaggauuagaauggauaggaggauuaucacauugcgcaggcuauuacaauacaggauggacauaccauaacccaucauuaaaaucaagauuaacaauaucauuagacacuccaaaaaaccaaguauuucuaaaacuaaauucaguaacagcagcagauacagcaauauauuacugugcaagauucgauggagaaguauuaguauaucacgauuggccaaaaccagcauggguagaucuauggggaagaggaacacuaguaacaguaacaguaucauca

SEQ ID NO: 47080 - RNA, 315 nt, Artificial Sequence
  derived and/or modified sequence opt6 from anti-HIV_PGT127_LightChain
caaucagcauuaacacaaccaccaucagcaucaggaucaccaggacaaucaauaacaauaagcuguacaggaacaucaaacaauuucguaucaugguaccaacaauauccaggaaaagcaccaaaauuaguaauauaugaaguaaacaaaagaccaucaggaguaccagacagauucucaggaucaaaaucaggaucaacagcaucacuaacaguaagcggacuacaagcagacgacgaaggaguauacuacugcucaucauuaguaggaaacugggacguaauauuuggaggaggaacaaaauuaacaguacua

SEQ ID NO: 47081 - RNA, 405 nt, Artificial Sequence
  derived and/or modified sequence opt6 from anti-HIV_PGT127_HeavyChain
caaccacaacuacaagaaucaggaccaggauuaguagaagcaucagaaacacuaaguuuaacaugcacaguaucaggagauucaacaggaagaugcaauuacuuuugggguuggguaagacaaccaccaggaaaaggauuagaauggauaggaucauuaucacacugcagaucauauuacaauacagacuggacauaucauaacccaucacuaaaaucaagauuaacaauaucauuagacacaccaaaaaaccaaguauuucuaagacuaacaaguguaacagcagcagauacagcaacauauuacugugcaagauucggaggagaaguauuaguauacagagacuggccaaaaccagcauggguagaucuauggggaagaggaacauuaguaacaguaucauca

SEQ ID NO: 47082 - RNA, 315 nt, Artificial Sequence
  derived and/or modified sequence opt6 from anti-HIV_PGT128_LightChain
caaucagcacuaacacaaccaccaucagcaucaggaucaccaggacaaucaauaacaauaucaugcacaggaacaucaaacaacuucguaucaugguaccaacaacacgcaggaaaagcaccaaaacuaguaauauacgacguaaacaaaagaccaucaggaguaccagacagauucucaggaucaaaaucaggaaacacagcaucacuaacaguaucaggacuacaaacagacgacgaagcaguauacuacugcggaucacuaguaggaaacugggacguaauauucggaggaggaacaaaacuaacaguacua

SEQ ID NO: 47083 - RNA, 405 nt, Artificial Sequence
  derived and/or modified sequence opt6 from anti-HIV_PGT128_HeavyChain
caaccacaacuacaagaaucaggaccaacauuaguagaagcaucagaaacacuaucacuaacaugcgcaguaucaggagauucaacagcagcaugcaauucauuuuggggauggguaagacaaccaccaggaaaaggacuagaauggguaggaagcuuaucacauugcgcaucauauuggaauagaggauggacauaccauaacccaucauuaaaaucaagauuaacauuagcauuagacacaccaaaaaacuuaguauuuuuaaaacuaaauucaguaacagcagcagauacagcaacauauuacugugcaagauucggaggagaaguauuaagauauacagauuggccaaaaccagcauggguagaucuauggggaagaggaacacuaguaacaguaucauca

SEQ ID NO: 47084 - RNA, 330 nt, Artificial Sequence
  derived and/or modified sequence opt6 from anti-HIV_PGT130_LightChain
caaagugcacuaacacaaccaccaucagcaucaggaucauuaggacaaucaguaacaauaucaugcaauggaacaaguucagacauaggaggauggaauuuuguaagcugguaucaacaauuuccaggaagagcaccaagacuaauaauauuugaaguaaauaaaagaccaagcggaguaccaggaagauucucaggaucaaaaucaggaaauagcgcaagucuaacaguaagcggacuacaaagcgaugacgaaggacaauacuuuugcucaagcuuauuuggaagaugggacguaguauuuggaggaggaacaaaauuaacaguauua

SEQ ID NO: 47085 - RNA, 387 nt, Artificial Sequence
  derived and/or modified sequence opt6 from anti-HIV_PGT130_HeavyChain
caaguacaacuacaagaaucaggaccaggauuaguaaaaccagcagaaacacuaucacuaacaugcucaguaucaggagaaucaauaaacacaggacacuacuacuggggauggguaagacaaguaccaggaaaaggacuagaauggauaggacacauacacuacacaacagcaguacuacacaacccaucacuaaaaucaagacuaacaauaaaaauauauacacuaagaaaucaaauaacacuaagacuaucaaacguaacagcagcagacacagcaguauaccacugcguaagaucaggaggagacauacuauacuacuacgaauggcaaaaaccacacugguucucaccauggggaccaggaauacacguaacaguaucauca

SEQ ID NO: 47086 - RNA, 330 nt, Artificial Sequence
  derived and/or modified sequence opt6 from anti-HIV_PGT131_LightChain
caaagugcauuaacacaaccaccaucagcaucaggaucauuaggacaaucauuaacaauaucauguucaggaacaggaucagauauaggaucauggaauuuuguaagcugguaucaacaauuuccaggaagagcaccaaauuuaauaauauuugaaguaaacagaagaagaucaggaguaccagacagauucucaggaucaaaaucaggaaauacagcaaguuuaacaguaagcggacuaagaagugaagacgaagcagaauauuuuuguucaaguuuaaguggaagaugggacauaguauuuggaggaggaacaaaaguaacaguauua

SEQ ID NO: 47087 - RNA, 387 nt, Artificial Sequence
  derived and/or modified sequence opt6 from anti-HIV_PGT131_HeavyChain
caaguacaacuacaagaaucaggaccaggacuaguaaaaccaucagaaacacuaucacuaacaugcacaguaucaggagacucaauaaacacaggacaccacuacuggggauggguaagacaaguaccaggaaaaggaccagaauggauagcacacauacacuacaacacagcaguacuacacaacccagcauuaaaaucaagaguaacaauaagcauauucacacuaaaaaaccuaauaacacuaucacuaucaaacguaacagcagcagacacagcaguauacuucugcguaagaucaggaggagacauacuauacuacauagaauggcaaaaaccacacugguucuacccauggggaccaggaauacuaguaacaguaucauca

SEQ ID NO: 47088 - RNA, 321 nt, Artificial Sequence
  derived and/or modified sequence opt6 from anti-HIV_PGT135_LightChain
gaaauaguaaugacacaaucaccagacacacuaucaguaucaccaggagaaacaguaacacuaucaugcagagcaucacaaaacauaaacaaaaaccuagcaugguaccaauacaaaccaggacaaucaccaagacuaguaauauucgaaacauacucaaaaauagcagcauucccagcaagauucguagcaucaggaucaggaacagaauucacacuaacaauaaacaacaugcaaucagaagacguagcaguauacuacugccaacaauacgaagaauggccaagaacauucggacaaggaacaaaaguagacauaaaa

SEQ ID NO: 47089 - RNA, 399 nt, Artificial Sequence
  derived and/or modified sequence opt6 from anti-HIV_PGT135_HeavyChain
caauuacaaaugcaagaaaguggaccaggauuaguaaaaccaagugaaacauuaaguuuaaguuguacaguaaguggagauaguauaagaggaggagaauggggagauaaagauuaucauuggggauggguaagacauagugcaggaaaaggauuagaauggauaggaagcauacauuggagaggaacaacacauuauaaagaaaguuuaagaagaagaguaagcaugaguauagauacaaguagaaauugguuuaguuuaagauuagcaaguguaacagcagcagauacagcaguauauuuuugugcaagacauagacaucaugauguauuuaugcuagugccaauagcaggaugguuugauguauggggaccaggaguacaaguaacaguaaguagu

SEQ ID NO: 47090 - RNA, 321 nt, Artificial Sequence
  derived and/or modified sequence opt6 from anti-HIV_PGT136_LightChain
gaaauaguaaugacacaaucaccaccaacauuaagcguaagcccaggagaaacagcaacauuaagcuguagagcaagccaaaacguaaaaaauaacuuagcaugguaccaacuaaaaccaggacaagcaccaagacuauuaauauuugacgcaagcucaagagcaggaggaauaccagacagauucucaggaucaggauauggaacagacuuuacauuaacaguaaacucaguacaaagcgaagacuuuggagauuacuuuugccaacaauaugaagaauggccaagaacauucggacaaggaacaaaaguagauauaaaa

SEQ ID NO: 47091 - RNA, 402 nt, Artificial Sequence
  derived and/or modified sequence opt6 from anti-HIV_PGT136_HeavyChain
caacuacaacuacaagaaagcggaccaggauuaguaaaaccaagugaaacauuaagccuaacauguacaguaagcggaggaucaaugagaggaacagacuggggagaaaacgauuuccauuacggauggauaagacaaagcucagcaaaaggauuagaauggauaggaaguauacacuggagaggaagaacaacacauuacaaaacaucauucagaagcagagcaacacuaucaauagauacaucaaacaauagauuuagcuuaacauuuucauuuguaacagcagcagacacagcaguauacuauugcgcaagacauaaauaucacgauauauuuagaguaguaccaguagcaggaugguucgauccauggggacaaggacuauuaguaacaguaagcuca

SEQ ID NO: 47092 - RNA, 321 nt, Artificial Sequence
  derived and/or modified sequence opt6 from anti-HIV_PGT137_LightChain
gaaauaaugaugacacaaucaccagcaauacuaucaguaucaccaggagacagagcaacacuaucaugcagagcaucacaaucaguaaaaaacaacuuagcaugguaccaaaaaagaccaggacaagcaccaagacuacuaauauucgacacaucaucaagagcaucaggaauaccagcaagauucucaggaggaggaucaggaacagaauucacacuaacaguaaacucaaugcaaucagaagacuucgcaacauacuacugccaacaauacgaagaauggccaagaacauucggacaaggaacaaaaguagaaauaaaa

SEQ ID NO: 47093 - RNA, 399 nt, Artificial Sequence
  derived and/or modified sequence opt6 from anti-HIV_PGT137_HeavyChain
gaaguacaucuagaagaaagcggaccaggauuaguaagaccaagugaaacauuaaguuuaacauguacagcaaguggaggaaguauaagaggaggagaauggggagauagugauuaucauuggggauggguaagacauaguccagaaaaaggauuagaauggauaggaaguauacauuggagaggaacaacacauuauaaugcaccauuuagaggaagaggaagauuaaguauagauuuaaguagaaaucaauuuagucuaagacuaacaaguguaacagcagaagauacagcaguauauuauuguguaaaacauaaauaucaugauauaguaaugguaguaccaauagcaggaugguuugauccauggggacaaggauuacaaguaacaguaucaagu

SEQ ID NO: 47094 - RNA, 336 nt, Artificial Sequence
  derived and/or modified sequence opt6 from anti-HIV_PGT141_LightChain
gauacaguaguaacacaaucaccauuaucauuaccaguaacaccaggagaagcagcaagcaugagcuguagcagcacacaaaguuuaagacauagcaauggagcaaacuaucuagcaugguaucaacauaaaccaggacaaagcccaagauuacuaauaagauuaggaagccaaagagcaucaggaguaccagauagauuuagcggaagcggaagcggaacacauuucacacuaaaaauaucaagaguagaagcagaagaugcagcaauauauuacuguaugcaaggauuaaacagaccauggacauuuggaaaaggaacaaaauuagaaauaaaa

SEQ ID NO: 47095 - RNA, 423 nt, Artificial Sequence
  derived and/or modified sequence opt6 from anti-HIV_PGT141_HeavyChain
caaguacaauuaguacaaagcggaccagaaguaaaaaaaccaggaucaagcguaaaaguaaguuguaaagcaaguggaaauacauucucaaaauaugacguacacuggguaagacaagcaacaggacaaggacuagaauggguaggauggaugucacacgaaggagauaaaacagaaucagcacaaagauuuaaaggaagaguaacauuuacaagagacacaagcgcaagcacagcauauauggaacuaagaggauuaacaucagacgauacagcaauauauuacuguacaagaggaucaaaacauagauuaagagauuacguacuauaugacgauuacggauuaauaaacuaucaagaauggaaugacuauuuagaauucuuagacguauggggacacggaacagcaguaacaguaucaagc

SEQ ID NO: 47096 - RNA, 336 nt, Artificial Sequence
  derived and/or modified sequence opt6 from anti-HIV_PGT142_LightChain
gauacaguaguaacacaaucaccauuaucauuaccaguaacaccaggagaagcagcaucaaugucauguucaucaacacaaucauuaagacauucaaauggagcaaacuaucuagcaugguaucaacauaaaccaggacaaucaccaagauuacuaauaagacuaggaucacaaagagcaucaggaguaccagacagauuuucaggaucaggaucaggaacacauuucacacuaaaaauaucaagaguagaagcagaagaugcagcaauauauuacuguaugcaaggauuaaacagaccauggacauuuggaaaaggaacaaaauuagaaauaaaa

SEQ ID NO: 47097 - RNA, 423 nt, Artificial Sequence
  derived and/or modified sequence opt6 from anti-HIV_PGT142_HeavyChain
caaguacaauuaguacaaaguggaccagaaguaaaaaaaccaggaucaagcguaaaaguaagcuguaaagcaagcggaaacacauucucaaaauaugacguacacuggguaagacaagcaacaggacaaggacuagaauggguaggauggauaucacacgaaagagauaaaacagaaucagcacaaagauuuaaaggaagaguaacauuuacaagagacacaagcgcaacaacagcauauauggaacuaagaggauuaacaucagacgauacagcaauauauuacuguacaagaggaucaaaacauagacuaagagauuacguacuauaugacgauuacggacuaauaaacuaucaagaauggaaugacuaucuagaauuccuagacguauggggacacggaacagcaguaacaguaucaagc

SEQ ID NO: 47098 - RNA, 336 nt, Artificial Sequence
  derived and/or modified sequence opt6 from anti-HIV_PGT143_LightChain
gacacaguaguaacacaaucaccauuaucauuaccaguaacaccaggagaagcagcaucaaugucauguacaucaacacaaucauuaagacauucaaacggagcaaacuaucuagcaugguaucaacauaaaccaggacaaucaccaagauuacuaauaagacuaggaucacaaagagcaucaggaguaccagacagauuuucaggaucaggaucaggaacacauuucacacuaaaaauaucaagaguagaaccagaagacgcagcaauauauuacuguaugcaaggacuaaacagaccauggacauucggaaaaggaacaaaauuagaaauaaaa

SEQ ID NO: 47099 - RNA, 423 nt, Artificial Sequence
  derived and/or modified sequence opt6 from anti-HIV_PGT143_HeavyChain
caaguacaauuagaacaaagcggagcagaaguaaaaaaaccaggaucaagcguaaaaguaaguuguaaagcaagcgguaacacauucaguaaauaugacguacacuggguaagacaagcaacaggacaaggacuagaauggguaggauggaugucacacgaaggagauaaaacagaaucagcacaaagauuuaaaggaagaguaacauuuacaagagacacaagcgcaagcacagcauauauggaacuaagaggauuaacaucagacgauacagcaauauauuacuguacaagaggaucaaaacauagauuaagagauuacguacuauaugacgauuacggacuaauaaacuaucaagaauggaaugacuaucuagaauucuuagacguauggggacacggaacagcaguaacaguaucaagu

SEQ ID NO: 47100 - RNA, 336 nt, Artificial Sequence
  derived and/or modified sequence opt6 from anti-HIV_PGT144_LightChain
gauacaguaguaacacaaucaccauuaucauuaagcguaacaccaggagaagcagcaagcaugagcuguacaagcacacaaucauuaagacauagcaauggagcaaacuaucuagcaugguaucaacauaaaccaggacaaagcccaagauuacuaauaagauuaggaagccaaagagcaucaggaguaccagauagauuuucaggaagcggaaguggaacacauuucacacuaaaaauaucaagaguagaagcagacgaugcagcaauauauuacuguaugcaaggauuaaacagaccauggacauuuggaaaaggaacaaaauuagaaauaaaa

SEQ ID NO: 47101 - RNA, 423 nt, Artificial Sequence
  derived and/or modified sequence opt6 from anti-HIV_PGT144_HeavyChain
caaguacaauuaguacaaagcggagcagaaguaaaaaaaccaggaucaagcguaaaaguaagcuguaaagcaaguggaaacacauucagaaaauaugacguacacuggguaagacaagcaacaggacaaggacuagaauggguaggauggaugucacacgaaggagauaaaacagaaucagcacaaagauuuaaaggaagaguaagcuuuacaagagacaauagcgcaagcacagcauauauagaauuaagaggauuaacaucagacgauacagcaauauauuacuguacaggaggaucaaaacauagauuaagagauuacguacuauaugacgauuacggacuaauaaaccaacaagaauggaaugacuaucuagaauuccuagacguaugggggcacggaacagcaguaacaguaucaagc

SEQ ID NO: 47102 - RNA, 336 nt, Artificial Sequence
  derived and/or modified sequence opt6 from anti-HIV_PGT145_LightChain
gaaguaguaauaacacaaucaccauuauucuuaccaguaacaccaggagaagcagcaucauuaucauguaaauguucacauucauuacaacacagcacaggagcaaacuaucuagcaugguaucuacaaagaccaggacaaacaccaagacuacuaauacacuuagcaacacacagagcaucaggaguaccagacagauuuucaggaucaggaucaggaacagacuucacacuaaaaauaucaagaguagaaucagacgacguaggaacauauuacuguaugcaaggauuacacucaccauggacauucggacaaggaacaaaaguagaaauaaaa

SEQ ID NO: 47103 - RNA, 420 nt, Artificial Sequence
  derived and/or modified sequence opt6 from anti-HIV_PGT145_HeavyChain
caaguacaauuaguacaaagcggagcagaaguaaaaaaaccaggaucaagcguaaaaguaaguuguaaagcaagcggaaauucauucucaaaccaugacguacacuggguaagacaagcaacaggacaaggacuagaauggaugggauggaugucacacgaaggagauaaaacaggauuagcacaaaaauuucaaggacgaguaacaauaacaagagacucaggagcaagcacaguauauauggaacuaagaggauugacagcagacgauacagcaauauauuacugucuaacaggaucaaaacauagauuaagagauuacuuucuauauaacgaauacggaccaaauuacgaagaauggggagauuacuuagcaacacuagauguauggggacauggaacagcaguaacaguaagcuca

SEQ ID NO: 47104 - RNA, 657 nt, Artificial Sequence
  derived and/or modified sequence opt6 from anti-HIV_PGT151_LightChain
gacauaguaaugacccaaacaccucuaagccuaucagucacaccaggacaacccgcaucaauaucaugcaaaaguucagaaucacuaagacaaucaaacggaaaaacaucacucuacugguacagacaaaaaccaggucaaucaccacaacuauuaguauucgaaguaagcaacagauucucaggaguaucagacagauucguaggaucaggaucaggaacagacuucacauuaagaauaucaagaguagaagcagaagacguaggauucuacuacugcaugcaaucaaaagacuuuccauuaacauucggaggaggaacaaaaguagacuuaaaaagaacaguagcagcaccaucaguauucaucuucccaccaucagacgaacaacuaaaaucaggaacagcaucaguaguauguuuacuaaacaacuucuacccacgagaagcaaaaguacaauggaaaguagauaacgcacuacaaucaggaaacucacaagaaucaguaacagaacaagacagcaaagacucaacauacucacuaagcucaacauuaacccuaucaaaagccgacuaugaaaaacacaaaguauacgcaugcgaaguaacacaccaagguuuauccucaccaguaacaaaaucuuucaacagaggcgaaugc

SEQ ID NO: 47105 - RNA, 720 nt, Artificial Sequence
  derived and/or modified sequence opt6 from anti-HIV_PGT151_HeavyChain
agaguacaauuaguagaaucaggaggagguguaguacaaccaggaaaaagcguaagauuaucauguguaguaucagauuuccccuucucaaaauauccaauguauuggguaagacaagcaccaggaaaaggauuagaauggguagcagcaauaucaggagacgcauggcacguaguauauucaaauaguguucaaggaagauuuuuaguaucaagagacaauguuaaaaacacacuauauuuagaaaugaauagccuaaaaauagaagauacagcaguauauagaugugcaagaauguuucaagaaucaggaccaccaagauuagacagauggucaggaagaaacuauuacuauuacucaggaauggauguauggggacaaggaacaacaguaacaguaucaagcgcaucuacaaaaggaccaaguguauuuccauuagcaccaucaaguaaaucaacaucaggaggaacagcagcauuaggaugucuaguaaaagauuacuuuccagaaccaguaacaguaucauggaacucaggagcacuaacaaguggaguacauacauuucccgcaguauuacaaucaagcggacuauauagcuuaaguucaguaguaacaguaccaagcucaagccuaggcacccaaacauauauauguaacguaaaccacaaacccucaaacacaaaaguagauaaaagaguagaaccaaaaucaugugacaaa

SEQ ID NO: 47106 - RNA, 657 nt, Artificial Sequence
  derived and/or modified sequence opt6 from anti-HIV_PGT152_LightChain
gacaucguaaugacacaaacaccacuaagccuaucagucgacccaggacaaccagcaucaauaucaugcaaaucaucacaaucacuaagacaaucaaacggaaaaacaagucuauacugguaccaacaaaaaccaggccaaucaccacaacuacuaauauucgaaguaucaaacagauucucaggaguaucagacagauucgucggaucaggaucaggcacagacuucacacuaagaauaagcagaguagaagcagaagauguaggauucuauuacugcaugcaaucaaaagacuucccauuaacauucggaggcggaacaaaagucgaucuaaaaagaacagucgcagccccaucaguauuuauauucccaccaucagacgaacaacuaaaaucaggaacagcaucaguaguaugcuuacuaaacaacuucuacccaagagaagcaaaaguacaauggaaaguagacaacgcacuccaaucaggaaacucacaagaaucaguaacagaacaagacagcaaagacucaacauauucacuaucaucaacacuaacauuaagcaaagccgacuacgaaaaacacaaaguauacgcaugcgaaguaacacaccaaggacuaucaucaccaguaacaaaaucauucaacagaggagaaugc

SEQ ID NO: 47107 - RNA, 720 nt, Artificial Sequence
  derived and/or modified sequence opt6 from anti-HIV_PGT152_HeavyChain
agaguacaauuaguagaaucaggaggaggcguaguacaaccaggaaaaucaguuagauuaucauguguaguaucagauuucccauucucuaaauauccaauguacuggguaagacaagcaccaggaaaaggauuagaauggguagcagcaauaucagcagaugcauggcacguaguauauucaggaucaguacaaggaagauuucuaguaucaagagacaacaguaaaaacauacuauauuuagaaaugaacacacuaaaaauagaagauacagcaguauaucgcugugcaagaauguuucaagaaucaggcccaccaagauuugacucauggucaggaagaaacuacuacuauuauucaggaauggacguuuggggacaaggaacaacagucacugucucuucagcaucaacaaaaggaccaucuguauuuccauuagcaccaucuuccaaaucaacaucaggaggaacagcagcauuaggauguuuaguuaaagauuacuuuccagaaccaguaacagucucauggaacaguggagcuuuaacuucaggaguacauacauuuccagcaguauuacaaucaucaggacuauauucacuaagcucaguuguaacaguaccaucuucaucacuaggaacacaaacauauauauguaacguaaaccauaaaccaucaaauacaaaaguagauaaaagaguagaaccaaaaucaugugauaaa

SEQ ID NO: 47108 - RNA, 309 nt, Artificial Sequence
  derived and/or modified sequence opt6 from anti-HIV_VRC-CH30_LightChain
gacauacaaaugacacaaucaccaucaucacuaucagcaucacuaggagacagaguaacaauaacaugccaagcaucaagaggaauaggaaaagaccuaaacugguaccaacaaaaaccaggaaaagcaccaaaacuacuaguaucagacgcaucaauacuagaaggaggaguaccaucaagauucucaggaucaggauuccaccaaaacuucucacuaacaauaucaucacuacaaccagaagacguagcaacauacuucugccaacaauacgaaacauucggacaaggaacaaaaguagacauaaaa

SEQ ID NO: 47109 - RNA, 393 nt, Artificial Sequence
  derived and/or modified sequence opt6 from anti-HIV_VRC-CH30_HeavyChain
caaguacaauuaguacaaagcggagcagcaguaagaaaaccaggagcaagcguaacaguaagcuguaaauuugcagaagacgaugacuauaguccacacuggguaaauccagcaccagaacauuauauacauuucuuaagacaagcaccaggacaacaauuagaauggcuagcauggaugaacccaacaaauggagcaguaaauuacgcauggcaacuacauggaagauuaacagcaacaagagauggaucaaugacaacagcauucuuagaaguaagaucacuaagaagugaugacacagcaguauauuauugcgcaagagcacaaaaaagaggaagaagugaaugggcauaugcacauuggggacaaggaacaccaguagcaguaucaagc

SEQ ID NO: 47110 - RNA, 309 nt, Artificial Sequence
  derived and/or modified sequence opt6 from anti-HIV_VRC-CH31_LightChain
gacauacaaaugacacaaucaccaucaucacuaucagcaucacuaggagacagaguaacaauaacaugccaagcaucaagaggaauaggaaaagaccuaaacugguaccaacaaaaagcaggaaaagcaccaaaacuauuaguaucagacgcaucaacacuagaaggaggaguaccaucaagauucucaggaucaggauuccaccaaaacuucucacuaacaauaucaucauuacaagcagaagacguagcaacauacuucugccaacaauacgaaacauucggacaaggaacaaaaguagacauaaaa

SEQ ID NO: 47111 - RNA, 393 nt, Artificial Sequence
  derived and/or modified sequence opt6 from anti-HIV_VRC-CH31_HeavyChain
caaguacaauuaguacaaagcggagcagcaguaagaaaaccgggagcaagcguaacaguaagcuguaaauuugcagaagacgaugacuauaguccauacuggguaaauccagcaccagaacauuuuauacauuucuuaagacaagcaccaggacaacaauuagaauggcuagcauggaugaacccaacaaauggagcaguaaauuacgcaugguauuuaaauggaagaguaacagcaacaagagauagaucaaugacaacagcauucuuagaaguaaaaucacuaagaagugaugacacagcaguauacuauugcgcaagagcacaaaaaagaggaagaucagaaugggcauaugcacauuggggacaaggaacaccaguaguaguaucaagc

SEQ ID NO: 47112 - RNA, 309 nt, Artificial Sequence
  derived and/or modified sequence opt6 from anti-HIV_VRC-CH32_LightChain
gacauacaaaugacacaaucaccaucaucacuaucagcaucacuaggagacagaguaacaauaacaugccaagcaucaagaggaauaggaaaagaccuaaacugguaccaacaaaaaccaggaagagcaccaaaacuacuaguaucagacgcaucaauacuagaaggaggaguaccaacaagauucucaggaucaggauuccaccaaaacuucucacuaacaauaucaucacuacaagcagaagacguagcaacauacuucugccaacaauacgaaacauucggacaaggaacaaaaguagacauaaaa

SEQ ID NO: 47113 - RNA, 393 nt, Artificial Sequence
  derived and/or modified sequence opt6 from anti-HIV_VRC-CH32_HeavyChain
caaguacaauuaguacaaucaggagcagcaguaagaaaaccaggagcaucaguaacaguaagcuguaaauuugcagaagacgaugacuuuucaccacacuggguaaauccagcaccagaacacuauauacauuucuuaagacaagcaccaggacaacaacuagaauggcuagcauggaugaaaccaacaaauggagcaguaaauuacgcauggcaacuacaaggaagagucacaguaacaagagauagaucacaaacaacagcauuccuagaaguaaaaaaucuaagaucagaugacacagcaguauacuauugcgcaagagcacaaaaaagaggaagaucagaaugggcauaugcacauuggggacaaggaacaccaguaguaauaucagca

SEQ ID NO: 47114 - RNA, 309 nt, Artificial Sequence
  derived and/or modified sequence opt6 from anti-HIV_VRC-CH33_LightChain
gacauacaaaugacacaaucaccaucaucacuaucagcaucacuaggagacagaguaacaauaacaugccaagcaucaagaggaauaggaaaagaccuaaacugguaccaacaaaaaagaggaagagcaccaagacuacuaguaucagacgcaucaguacuagaaggaggaguaccaucaagauucucaggaucaggauuccaccaaaacuucucacuaacaauaucaacacuacaaccagaagacguagcaacauacuucugccaacaauacgaaacauucggacaaggaacaaaaguagacauaaaa

SEQ ID NO: 47115 - RNA, 393 nt, Artificial Sequence
  derived and/or modified sequence opt6 from anti-HIV_VRC-CH33_HeavyChain
caaguacaauuaguacaaucaggagcagcaguaagaaaaccaggagcaucaauaucaguaagcuguaaauuugcagaugcagaugacuauucaccacacuggaugaauccagcaccagaacacuauauacauuucuuaagacaagcaccaggacaacaauuagaauggcuagcauggaugaacccaacaaauggagcaguaaauuacgcaugguauuuaaauggaagaguaacagcaacaagagauagaucaaugacaacagcauuccuagaaguaagaagucuaagaucagaugacacagcaguauauuauugcgcaagagcacaaaaaagagcaagaagugaaugggcauaugcacauuggggacaaggaacaccaguaguuguaucaagu

SEQ ID NO: 47116 - RNA, 309 nt, Artificial Sequence
  derived and/or modified sequence opt6 from anti-HIV_VRC-CH34_LightChain
gacauacaaaugacacaaucaccaucaucacuaucagcaucacuaggagacagaguaacaauaacaugccaagcaucaagaggaauaggaaaagaccuaaacugguaccaacaaaaagcaggaaaagcaccaaaacuacuaguaucagacgcaucaauacuagaaggaggaguaccaucaagauucucaggaucaggauuccaccaaaacuucucacuaacaauaucaucacuacaaccagaagacguagcaacauacuucugccaacaauacgaaacauucggacaaggaacaaaaguagacauaaaa

SEQ ID NO: 47117 - RNA, 393 nt, Artificial Sequence
  derived and/or modified sequence opt6 from anti-HIV_VRC-CH34_HeavyChain
caaguacaauuaguacaaagcggagcagcaguaagaaaaccaggagcaaguguaacaguaagcuguaaauuugcagaagacgaugacuggaguccacacuggguaaauccagcaccagaacauuauauacauuucuuaagacaagcaccaggacaacaauuagaauggcuagcauggaugaacccaacaaauggagcaguaaauuacgcauggcaauuaaauggaagacuaacagcaacaagagauacaucaaugacaacagcauucuuagaaguaaaaucacuaagaagugaugacacagcaguauacuauugcgcaagagcacaaaaaagaggaagaucagaaugggcauaugcacauuggggacaaggaacaccaguaguaguaucaagu

SEQ ID NO: 47118 - RNA, 306 nt, Artificial Sequence
  derived and/or modified sequence opt6 from anti-HIV_VRC-PG04_LightChain
gaaauaguacuaacacaaucaccaggaacacuaucacuaucaccaggagaaacagcaucauuaucaugcacagcagcaucauacggacacaugacaugguaccaaaaaaaaccaggacaaccaccaaaacuacuaauauucgcaacaucaaaaagagcaucaggaauaccagacagauucucaggaucacaauucggaaaacaauacacacuaacaauaacaagaauggaaccagaagacuucgcaagauacuacugccaacaacuagaauucuucggacaaggaacaagacuagaaauaagaaga

SEQ ID NO: 47119 - RNA, 375 nt, Artificial Sequence
  derived and/or modified sequence opt6 from anti-HIV_VRC-PG04_HeavyChain
caaguacaauuaguacaaaguggaucaggaguaaaaaaaccaggagcaucaguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccagauuuuagacaaagaguaaguuuaacaagagauagagauuuauuuacagcacauauggauauaagaggauuaacacaaggagauacagcaacauauuuuugugcaagacaaaaauuuuauacaggaggacaaggaugguauuuugauuuauggggaagaggaacacuaauaguaguaaguagu

SEQ ID NO: 47120 - RNA, 303 nt, Artificial Sequence
  derived and/or modified sequence opt6 from anti-HIV_VRC-PG04b_LightChain
gaaauaguacuaacacaaucaccaggaacacuaucacuaucaccaggagaaacagcaucacuaucaugcacagcagcaucauacggacacaugacaugguaccaaaaaaaaccaggacaaccaccaaaacuacuaauauucgcaacaucaaaaagagcaucaggaauaccagacagauucucaggaucacaauucggaaaacaauacacacuaacaauaacaagaauggaaccagaagacuucgcaggauacuacugccaacaaguagaauucuucggacaaggaacaagacuagaaauaaga

SEQ ID NO: 47121 - RNA, 375 nt, Artificial Sequence
  derived and/or modified sequence opt6 from anti-HIV_VRC-PG04b_HeavyChain
caaguacaauuaguacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 47122 - RNA, 612 nt, Artificial Sequence
  derived and/or modified sequence opt6 from anti-HIV_VRC-PG20_LightChain
caaucagcacuaacacaaccaccaucaguaucaggaucaccaggacaaucaauaacauuaucaugcaccggcgcaucaacaucagucgcaugguaccaacaauacgcagacaaagcaccaagacuaauaguauucgacggaaacaaaagaccaucagacauauccucaagauucucaggaucacaaucaggaggaacagcaucacuaacaaucucaggacuacaaucagaagacgaagcauacuaccauugcaacgcauucgaauucuuuggaggaggaacaaaacucacaguacuaucacaaccaaaagcagcaccauccguaacacuauucccaccaucaucagaagaacuacaagcaaauaaagcaacacuaguaugccuaauaucagacuucuaccccggagcagucacaguagcauggaaagccgacuccucaccaguaaaagcaggagucgaaaccacaacaccauccaaacaaucaaauaacaaauacgcagcaucaucauaccuaucacuaacaccagaacaauggaaaucacacaaaucauacucaugccaaguaacacaugaaggaucaacagucgaaaaaacaguagcacccacagaaugc

SEQ ID NO: 47123 - RNA, 681 nt, Artificial Sequence
  derived and/or modified sequence opt6 from anti-HIV_VRC-PG20_HeavyChain
gaaguacacuuaaugcaaucaggaacagaaaugaaaaaaccaggagcauccguaagaguaacaugccaaacaucaggauacacauuuucagacuacuucauacacuggcuaagacaaguaccaggaagaggauuugaauggaugggauggaugaacccacaauggggacaaguaaauuacgcaagaacauuucaaggaagaguaacaaugacaagagacguauacagagaaguagcauacuuagacuuaagaucauuaacauucgcagacacagcaguauacuuuugcgcaagacgaaugagaucacaagaccgagaaugggacuuucaacacuggggucaaggaacaagaauaauaguaaguucagcaucaacaaaaggaccaucaguauuuccauuagcaccaucaagcaaaucaacaucaggaggcacagcagcauuaggaugccuaguuaaagacuacuucccagaaccaguaacaguaucauggaacucaggagcauuaacaucaggaguacacacauucccagcaguacuacaaucaucaggucuauauucacuaucaagcguaguaacaguaccaucaucaucacuaggaacacaaacauacauaugcaacguaaaccacaaaccaucaaauacaaaaguagauaaaaaaguagaaccaaaaucaugcgacaaa

SEQ ID NO: 47124 - RNA, 1059 nt, Artificial Sequence
  derived and/or modified sequence opt6 from anti-HIV_VRC-PG20_G-Chain
guauggaaagacgcagacacaacucuauucugugcaucagaugccaaagcucacgaaacagaaguacauaauguaugggcuacacacgcaugcguacccaccgacccaaauccacaagaaauacacuuagaaaacguaacagaaaacuucaauauguggaaaaacaauaugguagaacaaaugcaagaagauguaauaucacucugggaccaaucacuucaaccaugugugaaauuaacaggaggaagcguuauaaaacaagcauguccaaaaauaucauucgauccaauaccuauacacuacugcacaccagcaggauacguaauacuaaaaugcaacgacaaaaacuucaacggaacaggaccaugcaaaaacguaucauccguacaaugcacacauggaauaaaaccaguaguaucaacacaacuacuacuaaauggcagcuuagcagaagaagaaauuauaauaagaucagaaaaccuaacaaacaacgcaaaaacaauaauaguacaccuaaauaaaagcguagaaauaaacuguacuagaccaucaaauggaggaagcggaaguggaggugacauaaggaaagcauacugugaaauaaacggaacaaaauggaacaaaguacuaaaacaaguaacagaaaaacuaaaagaacacuuuaacaacaaaacaauaauauuccaaccaccaucaggaggcgaccuagaaauaacaaugcaccacuucaacugcagaggagaauuuuucuacugcaauacaacacaacuauucaacaacacaugcauaggaaacgaaacaaugaaaggaugcaacggaacaauaacacuaccaugcaaaauaaaacaaaucauaaacauguggcaaggaacaggacaagccauguacgccccaccaauagauggaaaaauaaacuguguaagcaacauaacaggaauacuacuaacacgagacggcggagcaaacaacacaucaaacgaaacauucagaccaggaggaggaaacaucaaagacaacuggagaucagaacuauacaaauacaaaguaguacaaaucgaa

SEQ ID NO: 47125 - RNA, 312 nt, Artificial Sequence
  derived and/or modified sequence opt6 from anti-HIV_VRC02_LightChain
gaaauaguacuaacacaaucaccaggaacauuaagccuaagcccaggagaaacagcaauaauaagcuguagaacaagucaauacggaucauuagcaugguaccaacaaagaccaggacaagcacccagauuaguaauauauagcggaagcacaagagcagcaggaauaccagacagauucagcggaucaagauggggaccagacuauaacuuaacaauaagaaaucuagaaagcggagacuuuggauuauacuauugccaacaauaugaauuuuucggacaaggaacaaaaguacaaguagauauaaaaaga

SEQ ID NO: 47126 - RNA, 363 nt, Artificial Sequence
  derived and/or modified sequence opt6 from anti-HIV_VRC02_HeavyChain
caaguacaauuaguacaaucaggaggacaaaugaaaaaaccaggagaaaguaugagaauaucaugucaagcaaguggauaugaauuuauagauuguacauuaaauuggguaagauuagcaccaggaagaagaccagaauggaugggaugguuaaaaccaagaggaggagcaguaaauuaugcaagaccauuacaaggaagaguaacaaugacaagagauguauauagugauacagcauuuuuagaauuaagaagucuaacagcagaugauacagcaguauauuauuguacaagaggaaaaaauugugauuauaauugggauuuugaacauuggggaagaggaacaccaguaacaguaaguagu

SEQ ID NO: 47127 - RNA, 309 nt, Artificial Sequence
  derived and/or modified sequence opt6 from anti-HIV_VRC03_LightChain
gaaauaguacuaacacaaucaccaggaauauuaagcuuaagcccaggagaaacagcaacauuauucuguaaagcaagccaaggaggaaacgcaaugacaugguaucaaaaaagaagaggacaaguaccaagauuacuaauauacgauacaucaagaagagcaucaggaguaccagauagauuuguaggaagcggaagcggaacagauuucuuucuaacaauaaauaaauuagacagagaagauuucgcaguauauuacugucaacaauucgaauucuuuggauuaggaucagaauuagaaguacacaga

SEQ ID NO: 47128 - RNA, 390 nt, Artificial Sequence
  derived and/or modified sequence opt6 from anti-HIV_VRC03_HeavyChain
caaguacaauuaguacaaaguggagcaguaauaaaaacaccaggaaguaguguaaaaauaaguuguagggcaaguggauauaauuuuagagauuauaguauacauuggguaagauuaauaccagauaaaggauuugaauggauaggauggauaaaaccauuauggggagcaguaaguuaugcaagacaauuacaaggaagaguaaguaugacaagacaauuaagucaagauccagaugauccagauuggggaguagcauauauggaauuuaguggauuaacaccagcagauacagcagaauauuuuuguguaagaagaggaucaugugauuauuguggagauuuuccauggcaauauuggggacaaggaacaguaguaguaguaaguagu

SEQ ID NO: 47129 - RNA, 630 nt, Artificial Sequence
  derived and/or modified sequence opt6 from anti-HIV_VRC23_LightChain
gaaauaguaaugacacaaagcccaguaacaguuagcguaagcagaggaggaacagcaacuuuaagcugucgagcaagccaaggaguaggcucagacguagcaugguaccaacacaaacccggacaaacaccaagauuauuaauauauggagcaaguacacgugcaagcggaguaccagaaagauucucaggaucaggauuucacguagauuuuacauuaucaauaagcggacuacaaccagaagacguagcaauauacuauugccaacaauacgaaacauucggacaaggaacaaaaguagaaauaaaaagaacaguagcagcaccaagcguauucauauucccacccucagacgaacaauuaaaaucaggaacagccucaguaguaugccuacuaaauaacuuuuacccaagagaagcaaaaguacaauggaaaguagauaacgcacuacaaucaggaaacucacaagaaagcguaacagaacaagauagcaaagacucaacauauagcuuaaguucaacacuaacauuaagcaaagcagauuacgaaaaacauaaaguauacgcgugcgaaguaacacaccaaggauuaagcucaccaguaacaaaaucauuuaacagaggagaaugc

SEQ ID NO: 47130 - RNA, 672 nt, Artificial Sequence
  derived and/or modified sequence opt6 from anti-HIV_VRC23_HeavyChain
gaaguacaauuuguacaaucaggagcagaaguaaaaaaaccaggagcaucaguaagagucucaugugaagcaucaggauacucauucacugacuacguacuacaauggauaagacaagcaccaggacaaagaccagaauggaugggauggauaaaaccagaaagaggagcaguuucauacgcaccacaauuucaaggacgauuaacauuaacaagagacuuauacacagaaacagccuauaugcacuucaaaaacuuaagaucagacgauacagccauauauuacugugccagaggaguaagaagagacgcaucauggugguuacaauuuuggggccaaggaacauuaguaacaguaucaucagcaucaacaaaaggaccaucaguauuuccacuagcaccaucaucaaaaucaacaucaggaggaacagcagcacuaggcuguuuaguaaaagacuacuucccagaaccaguaacaguaucauggaauucaggagcauuaacaagcggaguacauacauuuccagcaguacuacaaucaucaggacuauacucauuaucaagcguaguaacaguaccaucaucaucacuagguacacaaacauauauauguaacguaaaccauaaaccaucaaacacaaaaguagauaaaaaaguagaaccaaaaucaugc

SEQ ID NO: 47131 - RNA, 1077 nt, Artificial Sequence
  derived and/or modified sequence opt6 from anti-HIV_VRC23_G-Chain
gucuggagagacgcagacaccacacuauucugcgcaagcgacgcaaaagcauaugaaacagaaaaacacaacguaugggcaacacaugcaugcguaccaaccgauccaaacccacaagaaauacacuuagacaacguaacagaaaaauucaauauguggaaaaauaacaugguagaacaaaugcacacagauauaauaucacuaugggaccaaucauuaaaaccuuguguaaaacuuacaggaggaagcgcaauaacccaagcaugcccaaaaguaucauucgaaccaauaccaauacacuacugcacgcccgcaggauuugcaauacuaaaauguaaagacgaaggauuuaauggaaccggauuaugcaaaaacguaucaacaguacaaugcacacacggaauaaaaccaguaguaucaacacaacuacuacuaaacggaucacuagcagaaaaaaacauaacaaucagauccgaaaauauaacaaacaacgcaaaaauaauaauaguacaacucguacaaccaguaacaauaaaauguauaagaccaaacaacggcggcucaggaucaggaggugauauaagacaagcacacugcaauguaaccagaucaagauggaauaaaacacuccaagaagucgcagaaaaacuaagaacauacuucggaaacaaaacaauaauauucgcaaacagcucaggaggagaccucgaaauaacaacacacaguuucaauugcggcggcgaauuuuucuauugcaauacaagcggauuauucaacuccacaugguacguaaacagcacauggaacgacacagacuccacacaagaaucaaaugauaccauaaccuuacccugcagaauaaaacaaauaauaaauauguggcaacgagcaggccaagcaauguacgcuccacccauacccggagucauaaaaugcgaaucaaacauaacaggauuacuacuaacacgagacggaggaaaagacaacaacguaaacgaaacauucagaccaggaggaggagacaugagagacaacuggagaucagaacuauauaaauacaaaguaguagaaaucgaa

SEQ ID NO: 47132 - RNA, 648 nt, Artificial Sequence
  derived and/or modified sequence opt6 from anti-HIV_5CCK_LightChain
caaucagcacuaacacaaccagcaucaguaucagcaucacccggacaaucaauaacaauaucaugcucaggaacaagaucagacguaggaggauacgacuucgucucaugguaccaacaacacccaggaaaaguaccaaaacuaauaauauacgaaguaacaaaaagaccaucaggaaucccacaaagauucucaggaucaaaaucaggaaacacagcaucacuaacaauaucaggacuacaagcagacgacgaagcagacuacuacugcugcucauaugcaaacuacgacaaacuaauacuagguggaggaacaaaacuaaccguacuuggacaaccaaaagcaaacccuacaguaacauuauucccaccaucaucagaagaacuacaagcaaacaaagcaacacuaguaugcuuaauaucagacuucuacccaggagcagucacaguugcauggaaagcagacggauccccaguaaaagcagguguagaaacaacaaaaccaucaaaacaaucaaacaacaaauacgcagcaucaucauacuuaucacuaacaccagaacaauggaaaucacacagaucauacagcugccaaguaacccacgaaggaucaacaguagaaaaaacaguagcaccaacagaaugcuca

SEQ ID NO: 47133 - RNA, 696 nt, Artificial Sequence
  derived and/or modified sequence opt6 from anti-HIV_5CCK_HeavyChain
caaguacaauuaguacaaaguggagcugaaaugaaagauccaggagcaucaguaaaaguaucauguagagcaaguggauauaaauuuacagauuacuauaugcauuggguaagacaagcaccaggacaaggauuagaauggguaggauggguaaauacaaauggaggauuuacaaaauauggagcaaaauuucaaggaagaguaacaguaacaagagauacaucaacaaauacaguauuuuuagaauuaucaagauuaacauuuggagauacagcaauguauuuuugugcaagaccaaugcguccaguaucacaugggauugauuauucuggauuauuuguauuucaauuuuggggaagaggaacaaugguaacaguaaguucagcaucaacaaaaggaccaagcguauuuccacuagcaccaucaaguaaaagcacaagcggaggaacagcagcacuaggauguuuaguaaaagauuauuuuccagaaccaguaacagucucauggaauucuggagcacuaacaucaggagugcacacauuuccagcaguguuacaaucaucagguuuauauucacuaucaaguguaguaacaguaccaagcucaucauuaggaacacaaacauauauauguaauguaaaucauaaaccuucaaauacaaaaguagauaagaaaguagaaccaaaaucaugugau

SEQ ID NO: 47134 - RNA, 648 nt, Artificial Sequence
  derived and/or modified sequence opt6 from anti-HIV_5AWN_LightChain
caaagcguacucacacaaccagcaucaguaucagcaucacccggacaaucaauaacaguaucaugcacaggaucaagaaaugacguaggaggauacgauuucguaaguugguaccaacgacauccaggaggaguaccaaaacuaauaauauaugaaauauccaaacgaccgaguggcauaccacaaagauucucaggaucaagaucgggaaauacagcaaguuuaacaauaagcggacuacaagaugaugaugaagcagacuacuauugcuguucauacgcaucauacgauagauuaauauuuggaggagguacacgaguaagcguauuaagacaaccaaaagcagcaccgucaguaacauuauucccaccaucaagcgaagaauuacaagcaaacaaagcaacacuaguaugcuuaauaucagacuucuauccaggagcaguaacaguagcauggaaagccgauggaucaccaguaaaagcaggaguagaaacgacaaaaccaucaaaacaaagcaauaacaaauacgcagcaucaaguuacuuaucauuaacaccagaacaauggaaaucacacagaucauauaguugucaaguaacacaugaagggagcacaguagaaaaaacaguagcaccaacagaauguagc

SEQ ID NO: 47135 - RNA, 696 nt, Artificial Sequence
  derived and/or modified sequence opt6 from anti-HIV_5AWN_HeavyChain
caaguacaacugaugcaaaguggagcacaacuaagagauccaggagacucauuaaaaauaucaugcaaagcaagcggauauaacuuuauagacuaucauauacauuggguaagauuagcaccaggaagaggauuagaauggaugggauggauagacccaguaggaggaauaacaaaauacgcaggacaauuccaaggaagauuaucauuaacaagagauacaucaacaaauacauuauuccuagaauuaucaagauuaacagcaggagauaccgcaguauacuuuugugcacgaucaaugagaccaguagaucauggaauagacuauucaggauuauuuguauuucacuuuuggggaagaggaucagauguacuaguaaguucagcaucaacaaaaggaccaucaguauuuccauuagcuccaagcaguaaaucaacaaguggaggaacagcagcauuaggaugucuaguaaaagauuauuuuccagaaccaguuacaguuucauggaacaguggagcauuaacuucaggaguacauacauuuccagcuguauuacaaucaagcggacuauacucauuaucaaguguaguaacaguuccaucaucaucacuaggaacacaaacauauauaugcaacguaaaccauaaaccaucaaauacaaaaguagacaaaaaaguagaaccaaaaucaugugau

SEQ ID NO: 47136 - RNA, 645 nt, Artificial Sequence
  derived and/or modified sequence opt6 from anti-HIV_3QEG_LightChain
gaaauaguaaugaugcaaucaccaggaacacuaucacuaucaccaggagaaagagcaacacuaucaugcagagcaagccaaucagucucaucaucauaccuagcaugguaccaacaaaaaccaggacaagcaccaagauuauuaauauacggagcaucaucaagagcaacaggaaucccagacagauucucaggaucaggaucaggaaccgacuucacccuaacaauaucaagacuagaaccagaagacuucgcaguauacuacugccaacaauacggcucuagcccagaaacauucggacaaggaacaaaaguagaaauaaaaagaacaguagccgcaccaucaguauucauauucccaccaucagacgaacaauuaaaaucaggaacagcaucagucguaugccuauuaaacaacuucuacccaagagaagcaaaaguacaauggaaaguagacaacgcccuacaaucaggcaacucacaagaaagcguaacagaacaagauucaaaagacucaacauacucacuaucaucaacauuaacacuaucaaaagcagacuacgaaaaacacaaaguauacgcaugcgaaguaacucaccaaggacuaucaucaccaguaacaaaaucauucaaccgaggcgaaugc

SEQ ID NO: 47137 - RNA, 717 nt, Artificial Sequence
  derived and/or modified sequence opt6 from anti-HIV_3QEG_HeavyChain
caaguacaacuaguacaaucaggagcagaaguaaaaaaaccaggcucaucaguaaaaguaucaugcagagcaucaagaggaacauucagcucauauggaauaacaugggucagacaagcaccaggacaaggauuagaauggaugggaggaauaauaccaauauuugacgucacaaauuacgcacaaaauuuccaaggaagagucgcaauaacuacagaugcagaaaugucaacagcauacauggaacuuagaucacuaaaaucagaagacucagcaguuuacuauugcgcuucagauaguagagacuuuucauauuacgaaccaggaacaaguuacucacacuauuacaauauaauggacguauggggacaaggcacaacaguaacaguaucaucagcauccacaaaaggaccaucuguauuuccacuagcuccaucaucaaaaucuacaucaggaggaacagcagcucuuggcugucuaguuaaagauuacuuuccagaaccaguaacaguaucauggaacucaggagcauuaacaucaggaguacauacauuuccagcaguauuacaaucaucaggauuauauucacuaucaucaguaguaacagucccaucaucaucacucggaacacaaacauauaucugcaacguaaaccauaaaccaucaaauacaaaaguagauaaaagaguagaaccaaaaucaugugacaaaacacau

SEQ ID NO: 47138 - RNA, 690 nt, Artificial Sequence
  derived and/or modified sequence opt6 from anti-HIV_1N0X_K-Chain
caaguacaacuaguacaaucaggagcagaaguaaaaaaaccaggagcaucaguaaaaguaucaugucaagcaagcggauacagauucucaaacuuuguaauacacuggguaagacaagcaccaggacaaagauucgaauggaugggauggauaaauccauauaacgguaacaaagaauucucagcaaaauuucaagauagaguaacauuuacagcagacacaucagcaaacacagccuauauggaacuaagaucauuaagaucagcagauacagcaguauauuacugugcacgaguagguccauauucaugggacgauucaccacaagauaacuauuauauggacguauggggaaaaggaacaacaguaauaguaucaucagcuucaacaaaaggaccaucaguauuuccauuagcaccuagcucaaaaucuacaucaggaggaacagccgcauuaggaugucuaguaaaagauuacuuuccagaaccaguaacaguaucauggaacucaggagcucuaacaagcggaguacauacauuuccagcaguauuacaaucaagcggauuauauagccuaucaucuguaguaacaguaccaucaucaucauuaggaacacaaaccuauauauguaacguaaaccacaaaccaucaaauacaaaaguagauaaaaaaguagaaccaaaaucaugu

SEQ ID NO: 47139 - RNA, 645 nt, Artificial Sequence
  derived and/or modified sequence opt6 from anti-HIV_1N0X_M-Chain
gaaaucguauuaacacaaagcccaggaacauuaucacuaucaccaggugaaagagcaacauucucaugcagaucaucacacucaauaagaagcagaagaguagccugguaucaacacaaaccuggacaagcaccaagauuaguaauacacggcguaucaaacagagcaucaggaauaucagauagauuuucaggaucaggcagcggaacagacuucacccuaacaauaacaagaguagaaccagaagacuucgcacuauacuacugccaaguauacggagcaagcucauacacauucggacaaggaacaaaacuagaaagaaaaagaacaguagcagcaccaucaguauucauauucccaccaucagacgaacaacuaaaaucaggaacagcaucaguaguaugccuauuaaacaacuucuacccaagagaagcaaaaguucaauggaaaguagacaaugcacuacaaaguggaaacucacaagaaucaguaacagaacaagacucaaaagacucaacauauaguuuaagcucaacauuaacauuaucaaaagcagauuacgaaaaacacaaaguauacgcaugcgaaguaacacaccaaggauuaagaucaccaguaacaaaaucauucaacagaggagaaugc

SEQ ID NO: 47140 - RNA, 654 nt, Artificial Sequence
  derived and/or modified sequence opt6 from anti-HIV_3QEH_HeavyChain
gacauaguaaugacacaaucaccacuaucacuaccaguaacaccaggagaagccgcauccauauccugcagauccucccaaucauuacuacauacaaacggauuccaauaccuagacugguaccuacaaaaaccaggacaaucaccacaacuacucauauaccuaggaucaaacagagcaacaggaguaccacacagauucucaggaucaggaucagguacagaauucacacuaaaaauaucaagaguagaagcagaagacguaggaguauacuacugcaugcaagcaaaagaaucaccaacauucggacaaggaacaaaaguagaaauaaaaagaacaguagcagccccaucaguauucauauucccaccauccgacgaacaauuaaaaucaggcacagcaucaguaguaugccuacuaaacaacuucuacccaagagaagcaaaaguacaauggaaaguagacaacgcacuacaaucaggaaacucacaagaaucaguaacagaacaagacuccaaagacucaaccuacucacuauccucaacacuaacacuaucaaaagcagacuacgaaaaacacaaaguauacgcaugcgaaguaacacaccaaggacuaucauccccaguaacaaaaucauucaacagaggagaaugc

SEQ ID NO: 47141 - RNA, 696 nt, Artificial Sequence
  derived and/or modified sequence opt6 from anti-HIV_3QEH_G-Chain
caaguccaauuaguacaaucaggagccgaaguaagaaaaccaggagcaucaguaacagucuccugcaaaacaucuggcuacacauucguaaacuucuacauaguauggguaagacaagcaccaggacaaggacuagaauggaugggaguaauaaacccauucagaggagacacauacuuugcacaaaaauuuaaaggaagaguaacacuaacaagagacacaucaaccucaacaguauucauggaacuaaguucacuaagaagugacgacacagcaauauacuacugcgcaagagaccuagaaaugcgagacggaaacaaccacggaucacaccuagaauuuuggggacaaggaacucuaguaacaguaucaucagcaucaacaaaaggcccaucaguauucccacuagcaccuucaagcaaaucaacaagcggaggaacagcagccuuaggaugcuuaguaaaagacuacuucccagaaccaguaacaguauccuggaacucaggagcacuaacaucaggaguccauacauucccagcaguacuacaaucaucaggauuauacucauuaucaucaguaguaacaguaccaaguucaagccuaggaacacaaacauacauaugcaacguaaaccacaaaccaucaaacacaaaaguagacaaaagaguagaaccaaaaucaugcgacaaaacacac

SEQ ID NO: 47142 - RNA, 678 nt, Artificial Sequence
  derived and/or modified sequence opt6 from anti-HIV_2B1H_HeavyChain
gaaauacaacuagaacaaagcggagcugaaguaaaaaaaucaggcgaaagccuaaaaauaucaugccaaacaucaggauauucauuuucagauuacuggauaggcuggguuagacaaaugccaggaaaaggauuagaauggaugggaauauuuuaucccggagauucagauucaagauacaguccaucauucgaaggacaaguaacaaugucagcagauagaaguacaaauacagcacacuuacaauggucaaguuuaaaaccaagcgacacagcauuauacuacugcgcaagauuaggaggagacuaugaagauucaggagcagaugcauuugacuuuuggggacaaggaacacuuguaacaguaucaucagcaaguacaaaaggaccaucaguauuuccacuagcaccaucaucaaaaaguacaucaggaggaacagcagcuuuaggaugucuaguaaaagauuacuuuccagaaccaguaacaguaaguuggaacucaggagcacuaacaucaggaguacauacauuuccagccguauuacaaucaucaggacuauauucauuaucaucaguaguaacaguaccaucaucaucacuaggaacacaaaccuauauauguaacguaaaccacaaaccaucaaauacaaaaguagauaaaaaaguagaaccaaaauca

SEQ ID NO: 47143 - RNA, 645 nt, Artificial Sequence
  derived and/or modified sequence opt6 from anti-HIV_2B1H_LightChain
caaucuguacuaacacaaccaccaucagcaucaggaacaccuggacaaagaauaucaaucucaugcucaggaacaucauccaacgucgaaaacaacuacgucuacugguaccaacacuuaccaggcacagcaccaaaacuacuaauauacagaaacgaccacagaucaucaggcauaccagacagauucagcgcaucaaaaucaggaacaucagcaucacuagcaauaucaggacuaagaccugaagacgaaggagacuacuacugcgcagcaugggacgacucacgcggaggaccagacuggguauucggaggaggaacaaaauuaacaguacuagcacaaccaaaagcagccccauccguaacacuauucccacccucaucugaagaauuacaagcaaacaaagcaacacuaguaugcuuaauaucagacuucuauccaggagcaguaacaguagcauggaaagcagacucaucaccaguaaaagcaggaguagaaacaacaacaccaucaaaacaauccaacaauaaauacgcagcaucaucuuaccuaucacuaacaccagaacaauggaaaucacacaaaucauacagcugccaaguaacacacgaaggaucaacaguagaaaaaacaguagcaccaaca

SEQ ID NO: 47144 - RNA, 648 nt, Artificial Sequence
  derived and/or modified sequence opt6 from anti-HIV_3TNM_B-Chain
caaucaguacuaacccaaccaccaucagcaucaggaucaccaggacaaucaguaacaauaucuugcacaggaacaucaucagacguaggaggauacaauuacguaucaugguaccaacaccacccaggaaaagcuccaaaacuaauaauauccgaaguaaauaacagaccaucuggagucccagacagauucucaggaucaaaaucaggaaacacagcaucacuaacaguaucaggauuacaagcagaagacgaagccgaauacuacugcucaucauacacagacauacacaacuucguauucggaggaggaacaaaauuaacaguacuaggacaaccaaaagcagcaccaucaguaacacuauucccaccaucaucagaagaacuacaagcaaacaaagcaacacuaguaugccuaauaucagacuucuaccccggcgcaguaacaguagcauggaaagcagacucaucaccuguaaaagcaggcguagaaacaacaacaccaucaaaacaaucaaacaacaaauacgcagcaucaucauaccuaucacucacaccagaacaauggaaaucacaccgaucauacucaugccaaguaacacacgaaggaucaacaguagaaaaaacaguagcaccuacagaaugcuca

SEQ ID NO: 47145 - RNA, 693 nt, Artificial Sequence
  derived and/or modified sequence opt6 from anti-HIV_3TNM_A-Chain
caaguacaauuacaagaaucaggaccaggccuagucaaaccaucacaaacacuaucacuuucaugcacagucucaggaggaucaucaucauccggagcacauuacuggucauggauaagacaauacccaggaaaaggccuagaauggauaggauauauccauuacucaggaaauacauauuacaauccaucacuaaaaucacguauaacaauaucacaacauacaucagaaaaucaauucucacuaaaauuaaacucaguaaccguagcagacacagcaguauacuacugcgccagagguacaagauuaagaacacucagaaaugcauucgauauauggggucaaggaacaaugguaacaguaucaucagcuucaacuaaaggaccaucaguauucccacuagcucccucaucuaaaucaacaucaggaggaacagcagcacuaggaugucuagucaaagacuacuuuccagaaccaguaacaguuucauggaacucaggagcacuaacaucaggaguacauacauuuccagcaguauuacaaucaucaggauuauacucauuaucaucaguaguaacaguaccaucaucaucacuaggcacacaaacauauauauguaauguaaaccauaaaccaucaaacacaaaaguagacaaaagaguagaaccaaaaucaugugacaaaacacauaca

SEQ ID NO: 47146 - RNA, 690 nt, Artificial Sequence
  derived and/or modified sequence opt6 from anti-HIV_3UJJ_HeavyChain
gaaguacaacuaguacaaucaggagcugaaguuaaaaaaccaggagaaucauuaaaaauaucaugcaaagcaucaggauauucauuuagcucauacuggauagccuggguuagacaaaugccuggaaaaggacuagaauggaugggauucauauacccagcagauucagacacaagauacucaccaucauuccaaggacaaggaacaauaucagcagauaaaucaauaucaacagcauacuuacaauggucaucacuaaaagcaucagacacagcaauguacuauugugcaauauuaggcuuuuggggagcaaacagaggaggcgguggcauggacguauggggacaaggaacaacaguaauaguaucuucagcaucaacaaaaggaccaaguguauuuccauuagccccaucaucuaaaucaacaucaggcggaacagcugcauuaggaugucuaguaaaagauuacuuuccagaaccaguaacaguaucauggaacucaggagcacuaacaucaggaguacauacauucccagcaguauuacaaucuucaggacuauauucacuaucaucuguaguaacaguaccaucaagcucacuaggaacacaaacauauauauguaacguaaaccauaaaccaucaaauacaaaaguagauaaaaaaguugaaccaaaaucaugugacaaaaca

SEQ ID NO: 47147 - RNA, 639 nt, Artificial Sequence
  derived and/or modified sequence opt6 from anti-HIV_3UJJ_LightChain
ucauacgaacuaacccaaccaccaucaguaucaguaucaccaggacaaacagcaagaauaacaugcucaggagaugcccuaccagaaaaauaugcauacugguaccaacaaaaaucaggacaagcaccaguacuaauaauauacgaagacucaaaaagaccaucaggaauaccagaaagauucucaggaucaagaucagguaccauggcaacauuaacaauaucaggagcacaaguagacgacgaagcagacuacuacugcuacucaacaaacucagguggaacauucuucguauucggaacaggaacaaaaguaacaguauuaggacaaccaaaagcaaacccaacaguaacacuauucccaccaucuucagaagaacuacaagcaaauaaagcaacacuaguaugccuaauaucagauuucuacccaggagccguaacaguagcauggaaagcagacucaucaccaguaaaagcaggaguagaaaccacaacaccauccaaacaaucaaacaacaaauacgcagcaucauccuaccuaucauuaacaccagaacaauggaaaucacacagaucauacucaugccaaguaacacacgaaggaucaacaguagaaaaaacaguagccccaacagaaugc

SEQ ID NO: 47148 - RNA, 669 nt, Artificial Sequence
  derived and/or modified sequence opt6 from anti-HIV_3UJI_HeavyChain
caaguacaacuaguacaaucagcagcagaaguaaaaaaaccaggagaagcacuaaaaauaucaugcaaaggaucaggauacucauucucaaauuauuggauagcauggguaagacaaaugccaggaaaaggauuagaauggaugggaauaguuuacccagaugacucagacucaucauacaacagcucauuucaaggacaaauaacauucucagcagacaaaucaauaucaaccgcauaccuacacuggacaucacuacaagcaucagacacagccauguacuacugcgcacgacuaggauuugaaggagacuacucaggaucuuucuuugacuauuggggacaaggaacauuacuaauaguaucaucagcaucaacaaaaggaccaucaguauuuccacuagcacccucaucaaaaucaacuucaggaggaacagcagcacuaggaugccuaguaaaagacuacuucccagaaccaguaacaguaucauggaacucaggagcacuaacaucaggaguacacacauucccagcaguacuacaaucaucaggacuauacucacuaucaucaguaguaacaguaccaucaucaucucuaggaacacaaacauacauaugcaacgucaaccacaaaccaucaaauacaaaaguagacaaaaaaguagaacca

SEQ ID NO: 47149 - RNA, 627 nt, Artificial Sequence
  derived and/or modified sequence opt6 from anti-HIV_3UJI_LightChain
ucauacgaauuaacacaaccaccaucaguaucaguaucaccaggacaaacagcaucaaucacaugcucaggagauauacuaggagacaaauacguaucaugguaccaacaaaaaucaggacaaucaccacuauuaguaauauacgaagacacuaaaagaccaucaggaauaccagacagauuuucaggcucaaaaucuggaaacacagcaacacuaacaauaucaggaacacaagcaauggacgaagcagacuacuacugccaagcaugggacucaacacuaggcguaguauucggaggaggaacaaaaguaacaguccuaggacaaccaaaagcagcaccauccguaacacuauucccacccucauccgaagaacuacaagcaaacaaagcaacacuaguaugcuuaauaucagacuucuaccccggagcaguaacaguagcauggaaagcagacucaucaccaguaaaagcaggaguagaaacaacaacacccucaaaacaaucaaacaacaaauacgcagcaucaucauaccuaucauuaacaccagaacaauggaaaucacacaaaucauauucaugccaaguaacacacgaaggaucuacaguagaaaaaacaguagcacca

SEQ ID NO: 47150 - RNA, 666 nt, Artificial Sequence
  derived and/or modified sequence opt6 from anti-HIV_2QSC_HeavyChain
caaguacaauuaguacaaucaggaggaggccuaguucaaccaggaggaucacuaagauuaucaugcgcagcauucggauucaauuucucaucauauguaaugcacuggguaagacaagcaccaggacaaggacuagaauaccuaucagcaauaucaucagauggagaaacaacauaccacgcaaacucaguaaaaggaagauuuacaagcuccagagacaacucuaaaaacacacuauuccuacaaaugggaucauuaagaacagaagacgucgcaguauauuacugcgcaagagacagauacuaugaaacaucaggaucaaaugcauuugacguauggggacaaggaacaaugguaguaguaucaucagcaucaacaaaaggaccaucaguauuuccccuagcaccaugcucaagaucaacaucagaaagcacugcagcacuaggaugcuuaguaaaagauuauuuccccgaaccaguaacaguauccuggaacucaggagcucuaacauccggaguacacacauucccagcaguauuacaaucuucaggucuauauucauuaucaucaguaguaacaguaccaucaucaaacuucggaacucaaacuuauacauguaauguagaccauaaaccuucaaauacaaaaguagacaaaacaguagaa

SEQ ID NO: 47151 - RNA, 645 nt, Artificial Sequence
  derived and/or modified sequence opt6 from anti-HIV_2QSC_LightChain
aacucaguacuaacacaaucaccaucaucucuaucagcaucaguaggagacagaguaacaauaacaugccaagcaucacaagacauaucaaacuacuuaaacugguaucaacacaaaccaggaaaagccccaaaacuauuaauauacacagccucaaaccuagaaacaggaguaccaucaagauucucaggaggaggaucaggaacacacuucucauucacaauaacaucccuccaaccagaagacgcagcaacauacuucugccaacaauacgacaacuuaggagaccuaucauucggaggaggaacaaaaguagaaauaaaacgaacaguagccgcaccaucaguauucauauucccacccucagacgaacaacuaaaaucaggaacagcuucaguaguaugccuacuaaacaacuucuacccacgcgaagccaaaguacaauggaaaguagacaacgcacuacaaucaggaaacucacaagaaucaguaacagaacaagacucaaaagacucaacauacuccuuaucauccacacuaacacuaucaaaagcagacuacgaaaaacacaaaguauacgccugcgaagucacacaccaaggacuaucaucaccaguaacaaaaucauucaacagaggagaaugc

SEQ ID NO: 47152 - RNA, 690 nt, Artificial Sequence
  derived and/or modified sequence opt6 from anti-HIV_3MLZ_HeavyChain
caaguacaacuacaagaaucaggaccaggacuaguaaaaccaucagaaacacuaucauuaacaugcacaguaucaggaggcucaauaucaggauuucacuggucauggauaagacaaccaccaggaaaaggacuagaauacauaggauacauauacuauuccggaucaaccucauacaauccaucacuaaaaucaagaguaucaaugucaguagauacaucaagaaaucaauuuucacuagaacuauccucagucacagcagcagacacagcaguauacuauugcgcaagagacuucggugaauaucacuacgauggaagaggauuccaaugcgaaggauuugauuuauggggacaaggaacacuaguaacaguaucaucagcaagcacaaaaggaccaucaguauuuccauuagcaccaucaucuaaaucuacaucaggaggaacagcagccuuaggaugucuaguaaaagauuacuuuccagaaccaguaacagucucauggaacucaggagcacuaacaucaggaguacauacauuuccagcagucuuacaaucaucaggucuauacucauuaucaucaguaguaacaguaccaucaucaucacuaggaacacaaacauacauauguaacguaaaccauaaaccaucaaauacaaaaguagauaaaaaaguagaaccaaaaucaugc

SEQ ID NO: 47153 - RNA, 642 nt, Artificial Sequence
  derived and/or modified sequence opt6 from anti-HIV_3MLZ_LightChain
caaucuguacuaacacaaccaccaucaguaucagcagcaccaggacaaaaaguaacaauaucaugcucaggaucaucaucaaacauaggaaacaauaugguaucuugguaccaacaacaccccggaacagccccaaaacuauuaauauacgaaaacucaaaaagaccaucaggaauaccagacagauucuccggaucaagaucaggaacaucagcaacacuaggaaucauaggacuacaaaccggagacgaagcagaauacuacugcgcaaccugggacggaucacuaagaacaguauucggaggaggaacaaaauuaacaguauuaucccaaccaaaagccgcaccauccguaacauuauucccacccucaucagaagaauuacaagcaaacaaagcaacauuaguaugccuaaucucagacuucuacccaggagcaguaacaguagcauggaaagccgacucaucaccaguaagagcaggaguagaaacaacaacaccaucaaaacaaucaaacaacaaauacgcagcaucaucauacuuaucauuaacaccagaacaauggaaaucccacagaucauacucaugccaaguaacacacgaaggaucaacaguagaaaaaacaguagcaccaacagaaugu

SEQ ID NO: 47154 - RNA, 684 nt, Artificial Sequence
  derived and/or modified sequence opt6 from anti-HIV_3MLX_I-Chain
caaguacaacuacaagaaucaggaccaggauuaguaaaaccaucugaaacauuaucauuaacauguacaguaucaggaggaucaauaucaggauuccacuggucauggauacgacaaccacccggaaaaggacuagaauauauaggauacauauauuauaguggaucaacauccuacaauccaucauuaaaaucaagaguauccaugucaguagauacaucacgaaaccaauuuucacuagaacuaucauccguaacagcagcagacaccgcaguuuacuauugcgcaagagacuucggagaauaucacuaugacggaagaggauuccaaugcgaaggauuugacuuauggggucaaggaacauuaguaacaguaucaucagcaucaacaaaaggaccaucaguauuuccacuagcaccaucaucuaaaucaacaucaggcggaacagcagcauuaggaugccuaguaaaagauuacuuuccagaaccaguaacaguaucauggaacucaggagcacuaacaucaggaguacauaccuuuccagcaguacuccaaucaucaggauuauauucacuaucaucaguagucacaguaccaucaucaucacuaggaacacaaacauacauaugcaacguaaaccauaaaccaucaaauacaaaaguagauaaaaaaguagaaccaaaa

SEQ ID NO: 47155 - RNA, 633 nt, Artificial Sequence
  derived and/or modified sequence opt6 from anti-HIV_3MLX_M-Chain
ucaguacuaacacaaccaccaucaguaucugcagcaccaggacaaaaaguaacaauaagcugcucaggaucaucaucaaacauaggaaacaacaugguaucaugguaucaacaacacccaggaacagcaccaaaacuauuaauauaugaaaacucaaaaagaccaucaggaauaccagacagauucucaggaucaagaucaggaacaucagcaacauuaggaauaauaggacuacaaacaggagacgaagcagaauacuacugcgcaacaugggacggcagccuaagaacaguauucggagguggaacaaaacuaacaguauuaucacaaccaaaagcagccccaagcguaacauuauucccaccaucaucagaagaacuacaagcaaacaaagcaacauuaguaugccuaauaucagacuucuacccaggagcaguaacaguagcauggaaagcagacucaucaccaguaagagcaggaguagaaacaacaacaccaucaaaacaaucaaacaacaaauacgcagcaucaucauaccuaucacuaacaccagaacaauggaaaucacaccgaucauauagcugccaaguaacacacgaaggaucaacaguagaaaaaacaguagcaccaaca

SEQ ID NO: 47156 - RNA, 684 nt, Artificial Sequence
  derived and/or modified sequence opt6 from anti-HIV_3MLW_I-Chain
caaguacaacuaguacaaucaggagcagaaguaaaaaaagcaggagaaucauuagaaauaucuugcaaaggaucaggauauacauuuacagaucacuggauagcauggguaagacaaguaccaggaaaaggccuagaauggaugggaaugauauauccuggagauagcgacacaagauacucaccaucccuacaaggacgagucacaaugagugcagauaaaacacuaucaacagcauaccuacaauggucaagacucgaagcaucagauacagcaauguacuauugcgcuagauuacacuauucagauagaucuggaucauacuuuaacgauguauuucacauguggggacaaggaacaacaguaacaguaucaucagcaucaacaaaaggaccaaguguauuuccacuagccccuagcucaaaaucaacaucuggaggaacagcagcauuaggaugucuaguaaaagacuacuuuccagaaccaguaacaguaucauggaacucaggagcacuaacaagcggaguacauacauucccagcaguauuacaaaguucaggacuauauucauuaucaucuguaguaacaguaccaucaucaucacuaggaacacaaacauauauauguaacguaaaccauaaaccaagcaauacaaaaguagauaaaaaaguagaaccaaaauca

SEQ ID NO: 47157 - RNA, 645 nt, Artificial Sequence
  derived and/or modified sequence opt6 from anti-HIV_3MLW_M-Chain
caaucaguacuaacacaaccaccaucagcaucaggaacaccaggacaaagaguaacaauauccugcucaggaaacucaucaaacauagaaaacaacuacguauacugguaccaacaacuaccaggcucaacaccaaaacuacuaauauucagagacgaccaaagaccaucaggaguaccagacagauucucaggaaguaaaucaggaacaucagcaucacuagcaauaucaggacuaagaucagaagacgaagccgacuacuacugcgcaucaugggaugacucaagaggaggaccagacuauguauucggaacaggaacaaaaguaacaguacuaggacaaccaaaagcaaacccaacaguaacacuauucccaccaucuucagaagaacuacaagcaaacaaagcaacauuagucugccuaauaucagacuucuacccuggagcaguaacaguagcauggaaagcagacggaucaccaguaaaagcaggaguagaaaccacaaaaccaucaaaacaaucaaauaacaaauacgccgcauccucauaucuaucacuaacaccagaacaauggaaaucacacagaucauacagcugccaaguaacacacgaaggaucaaccguagaaaaaacaguagcaccaaca

SEQ ID NO: 47158 - RNA, 678 nt, Artificial Sequence
  derived and/or modified sequence opt6 from anti-HIV_3MLV_N-Chain
gaaguacaacuaguugaaucaggaggagaaguaaaacaaccaggacaaucucuaaaaauaucaugcaaaucaucaggauauaacuucuuagauucauggauaggauggguaagacaaauaccaggaaaaggacuagaauggauaggaauaauuuacccagacgauucagaugcucauuacucaccaucauucgaaggacaaguaacuaugucaguagacaaaucaauaucaacagcauacuuacaauggacaacucuacaagcaucagacacaggaaaauauuuuugcacaagacuauacuuauucgaaggagcacaaucuucaaaugcauuugacuuauggggacaaggaacaaugauacuuguaucuucuggaacaacaaaagguccaucaguauuucccuuagcaccaucaucaaaaucaacaucaggaggaacagcagcauuaggauguuuaguaaaagauuacuucccagaaccaguaacaguaucauggaacucaggagcacuaacaucaggaguacauacauuuccagcaguauuacaauccucaggacuauauucacuaucaucuguaguaacuguaccaucaucaucacuaggaacacaaacauauauauguaacguaaaccauaaaccaucaaauacaaaaguagauaaaaaagucgaaccaaaauca

SEQ ID NO: 47159 - RNA, 657 nt, Artificial Sequence
  derived and/or modified sequence opt6 from anti-HIV_3MLV_M-Chain
ucauaccuacuaacacaaccaccaucaguaucaguaucaccaggacaaacagcaucaauaucaugcucaggagauaaacuagacgacaaauacguaucaugguacuaccaacgaccaggacaaucaccagucuuacucauguaccaagacuucaaaagacccucaggaauaccagaaagacuaagcggaucaaaaagcggaaaaacagcaacacuaacaauaucaggaacacaaucucuagacgaaggagacuacuauugccaagcaugggacgcaucaacaggaguaucaggaggcggaacaaaacuaacaguacuauucggagaaggaacaagacuaacaguacuagcacaaccaaaagcagcaccuagcguaacacuauuuccacccucaucagaagaauuacaagcaaacaaagcaacacuaguaugccuaauaucagacuuuuacccaggugcaguaacaguagcauggaaagcagacucaucaccagucaaagcaggcguagaaacaacaacaccaucaaaacaaucaaacaacaaauacgcagcaucaucauaccuaucacucacaccagaacaauggaaaucacacaaaucauacuccugccaagucacacacgaaggaucaacaguagaaaaaacaguagcacccaca

SEQ ID NO: 47160 - RNA, 654 nt, Artificial Sequence
  derived and/or modified sequence opt6 from anti-HIV_3MLU_LightChain
uaccuacuaacacaaccaccauccgucucaguaucaccaggccaaacagcaucaauaucaugcucaggagacaaacucgacgacaaauacguaucaugguacuaccaaagaccaggacaaucaccaguacuauuaauguaccaagacuuuaaaagaccaucaggaauaccagaaagacuaucagguucaaaaucaggaaaaacagcaacauuaacaauaucaggcacacaaucacuagacgaaggagacuacuacugccaagcaugggacgcaaguacaggaguauccggaggaggaacaaaacuaacaguacuauucggagaaggaacacgauuaacaguacuagcacaaccuaaagcagcaccaucaguaacacuauucccaccaucaucagaagaacuacaagcaaacaaagcaacacuuguaugucuaauaucagacuucuacccaggagcaguaacaguagcuuggaaagcagacucaucaccaguaaaagcaggaguagaaacaacaacaccaucaaaacaaucaaauaacaaauacgcagcaucaaguuacuuaucacuaacaccagaacaauggaaaucacacaaaucauacucaugccaaguaacacacgaaggaagcacaguagaaaagacaguagcaccaacu

SEQ ID NO: 47161 - RNA, 657 nt, Artificial Sequence
  derived and/or modified sequence opt6 from anti-HIV_3MLT_G-Chain
uccuacgaccuaacacaaccacccucaguaucaguaucaccaggacaaacagcaucaauaucaugcucaggcgacaaauuagacgacaaauacguaucaugguacuaccaaagaccaggacaaucaccaguauuauuaauguaccaagacuucaaaagaccaucaggaauacccgaaagacuaucaggaagcaaaucaggaaaaacagcaacauuaacaauauccggcacacaaucacuagacgaaggagacuacuacugccaagcaugggacgcaucaacaggaguauccggaggaggaacaaaauuaacagucuuauucggcgacggcacaagacuaacaguacuaggacaaccaaaagcagcaccaucaguaacauuauucccaccaucaagugaagaacuacaagcaaacaaagccacacuaguaugcuuaauaucagacuucuacccaggagccguaacaguagcauggaaagcagacucaucaccaguaaaagcaggaguagaaacaacaacaccaucaaaacaaaguaacaauaaauaugcagcuucaucauaccuaucacucacaccagaacaauggaaaucccacaaaucauauucaugucaaguaacacacgaaggaagcacaguagaaaaaacaguagcaccaaca

SEQ ID NO: 47162 - RNA, 666 nt, Artificial Sequence
  derived and/or modified sequence opt6 from anti-HIV_3GO1_HeavyChain
gaaguacaauuacaagaaucaggaccaggccuaguaaaaccaucagaaacacuaucacuaacaugcacaguaucaggaggaccaauaaacaacgcauacuggacauggauaagacaaccaccaggaaaaggacuagaauacuuaggauauguauaccacacaggaguaacaaacuauaauccaucacuaaaaucaagacuaacaauaacaauagacacaucaagaaaacaauuaucacuauccuuaaaauucguaacagcagcagacucagccguauacuacugcgcaagagaaugggcagaagacggagacuucggaaacgccuuccacguauggggacaaggaacaaugguagcaguaucaucagcaucgacaaaaggaccaagcguguucccacuagcaccaucauccaaaucaacaagcggaggaacagcagcacuaggaugcuuagucaaagacuacuucccagaaccaguaacaguaucauggaacucaggagcacuuacaucaggaguacacacauucccagcaguacuacaaucaucaggacuauacuccuuaucaucagucguaacaguaccaucaucaagucuaggaacacaaacauacauaugcaacgucaaccacaaacccucaaacacaaaaguagacaaaagaguagaacca

SEQ ID NO: 47163 - RNA, 627 nt, Artificial Sequence
  derived and/or modified sequence opt6 from anti-HIV_3GO1_LightChain
ucauacguauuaacacaaccaccaucaguaucuguaaguccaggacaaacagcaagaauaacaugcucagcagaagcauuaucaaaccaauacgcauacugguacagacaaagaccagggcaagcaccacuacuaauaauauauaaagacacaaaaagaccaucaggcauaccagaaagauucucaggcucaacaucaggaacaacaguaacacuaacuauaucaggaguacaagcagaagacgaagcagacuauuauugccaaagcgcagacucaucaggagacuacguauucggaggaggaacaaaaguaacaguacuaggacaaccaaaagcaaacccaacaguaacauuauucccacccucaagcgaagaacuacaagcaaauaaagcaacauuaguaugccuaauaucagauuuuuacccaggagcaguaacaguagcauggaaagcagauggaucaccaguaaaagcaggaguagaaacaaccaaaccauccaaacaaucaaacaacaaauacgcagcaucaucauauuuaucauuaacaccagaacaauggaaaucacacagaagcuacucaugccaaguaacacacgaaggcucaacaguagaaaaaacaguagcacca

SEQ ID NO: 47164 - RNA, 690 nt, Artificial Sequence
  derived and/or modified sequence opt6 from anti-HIV_4XCY_J-Chain
caaguacaauuaguacaaaguggcgcagaaguaaaaagaccaggaucaucagucacaguaucauguaaagcaucaggaggaagcuucucaacauaugcauuaucauggguaagacaagcaccaggaagaggauuagaauggaugggaggaguaauuccacuacuaacaauaacaaacuaugcaccaagauuucaaggaagaauaacaauaaccgcagacagaucaacuagcacugcauauuuagaauuaaauaguuuaagaccagaagauacagcaguauauuacugugcaagagaaggaacaacaggauggggaugguuagguaaaccaaucggagcauuugcacauuggggacaaggaacacuaguaacaguaaguucagccucaacuaaaggaccaucaguauuuccacuagcccccucaucaaaaagcacaaguggagguacagcugcauuaggaugucuaguaaaagauuauuuuccagaaccaguaacaguuucauggaacucaggagcauuaacaucaggaguacauacauuuccagcaguauuacaaucaucaggacuauauucauuaucaagcguaguaacaguaccaaguucaucauuaggcacacaaacauauauauguaauguuaaccauaaaccaucaaauacaaaaguagauaaaaaaguagaaccaaaaucaugu

SEQ ID NO: 47165 - RNA, 645 nt, Artificial Sequence
  derived and/or modified sequence opt6 from anti-HIV_4XCY_K-Chain
gaaauaguccuaacacaaucaccaggaacacaaucccuaucaccaggagaaagagcaacacuaucaugccgagcaucacaaucaguaggaaacaacaaacuagcaugguaccaacaaagaccaggacaagcaccaagauuacuaauauacggagcaagcucacgaccaucaggaguagcagacagauucucaggaucaggaucaggaacagacuucacauuaacaauaucaagacuagaaccagaagacuucgcaguauauuacugccaacaauacggacaaucacuaaguacauucggacaaggaaccaaaguagaaguaaaaagaacaguagcagcaccaucaguauucauauucccaccaucagacgaacaauuaaaaucaggaacagcaucaguaguaugcuuacuaaacaacuucuacccaagagaagccaaaguacaauggaaaguagacaacgcacuacaaucaggaaacucacaagaaucaguaacagaacaagacucaaaagacucaacauacagcuuaagcucaacacuaacacuaucaaaagcagacuacgaaaaacacaaaguauacgcaugcgaaguaacucaccaaggacuaucaucaccaguaacaaaaucauucaacagaggcgaaugu

SEQ ID NO: 47166 - RNA, 630 nt, Artificial Sequence
  derived and/or modified sequence opt6 from anti-HIV_4YBL_C-Chain
guccuaacacaaccaccaucagcaucaggaucaccaggacaaucaguaacaauaucaugcacaggaacaucaucagacguaggaggauacaacuacguaagcugguaccaacaccaucccggaaaagcuccaaaacuaauaauaucagaaguaaacaauagaccaucaggaguaccagacagauucucaggaucaaaaucaggaaauacagcaucauuaacaguaucaggacuacaagccgaagacgaagcagaauacuauugcucaucauauacagacauacauaacuucguauucggaggaggaacaaaauuaacaguacuaggacaaccaaaagcagcaccaucaguaacacuauucccaccauccucagaagaacuacaagcaaacaaagcaacacuaguaugucuaauaucagacuucuacccaggugcaguaacaguagccuggaaagcagacucaucacccguaaaagccgguguagaaacaacaacaccaucaaaacaaucaaauaacaaauacgcagcaucaucauaccuaucauuaacaccagaacaauggaaaucacacagauccuacucaugccaaguaacacacgaaggaucaacaguagaaaaaacaguagcacca

SEQ ID NO: 47167 - RNA, 672 nt, Artificial Sequence
  derived and/or modified sequence opt6 from anti-HIV_4YBL_B-Chain
caaguacaacuacaagaaucaggaccaggucuaguaaaaccaucacaaacacuaucacuaucaugcacaguaucuggaggaucaucaucaucaggagcacacuacuggucauggauacgacaauacccaggaaaaggacuagaauggauaggauacauacacuauucaggaaacacauacuacaacccaucacuaaaauccagaauaacaauaucacaacacacaucagaaaaccaauucucacuuaaacuaaacucagucacuguagcugacacagcaguauacuacugcgcaagaggaacacgacuaagaacauuaagaaacgcauucgacauauggggacaaggaacaaugguaacaguaucaucagcaucaacaaaaggaccaucaguauucccacuagcaccaucauccaaaucaacaucaggaggaacagcagcacuaggaugccuaguuaaagacuacuucccagaacccguaacaguaucauggaacagcggcgcacuaacaucaggaguacacacauucccagcaguauuacaaucaucaggauuauauucacuaucaucaguaguaacaguaccaucaagcucucuaggcacacaaacauacauaugcaacguaaaccacaaaccaucaaacacaaaaguagauaaaagaguagaaccaaaa

SEQ ID NO: 47168 - RNA, 630 nt, Artificial Sequence
  derived and/or modified sequence opt6 from anti-HIV_4R4N_X-Chain
gacauacaaaugacacaaucaccaucauucguaucagcaucaguaggagacagaguaacaauaacaugcagagcaucacaaggaauaucaucauaccuagcaugguaccaacaaaaaccaggaaaagcaccaaaauuaguaauauaugcagcaucaacacuacaaucaggaguaccaucaagauucucaggauccggaucaggaacagaauucacacuaacaauauccucacuacaaccagaagacuucgcaacauacuacugccaacaccuaauuggacuacgaucauucggacaaggaacaaaauuagaaauaaaaagaacaguugcagcaccaucaguauucauauucccaccaucagacgaacaacuaaaaucaggaacagcauccguaguaugucuauuaaacaacuucuacccaagagaagcaaaaguccaauggaaaguagacaacgcacuacaaagcggaaacucacaagaaagcguaacagaacaagacucaaaagacucaacauacucacuaagcucaacacuaacacuauccaaagcagacuaugaaaaacacaaaguauacgcaugcgaaguaacacaccaaggacuaucaucaccaguaacaaaaucauucaacaga

SEQ ID NO: 47169 - RNA, 660 nt, Artificial Sequence
  derived and/or modified sequence opt6 from anti-HIV_4R4B_F-Chain
caaguacaacuccaacaauggggagcaggacuucuaaaaccaucagaaacacuaucacuaacaugcggaguauacggagaaucacuaucaggacacuacuggucauggguaagacaaccaccaggaaaaagauuagaauggauaggagaaauaaaacacaacggauccccaaauuaccacccaucacuaaaaucaagaguaacaauaucauuagacaugucaaaaaaccaauucucacuaaaccuaacaucaguaacagcagcagacacugcaguauacuucugcgcaagaagaucaaacuggccauaccuaccauucgacccauggggccaaggaacauuaguaacaguauccucagcauccacaaaaggaccaucaguauucccacuagcaccaucaucaaaauccacaucaggaggaaccgcagcacuaggaugccuaguaaaagacuacuucccagaaccaguaacaguaucauggaacucaggagcacuaacauccggcguacacacauuuccagcaguccuacaaucaucaggucuauacucacuaucaucaguagucacaguaccaucaucaucauuaggaacacaaacauacauaugcaacguaaaccacaaaccaagcaacacaaaaguagacaaaaaaguagaaccaaaa

SEQ ID NO: 47170 - RNA, 750 nt, Artificial Sequence
  derived and/or modified sequence opt6 from anti-HIV_3JUY_D-Chain
caaguacaauuaguacaaaguggagcagaaguaaaaaaaccaggagcaaguguaaaaguaaguugucaagcaaguggauauagauuuagccauuuuacaguacauuggguaagacaagcaccaggacaaagauuugaauggaugggauggauaaauccauacaauggaaacaaagaauuuagugcaaaauuucaagauagaguaacuuuuacagcagauacaagugcaaauacagcauauauggaacuaagaaguuuaagaagugcagauacagcgguauauuauugugcaagaguaggagaauggggaugggaugauaguccguaugauaauuauuauauggauguauggggaaaaggaacaacaguaauaguaaguagugggggaggagggucaggaggaggaggaaguggaggaggaggaagugaaauaguauuaacgcaagcaccgggaacauuaucacuaaguccaggagaaagagcaacuuuuaguuguagaagcagucacaguauaagaaguagaagagucgcaugguaucaacauaaaccaggacaagcaccaagacuaguaauacauggaguaaguaauagagcgaguggaauaagugauagauuuaguggaaguggaaguggaacggauuuuacacuaacaauaacaagaguagaaccagaagauuuugcauuauauuauugucaaguauauggagcaucaaguuauacuuuuggacaaggaacaaaauuagaaagaaaa

SEQ ID NO: 47171 - RNA, 369 nt, Artificial Sequence
  derived and/or modified sequence opt6 from anti-HIV_4KG5_HeavyChain
caauuaguacaaaguggaccagaagcaaaaagaccaggaucaucaguaaaaguaucaugcaaagcaucaagagacacauucaacaacuacguacuaaacuggguaagacaagcaccaggacaaggacuagaauggaugggaggaauaggaccaauaauagaaacagcagacuacgcagaaaaauucagaggaagacuaucaauaacagcagacgaaucaacaacaacagcauacauggaacuaucaucacuaacaucagacgacacagcaguauacuacugcgcaagaucaccauacagcucacuaacagacacauacuacuacuacauggaccuauggggaaaaggaacaacaguaacaguaucauca

SEQ ID NO: 47172 - RNA, 336 nt, Artificial Sequence
  derived and/or modified sequence opt6 from anti-HIV_4KG5_LightChain
cuaacacaaucaccagacucacuagcaguaucacuaggagaaagagcaacaauaaacugcaaaucaucccaaucaauacuagacucaucaaacaacagaaacuaccuaacaugguaccaacaaaaaccaggacaaccaccaaaacuacuaauauacugggcaucaacaagagaaucaggaguaccagacagauucucaggaucaggaucaucaacagacuucacacuaacaauaucaucacuacaagcagaagacguagcaguauacuacugccaacaauacuucucaacaccaggaauaacauucggacaaggaacaagacuagaaauaaaaaga

SEQ ID NO: 47173 - RNA, 309 nt, Artificial Sequence
  derived and/or modified sequence opt6 from anti-HIV-1_LightChain
gaaauaguacuaacacaaucaccagcaacacuaagccuaucaccaggagaaagagcaacacuaucaugcagagcaucacaaucaguauacacaaaacuagcaugguaccaacaaaaaccaggacaaccaccaagacuacuaauauacgacgcaucaaacagagcagcaggaauaccagcaagauucucaggaucaggaucaggaacagaauucacacuaacaauaaaaagaauggaaagagaagacuucgcaguauacuacugccaaauacuagaauucuucggacaaggaacaacaauagacaugaac

SEQ ID NO: 47174 - RNA, 312 nt, Artificial Sequence
  derived and/or modified sequence opt6 from anti-HIV-1_LightChain
gauauacaaaugacacaaucaccaucaucaguaagcgcaagcguaggagauagaguaacaauaacauguagagcaagccaaggaauacuaucaagccaacuagcauggcaucaacaaagaagaggacaaccaccaagauuacuaauauacggaggaucaaacagagcaccaggaauaccagaaagauuuacaggaagcggaagcggaacagauuucguacuaacaauaaaaagauuacaaagagacgauuucgcaguauauuacugucaaauacuagaauuuuucggaagaggaacaagaguagaaaugaac

SEQ ID NO: 47175 - RNA, 312 nt, Artificial Sequence
  derived and/or modified sequence opt6 from anti-HIV-1_LightChain
ggauuauuacuaacacaaucaccaggaccaguaucauuuuucccaggagaaagagcaacaguaagcuguagagcaagccauagcguaaacagcgcagcaauaaauugguaucaacaaaaacgaggacaaccaccaagauuaauaauaguagauggaucaacaagagcaacagcaguaccagaaagauuuagcgcaacaggaagcggaacagaauuuacauuaguaauaucaagacuagaaccagaagauuucgcaguauauuucugucaacaucuacaauucuucggauuaggaacaaaaguagacauaaaa

SEQ ID NO: 47176 - RNA, 312 nt, Artificial Sequence
  derived and/or modified sequence opt6 from anti-HIV-1_LightChain
gcauucguaaugacacaaucaccaggaacauuagcauuaagcccaggagaaagagcaacauuaagcuguagaacaagccaagaaauacuaucaaaccaacuagcauggcaucaacaaagaagaggacaaccaccaagauuacuaauauacggaggaucaaacagagcaccaggaauaccagaaagauuuacaggaagcggaagcggaacagauuucguacuaacaauaaauagauuagaaagagacgauuucgcaguauauuacugucaaauacuagaauuuuucggaagaggaacaagaguagaaaugaac

SEQ ID NO: 47177 - RNA, 312 nt, Artificial Sequence
  derived and/or modified sequence opt6 from anti-HIV-1_LightChain
ggaauaguacuaacacaaucaccagauacacuaucacuaucaccaggagacagagcaacauuaucauguaaaacaucacaaucaauagcaucagaacaccuagcaugguaucaacaaagaccaggacaaccaccaagacuauuaauauucggagcaucaaacagagcaucaggaauaccaacaagauucucaggaucaggaucaggagcagacuucacacuaucaauaacaagauuagaaccagaagacuucgcaguauacuacugucaauucucagaauuuuucggaagaggagcaagaguagaaguaaaa

SEQ ID NO: 47178 - RNA, 312 nt, Artificial Sequence
  derived and/or modified sequence opt6 from anti-HIV-1_LightChain
caauucguaaugacacaaucaccagcaacacuaucaucaucaccaggaggaacagcaacacuaucaugcagaacaucacacucaauacuaaacucacaacuagcauggcaccaacaaagaagaggacaaccacuaagacuacuaauauacggagcaucaaacagagcaccaggaauaccagaaagauucucagcaucaggaucaggaacagaauucguacuaacaauaaaacgaauggaaagagaagacuucgcaguauacuacugccaaauacuagaauucuucggacaaggaacaacaauagacaugaac

SEQ ID NO: 47179 - RNA, 354 nt, Artificial Sequence
  derived and/or modified sequence opt6 from anti-HIV-1_HeavyChain
agaguacauuuaguacaaaguggaacacaaguaaaaaaaccaggagcaaguguaaaaguaaguugugaaacaaguggauuuaaauuuuuagauaguuuaauacauuggguaagacaagcaccaggacaaggauuauauuggaugggauggauaaaaccauauagaggaaguguaaauuaugauggauauuuuagaggaagaguaaguaugacaagagauauauauacagauacagcauauuuagaauuaaguggauuaagaagugaugauacagcaauauauuauugugcauuuggagcaggagauggaugggauuuaguauggggacaaggaacauuaguaauaguaaguagu

SEQ ID NO: 47180 - RNA, 354 nt, Artificial Sequence
  derived and/or modified sequence opt6 from anti-HIV-1_HeavyChain
agaguacauuuaguacaaaguggaacacaaguaaaaaaaccaggagcaaguguaaaaguaaguugugaaacaaguggauuuaaauuuuuagauucacuaauacauuggguaagacaagcaccaggacaaggauuauauuggaugggauggauaaaaccauuuagaggaaguguaaauuaugauggauauuuuagaggaagaguaaguaugacaagagauauauauacagauacagcauauauggaauuaucaggauuaagaagugaugauacagcaauauauuauugugcauuuggagcaggagauggaugggauuuaguauggggacaaggaacauuaguaauaguaaguagu

SEQ ID NO: 47181 - RNA, 354 nt, Artificial Sequence
  derived and/or modified sequence opt6 from anti-HIV-1_HeavyChain
caaguacauuuaguacaaaguggaacacaaguaaaaaaaccaggagcaaguguaagaguaaguugugaaacaaguggauuuaaauuuuuagauaguauaauacauugguuuagacaagcaccaggagaaggauuauuuuggaugggauggauaaaaccauauacaggaaguguaaauuauguaagaagauaucaaggaagaguaaguaugacaagagauguauauagugauacagcauauauggauuuaucaggauuaaauagugaugauacagcaguauauuuuuguacauauggagcaggagauggauggaauuuaguauggggacaaggaacauuaguaauaguaagugca

SEQ ID NO: 47182 - RNA, 363 nt, Artificial Sequence
  derived and/or modified sequence opt6 from anti-HIV-1_HeavyChain
caaguaagauuaguacaaaguggaaaucaaguaagaaaaccaggagcaaguguaagaauaaguugugaagcaaguggauauaaauuuauagaucauuuuauacauuggguaagacaaguaccaggacauggauuagaaugguuaggauggauaaauccaagaggaggaggaguaaauuauaguagaggauuucaaggaaaauuaaguaugacaaugacaagagauaauuuugaagaaacagcauauuuagauuuaaguagauuaaauccaggagauacagcaguauauuauugugcaagaggauuugcaggauaugaauggaguuuuuuauggggacaaggaacauuaguaauaguaaguagu

SEQ ID NO: 47183 - RNA, 357 nt, Artificial Sequence
  derived and/or modified sequence opt6 from anti-HIV-1_HeavyChain
caaguaaguuuaguacaaaguggaaaucaauuaaaaaaaccaggagcaaguguaagaauaaguugugaaacaaguggauauaauuuuuuaaaucauuuuauacauuggguaagacaaguaccaggacauggauuagaaugguuaggauggauaaauccaagaggaggaggaguaaauuauaguagaaauuuucaaggaaaaguaaguuuaacaagaaauauagauauggaaacaguauauuuagauguaagaggacuaacaccaggagauacagcaguauauuauugugcaagaggauuuggaggaagugauuggaauuuuguauggggacaaggaacaagaauaacaguaagugca

SEQ ID NO: 47184 - RNA, 357 nt, Artificial Sequence
  derived and/or modified sequence opt6 from anti-HIV-1_HeavyChain
agaauaaauuuacaucaaaguggaagucaaguaaaaagaaguggagcaaguguaagaauaaguugugaaacaaguggauuuaaauuuauggauagucauuuacauuggguaagacaaguagcaggacaaggauuugaauggaugggauggauauuuacaaguggaggaggaguaaauuaugcaagacaauuucaaggaagauuaacauuaacaagagauguauuuacagauacaguauuuauggauuuaaguggaguaaauguaggagauacaggaguauauuauuguguaaaaggaacaggaggaaaugaauggggauuuaguuggggacaaggaacaguaguaguaguaagucca

SEQ ID NO: 47185 - RNA, 357 nt, Artificial Sequence
  derived and/or modified sequence opt6 from anti-HIV-1_HeavyChain
agaauaaauuuagaucaaaguggaagucaaguaaaaaaaaguggagcaaguguaagaauaaguugugaaacaaguggauuuaaauuuauggauagucauuuacauuggguaagacaaguagcaggacaaccauuugaauggaugggauggauauuuacaaguggaggaggaguaaauuaugcaagacaauuucaaggaagauuaacauuaacaagagauguauuuagugaaacaguauuuauggauuuaaguggauuaaaugcaggagauacaggaguauauuuuuguguaaaaggaacaggaggaaaugaauggggauuuguauggggacaaggaacaguaguaguaguaagucca

SEQ ID NO: 47186 - RNA, 357 nt, Artificial Sequence
  derived and/or modified sequence opt6 from anti-HIV-1_HeavyChain
agaauagaauuacaucaaaguggaagucaaguaaaaaaaaguggagcaaguguaagaauaaguugugaaacaaguggauuuaaauuuauggauagucauuuacauuggguaagacaaguagcaggacaaagauuugaauggaugggauggauauuuacaaguggaggaggaguaaauuaugcaagacaauuucaaggaagauuaagauuaacaagagauguauuuagugaaaguguauuuauggauuuaaguggauuaaauaguggagauacaggaguauauuauuguguaaaaggaacaggaggaaaugaauggggauuuguauggggacaaggaagucuaguaguaguaagucca

SEQ ID NO: 47187 - RNA, 372 nt, Artificial Sequence
  derived and/or modified sequence opt6 from anti-HIV-1_HeavyChain
caagcauuaguacaaagcggaagccaaaugaaaaaaccaggagauucaguaagauuaagcugucaaacaagcgauagcgcaauaacaaaauauuucauacacuggauaagacaagcaccaggaaaaggacuagaauggauagcauggauaucaccauauggaggaagaguaaacuauggauggcaaguaagagauagagcaacauuaacaagaaacauacacauggaaacaguauauauggauuuaagaggauuaagaccagacgauacagcaacauauuacugugcaaugagagauuacuguagagaugacaauugcaauagaugggacuuaggacauuggggacaaggaagccuaauaguaguaucagca

SEQ ID NO: 47188 - RNA, 357 nt, Artificial Sequence
  derived and/or modified sequence opt6 from anti-HIV-1_HeavyChain
caaguaacauuaguacaaaguggaaaucaauuaaaaagaccaggagcaaguguaagaauaaguugugaaacaaguggauauaauuuuauggaucauuuuauacauuggguaagacaaguaccaggacauggaccagaaugguuaggauggguaaauccaagaggaggaggaguaaauuauaguagaaaauuucaaggaagauuuaguaugacaagagauguauauauggaaacagcauauuuagauguaacaggauuaaguccagcagauacagcaguauauuauugugcaagaggauuuggaggaagugauuggaguuuuuuauggggacaaggaacauuaauaauaguaaguagu

SEQ ID NO: 47189 - RNA, 324 nt, Artificial Sequence
  derived and/or modified sequence opt6 from anti-HIV-1_LightChain
gaaauaguacuaacacaaucaccaggcacacuaucacuaucagcaggagaacgagcaucacuaucaugcagagcaucacaaacacuaaacucaaacuucuucgcaugguaccaccaaaaaccaggacaagcaccaagacuacuaauauacggagcaucaaacagagcaacaggaauaccagacagauucucaggaucaggaucaggaucagacuucacacuaacaauaucaagacuagaaccagaagacuucggaaaauacuacugcgaacaauacgacguaucaccaagaacauucggacaaggaacaaaaguagaaauaaaa

SEQ ID NO: 47190 - RNA, 324 nt, Artificial Sequence
  derived and/or modified sequence opt6 from anti-HIV-1_LightChain
gaaguaguacuaacacaaucaccaggaacauuaagccuaucaccaggagaaagagcaacacuaucaugcagagcaucacaaucaauaaacucaaacuucuucgcaugguaccaccaaaaaccaggacaagcaccaagacuacuaauauacggagcaucaucaagagcaacaggaauaccagacagaauaucaggaacaggaucaggagcagacuucacacuaacaauaacaggacuagaaccagaagacuucggacuauacuacugccaacaauacgacuucucaccaagaacauucggacaaggaacaagaguagaaauaaaa

SEQ ID NO: 47191 - RNA, 324 nt, Artificial Sequence
  derived and/or modified sequence opt6 from anti-HIV-1_LightChain
gaaguaguacuaacacaaucaccaggaacacuaucacuaucaccaggagaaagagcaacacuaucaugcagagcaucacaaacaauaaacucaaacuucuucgcaugguaccaccaaaaaccaggacaagcaccaagacuacuaauauacggagcaucaucaagagcaacaggaauaccagacagaauaucaggaucaggaucaggaacagacuucacacuaacaauaacaggacuagaaccagaagacuucggacuauacuacugccaacaauucgacuucucaccaagaacauucggacaaggaacaagaguagaaauaaaa

SEQ ID NO: 47192 - RNA, 324 nt, Artificial Sequence
  derived and/or modified sequence opt6 from anti-HIV-1_LightChain
gaaauaguacuaacacaaucaccaggaacacuaucacuagcaccaggagaaagagcaacacuaucaugcagagcaucacaaucaauaucaacaacauaccuagcaugguaccaacaaaaaccaggacaagcaccaagauuacuaauauacgaaacaucaucaagagcaucagacauaccagacagauucucaggaucaggaucaggaacagacuucacacuaacaauaucaagacuagaaccagaagacuucgcaguauauuacugccaccaauacgacagaucaccaagaacauucggacaaggaacaaaaguagaaauaaaa

SEQ ID NO: 47193 - RNA, 336 nt, Artificial Sequence
  derived and/or modified sequence opt6 from anti-HIV-1_LightChain
gauauaguaaugacacaaucaccagcaaguuuaagcguaacaccaggagaaacagcaagcauaagcuguaaauguagcagaagccuaagagaagaaguaggauauaacuaucuagauugguaucuacaaagaccaggaaaaagcccacaauuacuaauauacguaggaucauucagagcaccaggaguaagcgaaagauuuagaggaagcggagaacauaaagauuucacacuaaaaauagcaagaguagaaccaggagaugcaggaauauauuacuguaugcaaggaauagacacaccaagaacauuuggacaaggaacaacauuagaaauaaac

SEQ ID NO: 47194 - RNA, 321 nt, Artificial Sequence
  derived and/or modified sequence opt6 from anti-HIV-1_LightChain
gacauacaaaugacacaaucaccaucaucacuaucagcaucagucggagacagaguaacaauaacaugcagagcaucacaagcauucagaaacgaccuaggaugguaccaacacaaaccaggaaaagcaccagaaagacuaauauacgcaacaucaacacuagaaucaggaguaccaucaagauucucaggaucaggaucaggaacaaacuucacacuaacaauaucaucacuacaagcagaagacuucgcaacauacuacugccuacaauacaacacauucccaagaacauucggacaaggaacaaaaguagaaauaaaa

SEQ ID NO: 47195 - RNA, 333 nt, Artificial Sequence
  derived and/or modified sequence opt6 from anti-HIV-1_LightChain
aacuuuauguuaacacaaccacauucaguaucagaaucaccaggaaaaacaguaacaauaucaugcgcaagaacaagaggaggaauagacucagcauacguacacugguaccaacaaagaccaggaucaguaccaacaacaguaauauucgaagacaacagaagaccaccaggaguaccagacagauucucaggaucaauagacacaucaucaaacacagcaucauuaacaauaucaggacuaaaaacagaagacgaagcagacuacuacugccaaucauaugacgacacauacuucuggguauucggaggaggaacaaaauuaacaguacua

SEQ ID NO: 47196 - RNA, 333 nt, Artificial Sequence
  derived and/or modified sequence opt6 from anti-HIV-1_LightChain
aacuucaugcuaacacaaccacacucaguaucagaaucaccaggaaaaacaguaacaauaucaugcgcaagaacaagaggaacaauagacucagcauacguacacugguaccaacaaagaccaggagcaguaccaacaacaguaauauucgaagacgacagaagaccaucaggaguaccagacagauucucaggaucaauagacagcucaucaaacucagcaucacuaacaauaucaggacuaaaaacagaagacgaagcagacuacuacugccaaucauacgacucaaacuacuacuggguauucggaggaggaacaaaacuaacaguacua

SEQ ID NO: 47197 - RNA, 396 nt, Artificial Sequence
  derived and/or modified sequence opt6 from anti-HIV-1_HeavyChain
caaguacaacuacaacaaucaggaccagcauuaguaaaaccaucagaaacacuaucacuaacauguucaguaagcucaggaagaguaucaucauauuacuggucauggauaagacaaucaccaggaaaaggacuagaauggauaggauauauacauuacgauccagauacaaauacaaauuacagaacacauuaccauccaucacuaagaggaagaguaguaauaucaguagauucaucaaaaucucaaguaucauuaaaaguaagaucaguaacagcagcagacucagcacuauacuauugcgcaagacaucgauaugacccauggucaaaaggauacgauauaagaucaccauucgauuucuggggacaaggaacauuaguaacaguaucauca

SEQ ID NO: 47198 - RNA, 396 nt, Artificial Sequence
  derived and/or modified sequence opt6 from anti-HIV-1_HeavyChain
caaguacaccuacaacaaucaggaccaggauuaguaaaaccaucagaaacacuaucacuaacauguacaguaucaggaggaagaguaucaucauauuacuggucauggauaagacaaucaccaggaaaaggacuagaauggauaggauauauacauuacgauccagauacaucaacaaauuacagaacccauuaccauccaucacuaagaggaagaguaguaauaucaguagauacaaguaaaaaucaaguaucauuaacaguaagaucaguaacagcagcagacucagcauuauacuauugcgcaagacauagauaugacguauggucaaacggauacgauauaagaucaccauacgauuucuggggaagaggaacauuaguaacaguaucauca

SEQ ID NO: 47199 - RNA, 396 nt, Artificial Sequence
  derived and/or modified sequence opt6 from anti-HIV-1_HeavyChain
caaguacaccuagaacaaaguggaccagcauuaguaaaaccaagcgaaacacuaaguuuaacauguacaguaagcggaggaagaguaucaaguuauuacuggagcuggauaagacaaucuccaggaaaaggacuagaauggauaggauauauacauuacgauccagauacaucaacaaauuacagaacacauuaccauccaucacuaagaggaagaguaguaauaucaguagauagcagcaaaaaucaaguaucauuaaaaguaagaucaguaacagcagcagacucagcauuauacuauugcgcaagacauagauaugacguauggucaaaaggauacgauauaagaucaccauucgauuucuggggaagaggaacauuaguaacaguaagcuca

SEQ ID NO: 47200 - RNA, 390 nt, Artificial Sequence
  derived and/or modified sequence opt6 from anti-HIV-1_HeavyChain
caaguaguauuucaaaaaccaggaccaggaguaguaaaaccaagcgaaacauuaagccuaacauguacaguaagcggaggaagaguaagaagcuauuacuggagcuggauaagacuaccaccaggacaaggacuagaauggauaggauauauacauuacgaugaaacaacagaauacaaaagaucauacaauccaucacuaaaaagcagaauaacaauaucaauggauacaaguaaaaaucaaguaucauuaaaauuaagcucaguaacagcagcagacgcagcaguauacuauugcgcaagacauagauaugacagauggucagacucauacgauauaagaagcccauucgauauauggggacaaggaacaguaguaacaguaagcgca

SEQ ID NO: 47201 - RNA, 396 nt, Artificial Sequence
  derived and/or modified sequence opt6 from anti-HIV-1_HeavyChain
caaguacaacuacaacaauggggagcaggacuacuaaaaccaucagaaacacuaucacuaacaugcgcaauauacggaucaucauucucaggacacuacuggauguggauaagacaaucaccagcaaaaacacuagaauggauagcagaaauaaaccacacaggaggaacaagauauaacccaucauuagcaucaagaguaagaguauucucagacacaagcaaaaaccaauucucacuaaacaugacaucauuaacagcagcagacacaggaauauauuacugcguaagaggacaccuaucaagagacagauuaggacaauacgcauucuggucaggagcauuaauagauuacuuagacccauggggacaaggaacauuaguaacaguaucauca

SEQ ID NO: 47202 - RNA, 387 nt, Artificial Sequence
  derived and/or modified sequence opt6 from anti-HIV-1_HeavyChain
caaguacaauuacaucaauggggagcaggauuauuaaaaccaagugaaacauuaaguuuaacaugugcaguauauggaaguuuuacaggauuucaauggacauggguaagacaaacaccaggaaaaggauuagaauggauaggagaaauaaaucauaguggauuauuaguaacaggaaaaacagauuauaauccaaguuuagaaaguagaguaacaauaaguguagauacaaguaaaaaucaauuuaguuuaaaauuaacaaguguaacagcagcagauacaggaguauauuauugugcaagagcaggaggaaugagugauugggcauauccauauuauuauggaauggauguauggggacaaggaacaaugguaacaguaaguagu

SEQ ID NO: 47203 - RNA, 357 nt, Artificial Sequence
  derived and/or modified sequence opt6 from anti-HIV-1_HeavyChain
caaguacaauuaguagaaaguggaggaggagugguacaaccaggaagaaguuuaacauuaaguugugcaacaaguggauuugauuuuaguaguuauggauuucauuggguaagacaagcaccaggaaaaggauuacaauggguaaguauaauaagucaugauggaaguauaaaaaauuauggagauaguaugaaaggaagauuuaguguaaguagagauaaugcaaaagauauauuauauuuacaaaugaauaguuuaagaccagaugauacagcauuauaucauuguguaagaggagauggagaaaauggaggaacagauuauuggggauuaggaacauuaguaacaguaagugca

SEQ ID NO: 47204 - RNA, 357 nt, Artificial Sequence
  derived and/or modified sequence opt6 from anti-HIV-1_HeavyChain
caaguagauuuaguagaaaguggaggaggaguaguacaaccaggaaaaaguuuaaaauuaaguuguacagcaaguggauuuacauuuacaaguuauggaaugcauuggguaagacaaauaccaggaaaaggauuagaauggguagcaauaauaagucaugauggaacaauaaaaaauuauggagauaguguaaaaggaagauuuacaauaaguagagauaaugcaaugaauauauuauauuuacaaaugaauaauuuaagaggagaugauacagcauuauauuauuguguaagaggagauggagaaaauggaggaacagauuauuggggacaaggaacaguaguaacaguaaguagu

SEQ ID NO: 47205 - RNA, 369 nt, Artificial Sequence
  derived and/or modified sequence opt6 from anti-HIV_V3_HeavyChain
gaaguacaauuagugcaaucaggagcagaaguaaaaaaaccaggagaaucacuaaaaauaucaugccaaggauuuggauauacauuuagcacauacuggauaggauggguaagacaaaugccaggaaaaggauuagaauggcuaggaauaauauacccagaagauagcgaaacaauauacucaccaucauuccaaggacaagcaacaauaucagcagauaaaucauuaaguacagcauacuuacaauggagcggacuaagagcaucagacucagcaauauacuauugcgcaagauuaggauauugcggaagcacaagcuguaguuuuuucgauuucuggggaagaggaacacuaguaacaguaaguuca

SEQ ID NO: 47206 - RNA, 369 nt, Artificial Sequence
  derived and/or modified sequence opt6 from anti-HIV_V3_HeavyChain
gaaguacaauuaguacaaaguggagcagaaguaacaaaaccaggagaaaguuuaaaaauaaguuguaaaggaaguggauauaguuuuaguacacauuggauagcauggguaagacaaaugccaggaagaggauuagaauggaugggauuuauauauccagaugauagugauacaagauauagcccaaguuuacaaggacauguaauaauaagugcagauaaaaguuuaaguacagcauauuuacaauggaguaguuuaaaagcaagugauacagcaauguauuauugugcaagauuaggaggagaugaauaucaaaguaguggaggaauggauguauggggacaaggaacaacaguaauaguaaguagu

SEQ ID NO: 47207 - RNA, 393 nt, Artificial Sequence
  derived and/or modified sequence opt6 from anti-HIV_V3_HeavyChain
gaaguccaauuaguacaaaguggagcagaaguaaaaaaaccaggagcaacaguaaaaauaucaugcaaaguaucaggauacacacuaacagacuacuacauacacuggguacaacaagcaccaggaagaggacuagaauggcuaggacuaguagacccagaaaacggagaaacacuauacgcagaaaaauuccaaggaagaguaacacuaacagcagacacaucaacagacacagcauacauggaacuaaaaucacuaagauacgaagacacagcaguauacuacugcgcaacagaaggaccaccaucauacuacgacucaggaacauacgcaaaaucacuaccagcaucauucgcauguuggggacaaggaacacuaguaacaguaucauca

SEQ ID NO: 47208 - RNA, 369 nt, Artificial Sequence
  derived and/or modified sequence opt6 from anti-HIV_V3_HeavyChain
caaguacaacuacaagaaucaggaccaggacuuguaaaaccaucagaaacacuaucacuaacaugcacaguaucaggaggaucaauaaacaacuacuacuggucauggauaagacaaccaccaggaaaaggacuagaauacauaggauacauauucuacucaggaucaacaaacuacaacccaucacuaaaaucaagaguaacauucucaguagacacauccaaaaaccaauucucacuaaaacuaacaucaguaacagcaacagacacagcaguauacuacugcgcaagaggaccacuacuauacuucggagcaccaagaacacacuucgacuacuggggacaaggagcauuaguaacaguaucauca

SEQ ID NO: 47209 - RNA, 372 nt, Artificial Sequence
  derived and/or modified sequence opt6 from anti-HIV_V3_HeavyChain
gaaguacaacuaguacaaucaggagcagaaguaaaaaaaccaggagaaucacuaaaaauaucaugcaaaggaucaggauauagcuuuagcucacacuggauaggauggguaagacaacuaccaggaaaaggauuagaauggaugggaauaauauacccagacgauagugauacaaaauacaauccaucauuccaaggacaaguaacaauaucagcagauagaucaauaucaacagcauacuuacaauggagcucacuaaaagcaucagacacagcaauguacuauugcgcaagaguaggauaugacucauacggauacucaggaucaaacuuugacgaauggggacaaggaacauuaguaacaguaucaagc

SEQ ID NO: 47210 - RNA, 357 nt, Artificial Sequence
  derived and/or modified sequence opt6 from anti-HIV_V3_HeavyChain
gaaguacaauuaguacaaaguggagcagaaguaaaaaaaccaggagaaaguuuaaaaauaaguuguaaaggaaguggauauaauuuuaauagugauuggauaggauggguaagacaaaugccaggaaaaggauuagaauggguaggaaugauauauccagaugauuuugaaguaagacauaguccaccauuucaaggaagaguaacaaugaguguagauaaaagcauaaguacagcauauuuacaauggaguaguuuaaaaaguagugauacaggaauguauuuuugugcaagauuagauggaaaugcagcagcauuugauuauuggggacaaggaacacaaguaacaguaaguagu

SEQ ID NO: 47211 - RNA, 360 nt, Artificial Sequence
  derived and/or modified sequence opt6 from anti-HIV_V3_HeavyChain
gauguacaauuaguacaaagcggagcagaaguaaaaaaagcaggagaaaguuuaaaaauaaguuguagaccaaguggauauaauuuugcagauuauuggauaggauggguaagacaaaugccaggaaaaggauuagaauggaugggaauaauauuuccagaugauucagauacaagauauggaccaaguuuugaaggacaaguaacaauaagugcagauaaaaguauaaauacagcauaucuacaauggaauaguuuaaaagcaagugauacagcaauguauuuuugugcaagacauggaggaaguggagcagcaccaggagauuauuggggacaaggaacauuaguaacaguaaguagu

SEQ ID NO: 47212 - RNA, 363 nt, Artificial Sequence
  derived and/or modified sequence opt6 from anti-HIV_V3_HeavyChain
gaaguacaauuaguacaaaguggagcagaaguaaaaaaaccaggagcaacaguaaaaauaaguuguaaaguaaguggauauacauuuacagauuauuuuaugcauuggguacaagaagcaccaggaaaaggauuagcauggaugggauuaguagauccagaaaauggagauacaguauaugcagaaaaauuacaaggaagaguaacaaugagugcagauacaaguagagauacagcauauauggaauuaacaaguuuaagaagugaagauacagcaguauauuauugugcaauaggaaaaaguguagcaggaacaagugcauaugauauauggggacaaggaacaaugguaacaguaaguagc

SEQ ID NO: 47213 - RNA, 369 nt, Artificial Sequence
  derived and/or modified sequence opt6 from anti-HIV_V3_HeavyChain
caaguacaauuaguacaaaguggagcagaaguaagaaaaccaggagcaaguguaaaaguaaguuguaaagcaaguggagauacauuuaauaaucaugauauaaauuggguaagacaagcaccaggacaaggaccagaauggguaggauggaugaauccaaaaaguggaaaugcaggauaugcacaaaaauuucaaggaagaguaacaaugacaagagauacaaguauaaguacagcauauauggaauuaagaaguuuaacaagugaagauacaggaguauauuauugugcaagauuaacaguagauugugaugauggaggauguuauggagauuauuggggacaaggaacauuaguaacaguaaguagu

SEQ ID NO: 47214 - RNA, 354 nt, Artificial Sequence
  derived and/or modified sequence opt6 from anti-HIV_V3_HeavyChain
gaaguauauuuacaacaaaguggagcagaauuaaaagaaccaggagcaaauguaaaaauaaguuguaaagcauuuggauuuauauuuacagauuauuuuauacauuggcuaagacaagcaccaggaaaaggaccacaauggguaggaguaguagauccagaagacggaaguacaacauaugcagaagcauuucaaggaagaguaaguauaacagcagacagaaguacagauacagcauauauggauuuagcaggauuaacaucagaugauacagcaguauauuauugugcauuaauguggaaugaaaguggaccagauaauuggggacaaggaacauuaguaauaguaaguuca

SEQ ID NO: 47215 - RNA, 393 nt, Artificial Sequence
  derived and/or modified sequence opt6 from anti-HIV_V3_HeavyChain
gaagugcaaguaguagaauuuggaggagaaguaaaaaaaccaggagcaaguguaaaaguaagcugugaagcaaguggauauacauuugcaaaauuugcaauacauuggguaagacaagcaccaagacaaggacuagaauggaugggauggauaaauggagaugauggaaaaacagaauauagucaaaaauuucaagauagaguaacaaugacaagagauacaagugcaaguacaguauauauggaacuaucaaguuuaagaucagaagauacagcauuauauuauugugcaagagcaauguauccagauacaguaacaggaaaugauaauccagcaccaccaccauuugaaggagauuauuggggacaaggaacauuaguaacaguaucaagu

SEQ ID NO: 47216 - RNA, 393 nt, Artificial Sequence
  derived and/or modified sequence opt6 from anti-HIV_V3_HeavyChain
gaaguacaauuaguagaaaguggaggaggauuaguaaaaccaggaggaagucuaagauuaacauguguagcaaguggauuuacauuuagugauguaugguuaaauuggguaaggcaagcaccaggaaaaggauuagaauggguaggaagaauaaaaaguagaacagauggaggaacaacagauuaugcagcaaguguaaaaggaagauucacaauaaguagagaugauaguaaaaauacauuauauuuacaaaugaauaguuuaaaaacagaagauacagcaguauauaguuguacaacagauggauuuauaaugauaagaggaguaagugaagauuauuauuauuauuauauggauguauggggaaaaggaacaacaguaacaguaaguagu

SEQ ID NO: 47217 - RNA, 387 nt, Artificial Sequence
  derived and/or modified sequence opt6 from anti-HIV_CD4bs_HeavyChain
gaagaacaauuaguagaaaguggaggaggauuaguaaaaccaggaggaagucaaagacuaaguugugcagcaagugaauuuacauuuaguagauauacaaugaauuggguaagacaagcaccaggaaaaggauuagaauggguaaguaguauaaguggaaaugauaauaauauauauuaugcagauaguguaaaaggaagauuuacaauaaguagagauaaugcaagaaauaguuuauauuuacaaauaaauaguuuaagaguagaagauacagcaguauauuauugugcaagaggaccauuagauaguuaugauuuuuggucaggaaguagacauuauuauggauuagauguauggggacaaggaacaacaguaacaguaaguagu

SEQ ID NO: 47218 - RNA, 372 nt, Artificial Sequence
  derived and/or modified sequence opt6 from anti-HIV_CD4bs_HeavyChain
caaguacaauuaguacaaagcggaagcgaauuaaaaaaaccaggagcaagcguaaaaguaagcuguaaagcaagcggauacacauucacaagccauauaauaaacuggguaagacaagcaccaggacaaggacuagaauggaugggauggauaaauacaaauacaggaaacccaacauaugcacaaggauuuacaggaagauuuguauuuaguuuagacacaagcguaagcauggcauaucuacaaauaucaagcuuaaaagcagaagauacaggaguauauuacugugcaagaggauuuagacaaugguuaguagcaagaauaacauauuucgauuacuggggacaaggaacacuaguaacaguaagcuca

SEQ ID NO: 47219 - RNA, 369 nt, Artificial Sequence
  derived and/or modified sequence opt6 from anti-HIV_CD4bs_HeavyChain
gaauuaagauuacaagcaaguggaccaggauuaguaaaaccaagugaaacauuaaguuuaguauguaguguaaguggaguaucaauaucagauaguuauuggaauuggauaagacaaccagcaggaaaaggauuagaauggauaggaagaguauauacaagaggaacacauacauauaauccaaguuuaggaggaagagcaacaguaagcggagauacaaauaaaaaugaaguaaguuuaaaauuaaugaguguaacagcagcagauacagcaguauauuauugugcaagagcauuaucaggagauuggacaagaagauauuuuuauauggauguauggggaagaggaacaccaguaacaguaagcagu

SEQ ID NO: 47220 - RNA, 381 nt, Artificial Sequence
  derived and/or modified sequence opt6 from anti-HIV_CD4bs_HeavyChain
caacuacaacuacaagaaucaggaccaagacuaguaaaaccaucagaaacacuaucacuaacaugcacaguaucaggaggaucaauaucaucaggagacuacuacuggacauggauaagacaaccaccaggagaaggacuagaauacauaggauacauauacucaggaggaucaacagacuacaacccaucacuaaaaucaagagcaucaauaucacaagacacaucaacaaacgaauucucacuaaaauuaacaucaguaaccgcagcagacacagcaguauacuucugcgcaagagacagaagaguacuacuaugguucggagaaccaagaagaggacuagacuucuggggaccaggaacacuaguaacaguaucauca

SEQ ID NO: 47221 - RNA, 396 nt, Artificial Sequence
  derived and/or modified sequence opt6 from anti-HIV_CD4bs_HeavyChain
gaaguacaauuaguagaaagcggaggaggauuaguaaaaccaggaggaagccuaagauuaagcugugcagcaagcggauucacauucucaagcgcauggaugagcuggguaagacaagcaccaggaaaaggacuagaauggguaggaagaauaaaaagcaaaagcgauggagaaacaacagacuaugcagcaccaguaaaaggaagauuuacaauaagcagagacaaucuagaaagcacacuauaucuacaacuaaauagcuuaaaaacagaagauacagcaguauauuacugugcaacagcaacaccaucauacuaugacauaaugacgggaaauuacaaauacuauuacuauauggauguauggggaaaaggaacaacaguaacaguaaguuca

SEQ ID NO: 47222 - RNA, 363 nt, Artificial Sequence
  derived and/or modified sequence opt6 from anti-HIV_CD4bs_HeavyChain
caaguacaacuaguagaaagcgggggaggacuaguaaaaccaggaggaaguuuaagauuaagcugugcagcaagcggauucauauucagagaccauuacaugacauggauaagacaagcaccaggaaaaggacuagaauggguaaguuauauaucaagcucaagcaauaacauacaauaugcagauagcguaaaaggaagauuuacaguaaguagagacaaugcaaaaaacucacuauaucuacaaaugaauagcuuaagagcagacgauacagcaguauauuacugugcaagaagcggaccauuuuacaauuacggaccaccaaacaauuggggacaaggaacauuaguaacaguaucaagc

SEQ ID NO: 47223 - RNA, 378 nt, Artificial Sequence
  derived and/or modified sequence opt6 from anti-HIV_CD4bs_HeavyChain
caaguacaauuaguagaaagcggaggaggaguaguacaaccaggaggaagucuaacauuaagcuguacagcaaguggauucccauucaauagcuaugcaaugcacuggguaagacaagcaccaggaaaaggauuagaauggguaagcaugacaucacacgauggaggaaauaaagacuuuguagauagugugaaaggaagauuuacaauaaguagagauaauagcagaaacacacuauuucuacaaaugaauaguuuaagucaagacgauacaggaguauauuacuguguaagaggaaaauuagaagauuauaauuuuuggggacauuauagagauuuugauaguuggggacaaggaacauugguaacaguaagugca

SEQ ID NO: 47224 - RNA, 405 nt, Artificial Sequence
  derived and/or modified sequence opt6 from anti-HIV_CD4bs_HeavyChain
gaaccacauguaguagaaaguggaggaggaauggcaaaaccaggaggaaguuuaagauuaagcugugcaggaaguggauuuacauuuacaaaugcauggaugaauuggguaagacaagcaccaggaaaaggauuagaauggguaggauuaauaaaaaguaaaagcgauggaggaacaacagauuaugcagcagauguagaaggaagauuuacaauaaguagagaugauuuagaaaguacaauguuuuuagaaaugcauaguuuacaaauagaagauacagcaguauauuuuuguacaacacaauauccaagauauuaugauuuaaugacaggaaauuauaaaagaagauauuuuaguaguggaauggauguauggggacaaggaacagcaguaacaguaaguagu

SEQ ID NO: 47225 - RNA, 384 nt, Artificial Sequence
  derived and/or modified sequence opt6 from anti-HIV_CD4bs_HeavyChain
caaguacaacuacaagaaucaggaccaggacuaguaaaaccaucacaaacacuaucacuaacaugcacaguaucaggagacucaguaucaucaggaaacuacuacuggucauggauaagacaaccagcaggaaaaccacuagaauggauaggacacauaucaacaggaggaggaacaaaaaacaacccaagccuacaaucaagaguaacaauaucauuagacucaucaaaaaaccaaguaucacuaucacuaucaucaguaacagcagcagacacagcaguauacacaugcgcaagaggaccaccaagaucacuaugguucggagacccaacauacucauacauggacguauggggaaaaggaacaacaguaacaguaucauca

SEQ ID NO: 47226 - RNA, 372 nt, Artificial Sequence
  derived and/or modified sequence opt6 from anti-HIV_CD4bs_HeavyChain
caaguacaauuaguacaaagcggagcagaaguaaaaaaaccaggaucaagcguaaaaguaagcuguaaagcaagcggaggaacauucaauagccaugcauuuacauggguaagacaagcaccaggacaaggacuagaauggaugggaggaauaauaccaacacuaggacuagcaaacgaugcacaaaaauuucaaggaagauuuacaauaacagcagacgaaagcacaacaacaguauauauggaauuaaguagcuuaagaucagaagauacagcaguauauuacugugcaagaagaccauacuaugaccaaguaucaggaguaggagcauucgauauauggggacaaggaacaagaguaacaguaagcuca

SEQ ID NO: 47227 - RNA, 390 nt, Artificial Sequence
  derived and/or modified sequence opt6 from anti-HIV_V2_HeavyChain
caaguacaacuaguacaaucaggagcagaaguaaaaaaaccaggaagcucaguaaaaguaucaugcgaagcaucaggaguaacaucaagcucauacacaauaucauggguaagacuagcaccaggacaaggacuagaauggaugggaagaauaacaccaauauucgacauaacaaauuacgcacaaaaauuccaaggaagaguaacauuaacagcagacaaaucaacaggaacaacauacauggaauuaagcucacuaagaagcgacgacacagcaguauacuacugcgcaagagacaaaucagacguaguaguaguaacaagcauaagaccagcauauuacuacggaauggacguauggggacaaggaacaacaguaacaguaucaagc

SEQ ID NO: 47228 - RNA, 366 nt, Artificial Sequence
  derived and/or modified sequence opt6 from anti-HIV_V2_HeavyChain
caaguacaauuaguacaaaguggagcagaaguaaaaaaaccaggaaguaguguaaaaguaaguuguaaagcaagcggaggaacauuuagaaguuaugcaauaaguuggguaagacaagcaccaggacaaggauuagaauggaugggaggaauaauaccaauauuuggaacagcagauuaugcacaaaaauuucaaggaaaaguaacaauaacagcagaugaaaguacaaguacagcauauauggaauuaaguaguuuaacaagugaagauacagcaauguauuauugugcaagaaguagagaucauuuuuuugauacaagaguauuucaaggauggggacaaggaacauuaguaacaguaaguuca

SEQ ID NO: 47229 - RNA, 363 nt, Artificial Sequence
  derived and/or modified sequence opt6 from anti-HIV_V2_HeavyChain
caaguacaauuaguacaaucaggagcagaaguaaaaaaaccaggaagcucaguaaaaguaucaugcaaagcaucaggaggaaacuuuaacacauacacaauaucauggguaagacaagcaccaggacaaggauuagaauggaugggaagaauaauaccaauauucggaauaguaaauccagcacaaaaauucccaggaagaguaacaauaaauguagauaaaucaacaaauacagcauacauggaauuaaguucacuaagaagcgaagacacagcaguauacuauugcgcaacaucaggaguaggauuacacuuuggauauuucgauuacuggggacaaggaacacaaguaacaguaagcagc

SEQ ID NO: 47230 - RNA, 378 nt, Artificial Sequence
  derived and/or modified sequence opt6 from anti-HIV_V2_HeavyChain
caaguacaauuacaacaauggggaccaggacuauuaaaaccaagcgaaacauuaagccuaacaugugcaguauacggaggaucauucggaagauauuacuggagcuggauaagacaaucaucaggagaaggauuagaauggcuaggacaaauagaucacacaggaucaacaacauacaauccaucacuaaaaggaagaguaacaauaucaauagauagcucaacaaaucaauuuaguuuaaaaguaacaucaguaauagcagcagacacagcaguauacuauugcgcaagagcaccaucaggauauccaggaguaucacuauaucaauauuacggacuagauguauggggacaaggaacaacaguaacaguaagccca

SEQ ID NO: 47231 - RNA, 366 nt, Artificial Sequence
  derived and/or modified sequence opt6 from anti-HIV_V2_HeavyChain
caaguacaauuaguacaaagcggagcagaaguaaaaaaaccaggaucaaguguaaaaguaagcuguaaagcaagcggaggaacauucucaaauuaugcaauaagcuggguaagacaagcaccaggacaaggacuagaauggaugggaggaauaauaccaauauucggaacaacagacuaugcacaaaaauuucaaggaagaguaacaauaacagcagaugcaagcacaaguacagcauauauggaauuaucaaguuuaagaucagacgauacagcaguauauuacugugcaagaaguagaggacauuauuuugacacaagaguauucgaaggauggggacaaggaacauuaguaacaguaaguuca

SEQ ID NO: 47232 - RNA, 372 nt, Artificial Sequence
  derived and/or modified sequence opt6 from anti-HIV_V2_HeavyChain
caaguacacuuaguacaaagcggaacagaaguaaaaaaaccaggagcaaguguaacaguaagcuguaaagcaagcggauacucauucacaggauauuacuuacacuggguaagacaagcaccaggacaaggacuagaauggaugggauggauaaauccaaauagcggaggaacauacuaugcacaaaacuuucaagcaagaguaacaaugacaagagacacaagcauaagcacaguauauauggaucuaucaagauuaagaucagacgauacagcagucuauuacuguguaagaagagcaguauuaacagcacuaccaccaagauacuauuucgauuucuggggacaaggaacacuaguaacaguaagcuca

SEQ ID NO: 47233 - RNA, 318 nt, Artificial Sequence
  derived and/or modified sequence opt6 from anti-HIV_V3_LightChain
ucacuagaacuaacacaaccaccaucaguaucaguaucaccaggacaaacaguaucaauaacaugcucaggaaaccuacuaggagacaaagacgcaucaugguaccaacuaaaaccaggacaaucaccaauacuaguaauauaccuagacacagaaagaccaucaggaauaccagaaagauucagcggaucaaaaucaggaaacacagcaacacuaacaauaucaggaacacaagcaauggacgaagcagaauacuucugccaagcaugggacacaacaacaguacuauucggaggaggaacaagacuaacaguacua

SEQ ID NO: 47234 - RNA, 324 nt, Artificial Sequence
  derived and/or modified sequence opt6 from anti-HIV_V3_LightChain
agcgaugaauuaacacaaccaccaaguguaagcguaagcccaggacaaacagcaagaauaacauguagcggagacgcacuaccagaaaaauacgcauacugguaccaacaaaaaucaggacaagcaccaguauuaguaauagaugaagauaacaaaagaccauucggaacaccagaaagauucagcggaucaagaucaggaacaauggcaacacuaacaauaacaggagcacaaauggaagacgaagcagauuacuauugcucaaguacagacucaagaggaacauauuggguauucggaggaggaacaaaacuaacaguauua

SEQ ID NO: 47235 - RNA, 336 nt, Artificial Sequence
  derived and/or modified sequence opt6 from anti-HIV_V3_LightChain
caaucaguacuaacacaaccaccaucaguaucagcagcaccaggacaaaaaguaacaauaucaugcucagccggaaacucaaaaauaggagacaacuacauaucaugguaccaacacguaccaggagcagcaccaaaacuacuaauauacgaaaacgacaaaagaccaucaggaauaccagacagauucucaggaucaaaaucaggaacaucagcaucacuaggaauaacaggacuacaaacaggagacgaagcagacuacuacugcgcagcaugggacaacucacuaucaucagcacuauacguauucggaacaggaacaaaaguaacaguacua

SEQ ID NO: 47236 - RNA, 339 nt, Artificial Sequence
  derived and/or modified sequence opt6 from anti-HIV_V3_LightChain
gacauaguaaugacacaaucaccagacucacuagcaguaucacuaggagaaagagcaacaauaaacugcaaaucaucacaaaacguauucuacucaucaaacaacagaaacuaccuagcaugguaccaacaaagaccaggacaaccaccaaaacuacuauucuacugggcaucaacaagagaaucaggaguaccagacagauucucaggaucaggaucaggaacagacuucacacuaacaauaucaucauuacaaacagaagacguagcaauauacuacugccaacaauacuacaacacaccaccaacauucggaccaggaacaaaaguagaaauaaaa

SEQ ID NO: 47237 - RNA, 318 nt, Artificial Sequence
  derived and/or modified sequence opt6 from anti-HIV_V3_LightChain
ucauacgaacuaacacaaccaccaucaguaucaguaucaccaggacaaacagcaacaauaacaugcucaggagaccuacuaggagacaaauacgcaucaugguacagacaaaaaccaggacaaucaccaguauuaguaauauacgaagacacaaaaagaccaucaggacuaccagaaagauucucaggaucaaacucaggaaacacagcaacacuaacaauaucagaaacacaagcaauggacgaagcagacuacuacugccaagcaugggacacaagaacaguaguauucggaggaggaacaaaacuaacaguacua

SEQ ID NO: 47238 - RNA, 327 nt, Artificial Sequence
  derived and/or modified sequence opt6 from anti-HIV_V3_LightChain
caaucaguacuaacacaaccaccaagcguaagcgcagcaccaggacaaaaaguaacaauaagcuguagcggaagaucaagcgauauagaaaacaaauucguaagcugguaccaacaauuaccaggaacagcaccaaaacuauuaauauaugaagauaacaaaagaccaagcggaauaccagacagauucucaggaucaaaaucaggaacaagcgcaacauuaggaauaacaggacuacaaacaggagacgaagcagauuacuauugcggaacaugggacaauaacuuaagagcaggauuuggaggaggaacacacuuaacaguacua

SEQ ID NO: 47239 - RNA, 324 nt, Artificial Sequence
  derived and/or modified sequence opt6 from anti-HIV_V3_LightChain
ucauacgaacuaacacaaccaccaucaguaucaguaucaccaggacaaacagcaagaauaacaugcucaggagacgcacuaccaaacaaauacgcauucugguaccaacaaaaaucaggacaagcaccaguacuaguaauauucgacgacaacagaagaccagcaggaauaccagaaagauucucaggaucaagaagcggaacacuagcaacacuaacaauaucaggagcacaaguagaagacgaagcagacuacuacugcuacucaacagacaacgacggaaaauacuucguauucggaagcggaacaaugguaacaguacua

SEQ ID NO: 47240 - RNA, 318 nt, Artificial Sequence
  derived and/or modified sequence opt6 from anti-HIV_V3_LightChain
ucauacgaacuaacacaaccaccaucaguaucaguaucaccaggacaaacagcaucaauaacaugcucaggacacaaacuaggagacaaauacgcaucaugguaccaacacaaaccaggacaaucaccaguauuaguaauauacgaagacacacaaagaccaucaggaauaccagaaagaauaucaggaucaaaaucaggaaacacagcaacacuaacaauaucaggaacacaagcaauggacgaagcagacuacuacugccaagcaugggacucaagagcagcaguauucggaggaggaacaagacuaacaguacua

SEQ ID NO: 47241 - RNA, 327 nt, Artificial Sequence
  derived and/or modified sequence opt6 from anti-HIV_V3_LightChain
caaucagcacuaacacaaccagcaucaguaucaggaucaccaggacaaucaauaacaauaucaugcacaggaauaucaucagacauaggaacagacaacuacguaucaugguaccaacaacacccaggaaaagcaccaaaacuaauaauauacgaaguaucaaacagaccaucaggaauaucacacagauucucaggaucaaaaucaggaaacacagcaucacuaauaauaucaggacuacaaguagaagacgaagcacacuacuacugcaacucauacagaucagacacauuaguauucggaggaggaacaaaaguaacaguacua

SEQ ID NO: 47242 - RNA, 333 nt, Artificial Sequence
  derived and/or modified sequence opt6 from anti-HIV_V3_LightChain
caaucaguacuaacacaaccaccaucagcaucaggaacaccaggacaaagaguaacaauauccuguucaggaucaucaucaaacauaggaucaaauacaguaaacugguaccaacaccuaccaggaacagcaccaaaacuacuaauauacucaaacgaccaaagaccaucaggaguaccagacagauucucaggaucaucaucaggaacaucagcaucauuagcaauaucaggauuacaauccgaagacgaagcagacuacuacugcgcagcaugggacgacucauuaaacggaccauucguauucggaacaggaacaaaaguaacaguacua

SEQ ID NO: 47243 - RNA, 318 nt, Artificial Sequence
  derived and/or modified sequence opt6 from anti-HIV_V3_LightChain
gacauacaaaugacacaaucaccaucaucacuaucagcaucaguaggagacagaauaacaauaacaugcagaacaucacaaucaauagacaaccaccuaaacugguaccaacacaaaccaggaaaagcaccaaaacuacuaauaucagcagcauccagacuacaaucaggaguaccaucaagauucacaggaucaggaucaggaacagaauucacacuaacaauaucaucacuacaaccagaagacuucgcaguauacuacugccaacaaucauacauaacaauaacauucggaccaggaacaaaaguagacauaaaa

SEQ ID NO: 47244 - RNA, 321 nt, Artificial Sequence
  derived and/or modified sequence opt6 from anti-HIV_V3_LightChain
gaaauaguaaugacacaaucaccagcaacacuaucaguaucaccaggagaaggaguaacauuaucaugcagagcaucacaaucaguaucaucaaacauacuaugguaccaacaaagaccaggacaagcaccaagacuacuauuauacggagcaagcacaagagcaacaggaauaccagcaagauucucaggaucaggaucaggaacagaauucacauuaacaauaaacucaaugcaaagcgaagacuucgcaauauacuacugccaacaauaucacgacuggcuauggacacuaggacaaggaacacaaguagaaauaaaa

SEQ ID NO: 47245 - RNA, 327 nt, Artificial Sequence
  derived and/or modified sequence opt6 from anti-HIV_V3_LightChain
ucauacgaacuaacacaaccaccaucaguaucaguaucaccaggacaaacagcaucaauaacaugcucaggagacaaaaugggagaaagauauacaucaugguaccaacaaaaaccaggacaaagcccaguauuaguaaugagcgaaaacauaaaaagaccagcaggaauacccgaaagauucagcggaagcucaagcggaaacacagcaauacuaacaauaucaggaacacaagcaguagacgaagcagacuauuacugccaaguaugggacacaacaacaacaagcuacguaauauucggaggaggaacaaaacuaacaguacua

SEQ ID NO: 47246 - RNA, 321 nt, Artificial Sequence
  derived and/or modified sequence opt6 from anti-HIV_V3_LightChain
gacauacaaaugacacaaucaccaucaucacuaucagcaucaguaggagacagaguaacaauaacaugccaagcaucacaagacauaggaaacuaccuaaacugguaccaccaaaaaccaggaaaagcaccaaaacuacuaauauacgacgcaucaaacguagaaacaggaguagcaucaagauucucaggaucaggaucaggaacagacuucacacuaacaauaucaucacuacaaccagaagacauaggaacauacuucugccaacaauacgaaucacuaccaugggcauucggaggaggaacaaaaguagaaauaaga

SEQ ID NO: 47247 - RNA, 333 nt, Artificial Sequence
  derived and/or modified sequence opt6 from anti-HIV_V3_LightChain
aacuucaaacuaacacaaccacacucaguaucagaaucaccaggaaaaacaguaacaauaucaugcacaagaacaucaggaacaauagcaacaaacuacguacaaugguuccaacaaagaccaggaucaucaccaacaaccaugauauacgaaaacgacaaaagaccaucaggaguaccagacagauucucaggaucaauagacacaucaucaaacucagcaucacuaacaauaucaggacuaaaaaccgaagacgaagcagacuacuacugccaaucauacaacucaacagacauaguaguauucggaggaggaacaaaacuaacaguacua

SEQ ID NO: 47248 - RNA, 327 nt, Artificial Sequence
  derived and/or modified sequence opt6 from anti-HIV_V3_LightChain
caaucaguacuaacacaaccaccaucaguaucagcagcaccaggacaaaaaguaacaauaucaugcucaggaucaucaucaaauauaggaaacaauaugguaucaugguaccaacaacacccaggaacagcaccaaaacuauuaauauacgaaaauucaaaaagaccaagcggaauaccagacagauucucaggaucaagaucaggaacaucagcaacauuaggaauaauaggacuacaaacaggagacgaagcagaauacuacugcgcaacaugggacggaucauuaagaacaguauucggaggaggaacaaaauuaacaguacua

SEQ ID NO: 47249 - RNA, 324 nt, Artificial Sequence
  derived and/or modified sequence opt6 from anti-HIV_V3_LightChain
aguuaugaauuaacacaaccaccaagcguaagcguaagcccaggacaaacagcaagaauaacauguagcggagacgcacuaccaaaccaauacggauacugguaccaacaaaaaccaggacaagcaccaguauuaguaauauuuaaagauagcgaaagaccaagcggaauaccagaaagauucucaggaucaagcucaggaacaacaguaacacuaacaauaagcggaguacaagcagaagacgaagcagauuacuauugccaaagcgcagacucaagcggaaacuaugaaguauucggaggaggaacaaaacuaacaguauua

SEQ ID NO: 47250 - RNA, 330 nt, Artificial Sequence
  derived and/or modified sequence opt6 from anti-HIV_V3_LightChain
caaucaguacuaacacaaccaccaucaguaucagaagcaccaagacaaagaguaacaauaucaugcucaggaucaucaucaaacauaggaaacaacgcaguaaacugguaccaacaaguaccaggaaaagcaccaaaacuacuaauauacuacgacgaccuacuaccaucaggaguaucagacagauucucaggaucaaaaucaggaucaucagcaucacuagcaauauccggacuacaaucagaagacgaagcagacuacuacugcgcagcaugggacgacucacuaaaaguauacguauucggaacaggaacaucaguaacaguacua

SEQ ID NO: 47251 - RNA, 333 nt, Artificial Sequence
  derived and/or modified sequence opt6 from anti-HIV_V3_LightChain
gauauaguaaugaaucaaucaccaccaucauuagcaguaacaccaggagaaccagcaagcauaagcuguagagcaagccaaucauuacuauauagcgauggacauaacuaucuagauugguaucuacaaaaaccaggacaagcaccacaauuacuaauauaccuaggaagcacaagagcaagcggaguaccagauagauuuagcggaagcggaagcggaacagauuucacacuaaaaauaucaagaguagaagcagaagauguaggaguauauuacuguaugcaaccauuacaaucauacacauucggacaaggaacaaaacuagaaauaaaa

SEQ ID NO: 47252 - RNA, 321 nt, Artificial Sequence
  derived and/or modified sequence opt6 from anti-HIV_V3_LightChain
gcauaugaauuaacacaaccaccaucaguaucaguaucaccaggacaaacagcaagaauaacauguagcggagacgcacuaccaaaccaauacgcauacugguaccaucaaagaccaggacaagcaccaguauuaguaauacauaaagauacagaaagaccaagcggaauaccagcaagauucucaggaucaagcucaggaacaacaguaacacuaacaauaagcgaaguacaagcagaagacgaaggagauuacuauugccaaagcgcagacacaagcgcauacguaguauuuggaggaggaacaaaauuaacaguacua

SEQ ID NO: 47253 - RNA, 330 nt, Artificial Sequence
  derived and/or modified sequence opt6 from anti-HIV_V3_LightChain
caaagcguacuaacacaagcaccaucaagcucaggaacaccaggacaaucaguaacaauaucaugcucaggaucaagcucaaacauggaaauaaacuauguauauugguauagacaauucccaggaacagcaccacaauuacuaauauacaaugacaaucaaagaccaucaggaguaccagauagauuuagcgcaagcaaaagcggaacaucagcaucacuagcaauaggaggauuaagaucagaagaugaagcagacuauuucugugcaguauggcauggagauagaggaggaccaguauuuggaggaggaacaaaauuaacaguacua

SEQ ID NO: 47254 - RNA, 327 nt, Artificial Sequence
  derived and/or modified sequence opt6 from anti-HIV_V3_LightChain
ucauaugaauuaaaacaaccaagaucaguaucaguaucaccaggacaaacagcaagaauaacauguucaggagacgcaaugccaaaccaauacgcauacugguaccaacaaagaccaggcagagcaccaguacuauuaauauuuaaagacaacgaaagagcaucaggaauaccagaaagaauaucaggaucaucaucaggaacaacagcaacacuaacaauaaacagaguacaagcagaagacgaagcagauuacuuaugccaaagcgcagacucaucaggagcauuuccauggguauuuggaggaggaacaacauuaacaguacua

SEQ ID NO: 47255 - RNA, 324 nt, Artificial Sequence
  derived and/or modified sequence opt6 from anti-HIV_V3_LightChain
agcuaugaauuaacacaaccaccaagcguaagcguaaguccaggacaaacagcaagaauaacauguaguggagacgcacuaccaaaagaauacgcauacugguaccaacaaaaaaguggacaagcaccaguacuaguaauauaugaagauacaagaagaccaagcggaauaccagaaagauucucaggaucaagcucaggaacaauggcaacauuaacaguaagcggagcacauguagaugacgaagcagauuacuauugcuauagcagagacacaagcgcaaaccaauggguauucggaggaggaacaaaacuaacaguauua

SEQ ID NO: 47256 - RNA, 318 nt, Artificial Sequence
  derived and/or modified sequence opt6 from anti-HIV_V3_LightChain
gaaauaguacuaacacaaucaccagcaacacuaucauuaucaccaggagaaagagcaacacuaucaugcagagcaucacaaucaauaucaacauaccuaggaugguaccaacaaaaaccaggacaagcaccaagacuacuaauauacgacgcaucaaacagagcaacaggaauaccagcaagauucucaggaucaggaucaggaacagacuucacacuaacaauaucaucacuagaaccagaagacuucgcaguauacuacugccaacaaagauacacauggauaacauucggacaaggaacaagacuagaaauaaaa

SEQ ID NO: 47257 - RNA, 327 nt, Artificial Sequence
  derived and/or modified sequence opt6 from anti-HIV_V3_LightChain
ucauaugaauuaacacaaccaccaucaguaucaguaucaccaggacaaacagcaagaauaacaugcucaggagacgcacuaccaaaccaauacguauacugguaccaacaaagaccaggacaagcaccaguaguaguacuauauaaagacacagaaagaccaucaggaauaccagaaagauucucaggaucaucaucaggaacaacaguaacauuaacaauaucaggaguacaagcagaagacgaagcagauuacuacugccaaucagcagacaauucaggagcauacccauuauucuucggaggaggaacaaaauuaacaguacua

SEQ ID NO: 47258 - RNA, 333 nt, Artificial Sequence
  derived and/or modified sequence opt6 from anti-HIV_V3_LightChain
caaucaguauuaacacaaccaccaucaguaucagcagcaccaggacaaaaaguaacaauaucauguucaggaucaucaucaaauauaggaaacaauuacguacuaugguaccaacaauuuccaggaacagcaccaaaacuauuaauauacggaaauaacaaaagaccaucaggaauaccagacagauucucaggaucaaaaucaggaacaucagcaacauuaggaauaacaggacuacaaacaggagacgaagcagacuacuuuugcgcaacaugggacucaggauuaagcgcagacuggguauucggaggaggaacaaaauuaacaguacua

SEQ ID NO: 47259 - RNA, 321 nt, Artificial Sequence
  derived and/or modified sequence opt6 from anti-HIV_V3_LightChain
gacauacaaaugacacaauccccaucaucacuaucagcaucaguaggagacagaguaacaauaacaugcagagcaucacaagaaauagacaacuaccuagcaugguaccaacaaagaccaggaaaagcaccaaaaucacuaauauacgcagcaucaucacuacaaggaggaguaccaccaaaauucucaggaucaggaucaggaacagaauucacacuaacaauaucaucacuacaagcagaagacuucgcaacauacuacugccaacaauacaacgcauacccacuaacauucggacaaggaacaagacuagacauaaac

SEQ ID NO: 47260 - RNA, 324 nt, Artificial Sequence
  derived and/or modified sequence opt6 from anti-HIV_V3_LightChain
ucauacgaacuaacacaaccaccaucacuaucaguaucaccaggacaaacagcaucaauaacaugcucaggagacggacuaccaaaacaauacggauacugguaccaacaaaaaccaggacaagcaccacuauuaguaauacuaaaagacacagaaagaccaucaggaauaccagaaagauucucaggaucaucaucaggaacaacaguaacacuaacaauaucaggaguacaagcagaagacgaagcagacuacuacugccaaucaguagacucaacaggaucauacuacguauucggaccaggaacaaaaguaacaguacua

SEQ ID NO: 47261 - RNA, 324 nt, Artificial Sequence
  derived and/or modified sequence opt6 from anti-HIV_V3_LightChain
ucauacgaacuaacacaaccaccaucaguaucaguaucaccaggacaaacagcaagaauaacaugcucaggagacguauuaccaaaaaaauacgcauacugguaccaacaaaaaucaggacuagcaccaguacuaguaauauacgaagacaacagaagaccaucaggaauaccagaaagauucucaggaucaucaucaggaacaauggcaacacuaacaauaucaggagcacaaguagaagacgaaggagacuacuacugcagcucaacagacucaucaggagaccacuacguauucggaacaggaacaaaaguaacaguacua

SEQ ID NO: 47262 - RNA, 321 nt, Artificial Sequence
  derived and/or modified sequence opt6 from anti-HIV_V3_LightChain
gcauacgaacuaacacaaccaccaucaguaucaguaucaccaggacaaacagcaagaauaacaugcucagcagaagcacuaucaaaccaauacgcauacugguacagacaaagaccaggacaagcaccacuacuaauaauauacaaagacacaaaaagaccaucaggaauaccagaaagauucucaggaucaacaucaggaacaacaguaacacuaacaauaucaggaguacaagcagaagacgaagcagacuacuacugccaaucagcagacucaucaggagacuacguauucggaggaggaacaaaaguaacaguacua

SEQ ID NO: 47263 - RNA, 333 nt, Artificial Sequence
  derived and/or modified sequence opt6 from anti-HIV_CD4bs_LightChain
caaccaguauuaacacaaaguucaagugcaagcgcaagccuaggaucaagcguaaaauuaacauguacauuaggaucaggacauagcggaagcauaauagcauggcaucaacaacaaccaggaaaagcaccaagauaucuaaugaaaguacaaucaagcggaagcuauaacaaaggaucaggaguaccagauagauuuagcggaagcucaagcggagcagauagauaucuaacaauaucaaacuuacaauuugaagaugaaggagacuauuacugugaaacaugggauacaaauaaauauguauuuggaacaggaacaaaaguaacaguacua

SEQ ID NO: 47264 - RNA, 324 nt, Artificial Sequence
  derived and/or modified sequence opt6 from anti-HIV_CD4bs_LightChain
gaacucguacuaacacaaucaccaggaacauuaucauuaucacccggagaaagagcaacauuaucaugcagagcaucacaaucaguagcaucauacuaccuagcaugguaucaacaaaaaccaggacaagcaccaagacuacuaauauacggagcaucaucaagagcaacaggaauaccagacagauucucaggaucaguaucaggaacagacuucacacuaacaauaucaagauuagaaccagaagacuucgcacuauauuacugucaacaauacggaucaucaccauuaucauucggaggaggaacaaaaguagaaauaaga

SEQ ID NO: 47265 - RNA, 333 nt, Artificial Sequence
  derived and/or modified sequence opt6 from anti-HIV_CD4bs_LightChain
caaucagcacuaacacaaccaccaucaaugucaggaucaccaggacaaucaauaacaauaucaugcacaggaucaggaucagacguaggaucacacaacuucguaucaugguaccaacaacacccagcaagaguaccaaaacuacuaauauacgcaguaggaaacagaccaucaggaguaucagaaagauucucaggaucaaaaucaggaaacacagcauaccuaacaauaucaggacuacaagcagacgacgaagcagacuacuacugcucaagccacacaacaggaacaacacuagaaguauucggaggaggaacaagacuaacaguacua

SEQ ID NO: 47266 - RNA, 333 nt, Artificial Sequence
  derived and/or modified sequence opt6 from anti-HIV_CD4bs_LightChain
gauauaguaaugacacaaucaccauuaucauuaccaguaacaccaggagaaccagcaagcauuagcuguagaagcagcgaaucauuacuacauagcaauggauuuauauaucuagauugguaucuacaaaaaccaggacaaagcccacaauuacuaauauacuuaggaucaaaaagagcaucaggaguaagcgauagauuuagcggaagcggaagcggaacagcauucacacuaaaaauaucaagaguagaagcagaagauguaggaguauauuacuguaugcaagcauuagaaucaagaacauucggacaaggaacaaaacuagaaauaaaa

SEQ ID NO: 47267 - RNA, 327 nt, Artificial Sequence
  derived and/or modified sequence opt6 from anti-HIV_CD4bs_LightChain
gaaauaguacuaacacaaucaccaggaacacuaucacuaucaccaggagaaagagcaacacuaucaugcagagcaucacaaucaguaucaucaucauaccuagcaugguaccaacaaaaaccaggacaaucaccaagacuacuaauauacggagcaucaucaagagcaacaggaauaccagacagauucucaggaucaggaucaggaacagacuucacacuaacaauaucaagacuagaaccagaagacuucgcaguauacuacugccaacacuacggaucaucaucaauauucacauucggaccaggaacaaaaguagacauaaga

SEQ ID NO: 47268 - RNA, 330 nt, Artificial Sequence
  derived and/or modified sequence opt6 from anti-HIV_CD4bs_LightChain
aacuucaugcuaacacaaccacacucaguaucaggaucaccaggaaaaacaguaacaauaucaugcacaagaucaucaggaucaauagcaggaaacuacguacaaugguaccaacaaagaccaggaacaucaccaacaacaguaauauacgaaaacgaccaaagaucaucaggaguaccagacagauucucaggaucaauagacucaucaucaaacucagcaucacuaacaauaucaggauuaaaaacagaagacgaagcagacuacuacugccacucauacgacgcaacaaaccaaguauucggaggaggaacaaaacuaacaguacua

SEQ ID NO: 47269 - RNA, 333 nt, Artificial Sequence
  derived and/or modified sequence opt6 from anti-HIV_CD4bs_LightChain
gacguaguaguaacacaaucaccacuaucacuaccaguaacacuaggacaaccagcaucaauaucaugcagaucaucacaaucauuaguauacucagacggaacaacacaccuaaacugguaccaccaaagaccaggacaaccaccaagaagacuaauauacagaguaucaaacagagacucaggaguaccagacagauucucaggaucaggaucaggaacagacuucacacuaagaauaucaagaguagaagcagaagacguaggacuauacuacugcaugcuagcaacacacccauucacauucggaccaggaacaaaaguagaaauaaaa

SEQ ID NO: 47270 - RNA, 336 nt, Artificial Sequence
  derived and/or modified sequence opt6 from anti-HIV_CD4bs_LightChain
caaagcguacuaacacaaccaccaucaguaucaggagcaccaggacaaacaguaacaauaucaugcacaggaucaagcucaaacauaggaccaagcuaugacguacaaugguaccaacaauuuccaggaagagcaccaaaacuauuaauaucaggaaauaacaauagagcaagcggaguaccagacagauucucaggaucaaaaucaggaacaagcgcaagcuuagcaauaacaggacuacaaagcgaagacgaagcagauuacuauugucaaacauaugacucaagcuuaagcggacacguaguauuuggaggaggaacaagauuaacaguacua

SEQ ID NO: 47271 - RNA, 321 nt, Artificial Sequence
  derived and/or modified sequence opt6 from anti-HIV_CD4bs_LightChain
gacauacaaaugacacaaucaccaucaacacuaucagcaucaguaggagacagaguaacaauaacaugcagagcaucagcaucaauauacacauggcuagcaugguaccaacaaagaccaggaaaagcaccagaaguacuaauauacaaagcaucaacacuaaaaucaggaguaccaucaagauucucaggaucaggaucaggaacagaauucacacuaacaauaucaucacuacaaccaggagacuucgcaacauacuacugccaacaauacacaacauacccacuaacauucggaggaggaacaacaguagaaauaaaa

SEQ ID NO: 47272 - RNA, 330 nt, Artificial Sequence
  derived and/or modified sequence opt6 from anti-HIV_CD4bs_LightChain
caaucagcauuaacacaaccagcaagcguaucaggaucaccaggacaaucaauaacaauaucaugcacaggaacaucaaacgacauaggaacauacaaccuaguaucaugguaccaacaccacccaaacaaagcaccaaaaguaguaguauacgaaaacaacaaaagaccaucaggaauaucaaacagauucucaggaucaaaaucaggaaacacagcaucacuaacaauaucaggacuacaagcagaagacgaagcagacuacuacugcugcucauacgcaggaucaucaacauggguauucggaggaggaacaaaauuaacaguacua

SEQ ID NO: 47273 - RNA, 321 nt, Artificial Sequence
  derived and/or modified sequence opt6 from anti-HIV_V2_LightChain
gacauacaaaugacacaaucaccaucaacacuaucagcaucaguaggagacagaguaacaauaacaugcagagcaucacaaacaauaucaucauggcuagcaugguaccaacaaaaaucaggaacagcaccaaaauuauuaauauacaaagcaucaucaauaguaucaggaguaccaucaagauucucaggaucaggaucaggaacagaauucacacuaacaauaacaucacuacaaccagacgacuucgcaacauacuacugccaacaauacaacucaucaccagaaacauucggacaaggaacaaaaguagaaauaaaa

SEQ ID NO: 47274 - RNA, 318 nt, Artificial Sequence
  derived and/or modified sequence opt6 from anti-HIV_V2_LightChain
gaaauaguacuaacacaaucaccaggaacacuaucacuaucaccaggagaaagagcaacacuaucaugcagagcaucacaaucaguaucaucauaccuagcaugguaccaacaaaaaccaggacaagcaccaagacuacuaauauacgacgcaucaucaagagcaacaggaauaccagacagauucucaggaucaggaucaggaacagacuucacauuaacaauaucaagacuagaaccagaagacuucgcaguauacuacugccaacacuacgcaggaucaagaacauucggacaaggaacaaaaguagaaauaaaa

SEQ ID NO: 47275 - RNA, 333 nt, Artificial Sequence
  derived and/or modified sequence opt6 from anti-HIV_V2_LightChain
caaucaguacuaacacaaccaccaucaguaucaggagcaccaggacaaagaguaacaauaucaugcacaggaucaucaucaaacauaggagcacacuacgacguacacugguaccaacaacuaccaggaacagcaccaaaauuacuaauauacggaaacucaaacagaccaucaggaguaccagacagauucucaggaucaaaaucaggaacaucagcaucacuagcaauaacaggacuacaagcagaagacgaagcagacuacuacugccaaucauacgacucaucacuaucaggauacguauucggaacaggaacaaaaguaacaguacua

SEQ ID NO: 47276 - RNA, 324 nt, Artificial Sequence
  derived and/or modified sequence opt6 from anti-HIV_V2_LightChain
gacacaguaaugacacaaucaccagcaacacuaucaguaucaccaggagaacgaguaacacuaucaugcagagcaucacaaauaauaaacacaaaccuagcaugguaccaaaaaagaccaggacaagcaccaagacuacuaauauacgcagcaucagcaagagcaacaggaauaccagcaagauucucaggaucaggaucaggaacagaauucacacuaacaauaucaggacuacaaucagaagacucagcaguauacuacugccaacaauacaaacauuggccaccauacacauucggaagaggaacaaaacuagaaauaaga

SEQ ID NO: 47277 - RNA, 321 nt, Artificial Sequence
  derived and/or modified sequence opt6 from anti-HIV_V2_LightChain
gaaauagugcuaacacaaucaccaggaacauuaaguuuaagcccaggagaaagagcaacauuaagcuguagagcaagccaaagcguaaguucaagcuaucuagcaugguaucaacaaaaaccaggacaagcaccaagauuacuaauauacggagcaucaagcagagcaacaggaauaccagauagauuuagcggaagcggaagcggaacagauuucacacuaacaauaucaagauuagaaccagaagauuucgcaguauauuacugucaacaauacggaagcucaagaacauucggacaaggaacaaaaguagaaauaaaa

SEQ ID NO: 47278 - RNA, 321 nt, Artificial Sequence
  derived and/or modified sequence opt6 from anti-HIV_V2_LightChain
gacauacaaaugacacaaucaccaucaucacuaucagcaucaguaggagacagaguaacaauaacaugcagagcaucacaaucaauaucaggaaaccuaaacugguaccaacaaaaaccaggaaaagcaccaaaccuacuaauauacggagcaucaucacuacaaucaggaguaccaucaagauucucaggaucaggaucaggaacagacuucacacuaacaauaucaucacuacaaccagaagacuucgcaacauaccacugccaacaaucacacucaacaucauggacauucggacaaggaacaaaaguaguaauaaaa

SEQ ID NO: 47279 - RNA, 327 nt, Artificial Sequence
  derived and/or modified sequence opt6 from anti-HIV_10E8
gcaagcgaacuaacacaagauccaacaguaucaguagcacuaggacaaacaguaacaauaacaugcagaggagacagcuuaagaaaucacuauacaucaugguaucaacaaaaaacaggacaagcaccaguauuacuaauauacccaaaacauaacagaagcccaggaauaagcgacagauuuagcgcaagcucaagcggaaacacagcaucacuaacaauaacaggagcacaaacagaagaugaaggagacuauuacugcaguucaagagauaaaucaggaucaagauuaguaacauucggaggaggaacagaaguaacaggauua

SEQ ID NO: 47280 - RNA, 327 nt, Artificial Sequence
  derived and/or modified sequence opt6 from anti-HIV_10E8
gcaucagaacuaacacaagacccaacaguaucaguagcacuaggacaaacaguaacaauaacaugcagaggagacucauuaagaaaccacuacacaucaugguaccaacaaaaaacaggacaagcaccaguacuauuaauauacccaaaacacaacagaucaccaggaauaucagacagauucucagcaucaucaucaggaaacacagcaucacuaacaauaacaggagcacaaacagaagacgaaggagacuacuacugcucaucaagagacaaaucaggaucaagacuaguaacauucggaggaggaacaaaaguaacaguagua

SEQ ID NO: 47281 - RNA, 327 nt, Artificial Sequence
  derived and/or modified sequence opt6 from anti-HIV_10E8
gcaucagaacuaacacaagacccaacaguaucaguagcacuaggacaaacaguaacaauaacaugcagaggagacagcuuaagaaacuacuacacaucaugguaccaacaaaaaccaggacaagcaccaguacuauuaauauacccaaaacacaacagaccaccaggaauaucagacagauucagcgcaagcucaucaggaaacacagcaucacuaacaauaacaggagcacaaacagaagacgaaggagacuacuacugcucaucaagagacaaaucaggaucaagauuaguaacauucggaggaggaacaaaaguaacaggacua

SEQ ID NO: 47282 - RNA, 327 nt, Artificial Sequence
  derived and/or modified sequence opt6 from anti-HIV_10E8
gcaucagaacuaacacaagacccaacaguaucaguagcacuaggacaaacaguaacaauaacaugcagaggagacucacuaagaaacuacuacacaucaugguaccaacaaaaaccaggacaagcaccaguacuacuaauauacccaaaacacaacagaccaccaggaauaucagacagauucucagcaucaucaucaggaaacacagcaucacuaacaauaacaggagcacaaacagaagacgaaggagacuacuacugcagcucaagagacaaaucaggaucaagacuaguaacauucggaagaggaacaaaacuaacaguagua

SEQ ID NO: 47283 - RNA, 327 nt, Artificial Sequence
  derived and/or modified sequence opt6 from anti-HIV_10E8
gcaucagaacuaacacaagacccaacaguaucaguagcacuaggacaaacaguaacaauaacaugcagaggagacucacuaagaaaccacuacacaucaugguaccaacaaaaaacaggacaagcaccaguauuacuaauauacccaaaacacaacagaucaccaggaauaucagacagauucucagcaucaucaucaggaaauacagcaucauuaacaauaacaggagcacaaacagaagacgaaggagacuacuacugcucaucaagagacaaaucaggaucaagacuaguaacauucggaggaggaacaaaaguaacaguacua

SEQ ID NO: 47284 - RNA, 327 nt, Artificial Sequence
  derived and/or modified sequence opt6 from anti-HIV_10E8
gcaucagaacuaacacaagacccaacaguaucaguagcacuaggacaaacaguaacaauaacaugcagaggagacucacuaagaaacuacuacacaucaugguaccaacaaaaaccaagacaagcaccaguacuacuaauauacccaaaacacaacagaccaccaggaauaucagacagauucucagcaucaucaagcggaaacacagcaucacuaacaauaacaggagcacaaacagaagacgaaggagacuacuacugcucaucaagagacaaaucaggaucaagauuaguaacauucggaggaggaacaaaacuaacaguacua

SEQ ID NO: 47285 - RNA, 327 nt, Artificial Sequence
  derived and/or modified sequence opt6 from anti-HIV_10E8
gcaucagaacuaacacaagauccaacaguaucaguagcacuaggacaaacaguaacaauaacaugcagaggagacucacuaagaaacuacuacacaucaugguaccaacaaaaaccaggacaagcaccaguacuacuaauauacccaaaacacaacagaccaccaggaauaucagacagauucucagcaucaucaucaggaaacacagcaucacuaacaauaacaggagcacaaacagaagacgaaggagacuacuacugcucaucaagagacaaaucaggaucaagauuaguaacauucggaggaggaacaaaacuaacaguacua

SEQ ID NO: 47286 - RNA, 327 nt, Artificial Sequence
  derived and/or modified sequence opt6 from anti-HIV_10E8
gcaucagaacuaacacaagacccaacaguaucaguagcacuaggacaaacaguaacaauaacaugcagaggagacucacuaagaaaccacuacacaucaugguaccaacaaaaaacaggacaagcaccaauacuacuaauauacccaaaacacaacagaccaccaggaauaucagacagauucucagcaucaucaucaggaaacacagcaucacuaacaauaacaggagcacaaacagaagacgaaggagacuacuacugcucaucaagagacaaaucaggaucaagacuaguaacauucggaggaggaacaaaacuaacaguacua

SEQ ID NO: 47287 - RNA, 327 nt, Artificial Sequence
  derived and/or modified sequence opt6 from anti-HIV_10E8
ucaagugaucuaacacaagauccagcaguaucaguagcacuaggacaaacaguaagaauaacaugccaaggagauagcuuaagaagauacuaugcaggaugguaucaacaaaaaccaggacaagcaccaguauuaguaguauacggaagagauaacagaccaucaggaauaccagauagauuuagcggaagcacaagcggaaacacagcaucacuaacaauagcaggagcacaagcagaagaugacgcagacuauuacuguaguucaagagauaaaucaggaucaagauuaagcguauucggaggaggaacaaaacuaacaguauua

SEQ ID NO: 47288 - RNA, 327 nt, Artificial Sequence
  derived and/or modified sequence opt6 from anti-HIV_10E8
gcaagcgaacuaacacaagauccagcaguaucaguagcauucgaaaaaacaguaacaauaacaugccaaggagauagcuuaagaucacacuauguaucaugguaucaaaaaagaccaggacaagcaccaguauuaguauuuuacggaaaaaauaacagaccaucaggaauaccagacagauuuagcggaagcacaagcggaaacacagcaucacuaacaauagcaggagcacaagcagaagaugacgcagacuauuacuguagcucaagagauaaaucaggaucaagauuaagcguauucggaggaggaacaaaacuaacaguacca

SEQ ID NO: 47289 - RNA, 327 nt, Artificial Sequence
  derived and/or modified sequence opt6 from anti-HIV_10E8
gcaagcgaauuaacacaagauccagcaguaucaguagcacuaaaacaaacaguaacaauaacaugcagaggagauagcuuaagaucacacuauguaucaugguaucaacaaaaaccaggacaagcaccaguauuaguauuuuacggaaaaaauaacagaccaucaggaauaccagauagauuuaguggaagcucaagcggaaacacagcaucacuaacaauagcaggagcacaagcagaagaugacgcagacuauuacuguaguucaagagauaaaucaggaucaagauuaagcguauucggaggaggaacaaaacuaacaguauua

SEQ ID NO: 47290 - RNA, 327 nt, Artificial Sequence
  derived and/or modified sequence opt6 from anti-HIV_10E8
ucaagcgaacuaacacaagauccaggaguaucaguagcacuaaaacaaacaguaacaauaacaugcaggggagauagcuuaagaucacacuauguaucaugguaucaaaaaaaaccaggacaagcaccaguauuaguauuuuacggaaaaaauauaggaccaucaggaauaccagauagauuuaguggaagcacaagcggaaacacagcaucacuaacaauagcaggagcacaagcagaagaugacgcagacuauuacuguagcucaagagauaaaucaggaucaagauuaagcguauucggaggaggaacaaaacuaacaguauua

SEQ ID NO: 47291 - RNA, 327 nt, Artificial Sequence
  derived and/or modified sequence opt6 from anti-HIV_10E8
gcaagcgaacuaacacaagauccagcaguaucaguagcacuaaaacaaacaguaacaauaacaugcagaggagauagcuuaagaucacacuauguaucaugguaucaaaaaaaaccaggacaagcaccaguauuaguauuuuacggaaaaaauaacagaccaucaggaauaccagauagauuuagcggaagcucaagcggaaacacagcaucacuaacaauagcaggagcacaagcagaagaugacgcagacuauuacuguagcucaagagauaaaucaggaucaagauuaagcguauucggaggaggaacaaaacuaacaguauua

SEQ ID NO: 47292 - RNA, 327 nt, Artificial Sequence
  derived and/or modified sequence opt6 from anti-HIV_10E8
gcaagcgaauuaacacaagauccaggaguaucaguagcacuaaaacaaacaguaacaauaacaugcagaggagauagcuuaagaucacacuauguaucaugguaucaaaaaagaccaggacaagcaccaguauuaguauuuuacggaaaaaauaacagaccaucaggaauaccagauagauuuagcggaagcacaagcggaaacacagcaucacuaacaauagcaggagcacaagcagaagaugacgcagacuauuacuguagcucaagagauaaaucaggaucaagauuaagcguauucggaggaggaacaaaacuaacaguauua

SEQ ID NO: 47293 - RNA, 327 nt, Artificial Sequence
  derived and/or modified sequence opt6 from anti-HIV_10E8
gcaagcgaacuaacacaagauccaggaguaucaguagcacuagaacaaacaguaacaauaacaugcagaggagauagcuuaagaucacacuauguaucaugguaucaaaaaaaaccaggacaagcaccaguauuaguauuuuacggaaaaaauaacagaccaucaggaauaccagauagauuuagcggaaguacaagcggaaacacagcaucauuaacaauagcaggagcacaagcagaagaugacgcagacuauuacuguagcucaagagauaaaucaggaucaagauuaagcguauucggaggaggaacaaaacuaacaguauua

SEQ ID NO: 47294 - RNA, 327 nt, Artificial Sequence
  derived and/or modified sequence opt6 from anti-HIV_10E8
gcaagugaacuaacacaagauccaggaguaucaguagcacuaaaacaaacaguaacaauaacaugcagaggagauagcuuaagaucacacuauguaucaugguaucaaaaaaaaccaggacaagcaccaguauuaguauuuuacggaaaaaauaacagaccaucaggaauaccagauagauuuagcggaagcacaagcggaaacacagcaucacuaacaauagcaggagcacaagcagaagaugacgcagacuauuacuguagcucacgagauaaaucaggaucaagauuaagcguauucggaggaggaacaaaauuaacaguauua

SEQ ID NO: 47295 - RNA, 327 nt, Artificial Sequence
  derived and/or modified sequence opt6 from anti-HIV_10E8
ucaagcgaacuaacacaagauccaggaguaucgguagcacuaaaacaaacaguaacaauaacaugcagaggagauagcuuaagaucacacuauguaucaugguaucaaaaaaaaccaggacaagcaccaguauuaguauuuuacggaaaaaauaacaggccaucaggaauaccagauagauuuagcggaagcacaagcggaaacacagcaucacuaacaauagcaggagcacaagcagaagaugacgcagacuauuacuguagcucaagagauaaaucaggaucuagacuaagcguauucggaggaggaacaaaacuaacaguacua

SEQ ID NO: 47296 - RNA, 327 nt, Artificial Sequence
  derived and/or modified sequence opt6 from anti-HIV_10E8
ucgagcgaacuaacacaagaaacaggaguaucaguagcacuaggaagaacaguaacaauaacaugcagaggagauaguuuaagaucacacuaugcaucaugguaucaagaaaaaccaggacaagcaccaaaauuacuauuuuacggaaaaaauaacagaccaucaggaauaccagauagauuuagcggaagugcaagcggaaacagagcaucacuaacaauaucaggagcacaagcagaagaugacgcagaauauuacuguagcucaagagauaaaucaggaucaagauuaaguguauucggaggaggaacaaaacuagcaguauua

SEQ ID NO: 47297 - RNA, 327 nt, Artificial Sequence
  derived and/or modified sequence opt6 from anti-HIV_10E8
ucaagugaacuaacacaagaaacaggaguaucaguagcgcuaggaagaacaguaacaauaacaugcagaggagauagcuuaagaucacacuaugcaucaugguaucaaaaaaaaccaggacaagcaccaaaauuacuauuuuacggaaaaaauaacagaccaucaggaauaccagauagauuuagcggauucgcaagcggaaacagagcaucacuaacaauaucaggagcacaagcagaagaugacgcagaauauuacuguagcucaagagauaaaucaggaucaagauuaagcguauucggaggaggaacaaaacuaacaguauua

SEQ ID NO: 47298 - RNA, 327 nt, Artificial Sequence
  derived and/or modified sequence opt6 from anti-HIV_10E8
ucaagcgaacuaacacaagaaacaggaguaucaguagcacuaggaagaacaguaacaauaacaugcagaggagauagcuuaagaucacacuaugcaucaugguaucaaaaaaaaccaggacaagcaccaaaauuacuauuuuacggaaaaaauaacagaccaucaggaauaccagauagauuuagcggaagcgcaagcggaaacagagcaucacuaacaauaucaggagcacaagcagaagaugacgcagaauauauauguaguucaagagauaaaucaggaucaagacuaagcguauucggaggaggaacaaaacuaacaguauua

SEQ ID NO: 47299 - RNA, 327 nt, Artificial Sequence
  derived and/or modified sequence opt6 from anti-HIV_10E8
ucaagugaacuaacacaagaaacaggaguaucaguagcacuaggaagaacaguaacaauaacaugcagaggagauagcuuaagaucacacuaugcaucaugguaucaaaaaaaaccaggacaagcaccaaaauuacuauuuuacggaaaaaauaacagaccaucaggaauaccagauagauuuagcggaagcgcaagcggaaacagagcaucacuaacaauaucaggagcacaagcagaagaugacgcagaauauuacuguagcucaagagauaaaucaggaucaagauuaaguguauucggaggaggaacaaaacuaacaguauua

SEQ ID NO: 47300 - RNA, 327 nt, Artificial Sequence
  derived and/or modified sequence opt6 from anti-HIV_10E8
ucaagcgaacuaacacaagaaacaggaguaucaguagcacuaggaagaacaguaacaauaacaugcagaggagauagcuuaagaucacacuaugcaucaugguaucaaaaaaaaccaggacaagcaccaauauuacuauuuuacggaaaaaauaacagaccaucaggaauacacgauagauuuagcggaagcgcaagcggaaacagagcaucacuaacaauaucaggagcacaagcagaagaugacgcagaauauuacuguagcucaagagauaaaucaggaucaagauuaaguguauucggaggaggaacaaaacuaacaguauua

SEQ ID NO: 47301 - RNA, 393 nt, Artificial Sequence
  derived and/or modified sequence opt6 from anti-HIV_10E8
gaaguacaauuaguagaaaguggaggagauuuaguaaaaccaggaggaaguuuaagauuaagcuguagugcaaguggauuuaguuuuaaaaauacauggaugacauggguaagacaagcaccaggaaaaggauuagaauggguaggaagaauaacaggaccaggagaaggauggacaagugauuaugcagcaacaguacaaggaagauuuacaauaaguagaaauaauaugauagauauguuauauuuagaaaugaauagauuaagaacagaugauacaggauuauauuauuguguacauacagaaaaauauuauaauuuuuggggaggauauccaccaggagaagaauauuuucaacauuggggaagaggaacauuaguaauaguaaguagu

SEQ ID NO: 47302 - RNA, 393 nt, Artificial Sequence
  derived and/or modified sequence opt6 from anti-HIV_10E8
gaaauaagauuaguagaaaguggaggaggauuaguaaaaccaggaggaagccuaagauuaaguuguagcgcaagcggauucaauuucgauagcgcauggaugacauggguaagacaaccaccaggaaaaggacuagaauggguaggaagaauaacaggaccaggagaaggauggagcguaggauaugcagaaagcguaaaaggaagauuuauaauaagcagaauaaauagcauaaacuuucuauauuuagaaaugaauaauuuaagaccagaagauacaggaaguuauuucugugcacauacaggaaaacauuacgauuucuggagaggauacccaccaggagaagaauacuuucaagauuggggacaaggaacacaaguaauaguaaguagu

SEQ ID NO: 47303 - RNA, 393 nt, Artificial Sequence
  derived and/or modified sequence opt6 from anti-HIV_10E8
gaaauaagauuaguagaaaguggaggaggauuaguaaaaccaggaggaagucuaagauuaagcuguagcgcgagcggauucaauuucgauagcgcauggaugacauggguaagacaaccaccaggaaaaggacuagaauggguaggaagaauaacaggaccaggagaaggauggagcguagacuaugcagaaagcguaaaaggaagauuuauaauaagcagaauaaauaguauaaauuuucuauaucuagaaaugaauaacuuaagaccagaagauacaggaaguuauuucugugcacauacaggaaaacauuacgauuucuggagaggauacccaccaggagaagaauacuuucaagauuggggacaaggaacacaaguaauaguaaguagc

SEQ ID NO: 47304 - RNA, 393 nt, Artificial Sequence
  derived and/or modified sequence opt6 from anti-HIV_10E8
gaaguaagauuaguagaaaguggaggaagauuaguaagaccaggaggaaguuuaagauuaaguuguagcgcaaguggauuuaauuuugauaaugcauggaugacauggguaagacaaccaccaggaaaaggauuagaauggguaggaagaauaacaggaccaggagaaggauggaguguagauuaugcagcaaguguaaaaggaagauuuacaauaaguagaaugaauaguauaaauuuuuuuuauuuagaaaugaauaauuuaaaaauagaagauacaggguuauauuuuugugcaagaacaggaaaacauuaugcauuuuggggaggauauccaccaggagaagaauauuuagaagauuggggacaaggaacauuaguaauaguaaguagc

SEQ ID NO: 47305 - RNA, 393 nt, Artificial Sequence
  derived and/or modified sequence opt6 from anti-HIV_10E8
gaaguaagauuaguagaaaguggaggaggauuaguaaaaccaggaggaaguuuaagauuaaguuguagugcaaguggauuuaauuuugaugaugcauggaugacauggguaagacaaccaccaggaaaaggacuagaauggguaggaagaauaaguggaccaggagaaggauggaguguagauuaugcagaaagcguaaaaggaagauuuacaauaaguagauuaaauaguauaaauuuucuauauuuagaaaugaauaauguaagaacagaagauacaggauauuauuuuugugcaagaacaggaaaacauuaugauuuuuggaguggauauccaccaggagaagaauauuuucaagauuggggacaaggaacauuaguaauaguaaguagu

SEQ ID NO: 47306 - RNA, 393 nt, Artificial Sequence
  derived and/or modified sequence opt6 from anti-HIV_10E8
gaaguaagauuagcagaaagcggaggaggauuaguaaaaccaggaggaaguuuaagauuaaguuguagugcaaguggauuugauuuugauaaugcauggaugacauggguaagacaaccaccaggaaaaggauuagaauggguaggaagaauaacaggaccaggagaaggauggaguguagauuaugcagcaccaguggaaggaagauuuacaauaaguagauuaaauaguauaaauuuuuuauauuuagaaaugaauaauuuaagaauggaagauaguggauuauauuuuugugcaagaacaggaaaauauuaugauuuuuggaguggauauccaccaggagaagaauauuuucaagauuggggacagggaacauuaguaauaguaccaagu

SEQ ID NO: 47307 - RNA, 393 nt, Artificial Sequence
  derived and/or modified sequence opt6 from anti-HIV_10E8
gaaguaagauuaguagaaagcggaggaggauuaguaaaaccaggaggaaguuuaagauuaaguuguagugcaaguggauuugauuuugauaaugcauggaugacauggguaagacaaccaccaggaaaaggauuagaauggguaggaagaauaacgggaccaggagaaggauggaguguagauuaugcagcaccaguagaaggaagauuuacgauaaguagauuaaauaguauaaauuuuuuauauuuagaaaugaauaauuuaagaauggaagauaguggauuauauuuuugugcaagaacaggaaaauauuaugauuuuuggaguggauauccaccaggagaagaauauuuucaagauuggggacaaggaacauuaguaauaguaccaagu

SEQ ID NO: 47308 - RNA, 393 nt, Artificial Sequence
  derived and/or modified sequence opt6 from anti-HIV_10E8
gaaguaagauuaguagaaaguggaggaggauuaguaaaaccaggaggaaguuuaagauuaaguuguagugcaaguggauuugauuuugauaaugcauggaugacauggguaagacaaccaccaggaaaaggauuagaauggguaggaagaauaacaggaccaggagaaggauggaguguagauuaugcagcaccaguagaaggaagauuuacaauaaguagauuaaauaguauaaauuuuuuauauuuagaaaugaauaauuuaagaauggaagauaguggauuauauuuuugugcaaggacaggaaaauauuaugauuuuuggaguggauauccaccaggagaagaauauuuucaagauuggggacaaggaacauuaguaauaguaaguagc

SEQ ID NO: 47309 - RNA, 393 nt, Artificial Sequence
  derived and/or modified sequence opt6 from anti-HIV_10E8
gaaguaagauuagcagaaaguggaggaggauuaguaaaaccaggaggaaguuuaagauugaguuguagugcaaguggauuugauuuugauaaugcauggaugacauggguaagacaaccaccaggaaaaggacuagaauggguaggaaggauaacaggaccaggagaaggauggaguguagauuaugcagcaccaguagaaggaagauuuacaauaaguagacuaaauaguauaaauuuuuuauauuuagaaaugaauaauuuaagaauggaagauaguggauuauauuuuugugcaagaacaggaaaauauuaugauuuuuggaguggauauccaccaggagaagaauauuuucaagauuggggaagaggaacauuaguaauaguaucaagc

SEQ ID NO: 47310 - RNA, 393 nt, Artificial Sequence
  derived and/or modified sequence opt6 from anti-HIV_10E8
gaaguaagauuaguagaaaguggaggaggauuaguaaaaccaggaggaaguuugagauuaaguuguagugcaaguggauuugauuuugauaaugcauggaugacauggguaagacaaccaccaggaaaaggauuagaauggguaggaagaauaacaggaccaggagaaggauggaguguagauuaugcggcaccaguagaaggaagauuuacaauaaguagauuaaauaguauaaauuuuuuauauuuagaaaugaauaauuugagaauggaagauaguggauuauauuuuugugcaagaacaggaaaauauuaugauuuuuggaguggauauccaccaggagaagaauauuuucaagauuggggaagaggaacauuaguaauaguaaguagu

SEQ ID NO: 47311 - RNA, 333 nt, Artificial Sequence
  derived and/or modified sequence opt6 from anti-HIV-1_LightChain
caaucaguauuaacacaaccaccaagcguaagugcagcaccaggacaaaaaguaacaauaagcuguagcggaagaucaagcaauauaggaaacaauaauguauucugguaccaacaauuaccaggaacagcaccaaaacuauuaauauaugacaaugacaaaagaccaagcggaauaccagacagauucucaggaucaaaaucaggaacaagcgcaacauuaggaauaacaggacuacaaacaggagacgaagcagauuacuauugcggaacaugggacagcucauuaagcgcaggaggaguauuuggaacaggaacaaaaguaacaguacua

SEQ ID NO: 47312 - RNA, 336 nt, Artificial Sequence
  derived and/or modified sequence opt6 from anti-HIV-1_LightChain
caaagcguacuaacacaaccagcaucaguaucaggaucaccaggacaaucaauaacaauaagcugcacaggaacaaaaucagacauaggaggauacaaauacguaagcugguaccaacaacacccaggaaaagcaccaaaaauacuaauauaugacguaaacaaaagaccaagcggaauaccagacagauucucaggaucaaaaucaggaacaagugcaacacuaggaauaacaggauuacaaacaggagacgaagcagacuacuacugcggaacaugggacaacagccuaagcacaggaggaguauucggaacaggaacaaaaguaacaguacua

SEQ ID NO: 47313 - RNA, 321 nt, Artificial Sequence
  derived and/or modified sequence opt6 from anti-HIV-1_LightChain
caaucaguauuaacacaaccaccaagcguaucagcagcaccaggacaaagaguaacaauaagcuguuucggaucaagauucaguucaguaucaugguaccaacaauuaccaggaacagcaccaaaacuauuaauauaugaaaauacaaaaagaccaucaggaauaccagacagauucucaggaucaaaaucaggaacaucagcaacauuaggaauaacaggacuacaaacaggagacgaagcagacuacuauugcggaacaugggacagaucauuaucagcaggaggaguauuuggaacaggaacaaaaguaacaguacua

SEQ ID NO: 47314 - RNA, 333 nt, Artificial Sequence
  derived and/or modified sequence opt6 from anti-HIV-1_LightChain
caaucaguacuaacacaaccaccaucagcaucaggaacaccaggacaaacaauaacaauaucaugcucaggaucaagcucaaacauaggaucaaacgacguauacugguaccaacaccuaccaggaacaacacccaaaguaguaauauacaaaaacaacagaagaccaucaggaauaccagacagauucagcggaucaaaaucaggaacaucagcaacacuaggaauaacaggacuacaaacaggagacgaagcagacuacuacugcggaacaugggauagaucacuaucagcaggaggaguauucggaacaggaacaaaaguaacaguacua

SEQ ID NO: 47315 - RNA, 327 nt, Artificial Sequence
  derived and/or modified sequence opt6 from anti-HIV-1_LightChain
caaucaguacuaacacaaccaccaucaaugucagcagcaccaggacaaaaaguaacaauaucaugcucaggaucaacaucaauaauaggaaacaacuacauaucaugguaccaacaacuaccaggaacagcaccaaaacuacuaauauacgaagacaacaaaagaccaucaggaauaccagacagauucucaggaucaaaaucaggaacaucagcaacacuaggaauaacaggauuacaaacaggagacgaagcagacuacuacugcggaacauggcacucaucacuaucagcaggaggaguauucggaacaggaacaaaaguaaca

SEQ ID NO: 47316 - RNA, 333 nt, Artificial Sequence
  derived and/or modified sequence opt6 from anti-HIV-1_LightChain
caaucaguauuaacacaaccaccaucaguaucagcagcaccaggauuaaaaguaacaauaucaugcucaggaaacacaucaaauguaggagacaacuucguaagcugguacagauaccuaccaggaacagcaccaaaacuacuaucauacgaagacgacaaaagaccaucaggaauaccagacagauucucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 47317 - RNA, 333 nt, Artificial Sequence
  derived and/or modified sequence opt6 from anti-HIV-1_LightChain
caaucaguauuaacacaaccaccaagcgcaucaggaacaccaggacaaagaguaacaauaucauguucaggaucaucaagcaauauaggaucaaauacaguaaacugguaccaacaauuuccaggaacagcaccaaaacuauuaauauaugaaaauaacagaagaccaucaggaguaccagcaagauucucaggaucaaaaucaggaacaucagcaacauuagcaauaacaggacuacaaacaggagacgaagcagacuacuauugcgcaacaugggacucaucauuaucagcaggaggaguauuuggaacaggaacaaaaguaacaguacua

SEQ ID NO: 47318 - RNA, 318 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaucaucaagcaacauaggaaacaacuacguaucaugguaccaacaacuaccaggaacagcaccaaaacuacuaauauacgaaaacaacaaaagaccaucaggaauaccagacagauucucaggaucaaaaucaggaacaucagcaacacuaggaauaacaggacuacaaacaggagacgaagcagacuacuacugcggaacaugggacaacucacuaucaacaggaggaguauucggaacaggaaca

SEQ ID NO: 47319 - RNA, 288 nt, Artificial Sequence
  derived and/or modified sequence opt6 from anti-HIV-1_LightChain
ggauuaucaccaucacuauguucaggaagcucaagcaauauaggaaacaauuacguaagcugguaccaacaauuaccaggaacagcaccaaaacuauuaauauaugaaaauacaaaaagaccaagcggaauaccagacagauucucaggaucaaaaucaggaacaagcgcaacauuaggaauaacaggacuacaaacaggagacgaaggagauuacuauugcggaacaugggacagaaguuuaagcgcaggaggaguauuuggaacaggaacaaaaguaacaguacua

SEQ ID NO: 47320 - RNA, 333 nt, Artificial Sequence
  derived and/or modified sequence opt6 from anti-HIV-1_LightChain
caauuuguauuaacacaaccaccaagcguaagcgcagcaccaggacaaagaguaacaguaagcuguagcggaacaacaagcgauauaggagaaaauuacguaagcugguaccaaaaauuuagcgaagcagcaccaaaacuacuacuauaugacaaugacaaaagaccaagcggaauaccagacagauucucaggaucaaaaucaggaacaagcgcaacacuaggaauaacaggacuacaaacaggagacgaagcagauuacuauugcggaacaugggacagcucauuaagcgcaggaggaguauuuggaacaggaacaaaaguaacaguacua

SEQ ID NO: 47321 - RNA, 327 nt, Artificial Sequence
  derived and/or modified sequence opt6 from anti-HIV-1_LightChain
caaucaguauuaacacaaccaccaagcguaagcgcagcaccaggacaaaaaguaacaauaagcuguagcggaggaucaagcaauauaggaaacuauuacguaagcugguacuuacaauuaccaggaacagcaccaaaacuauuaauauaugaaaauaacaaaagaccaagcggaauaccagacagauucucaggaucaaaaucaggaacaagcgcaacauuaggaauaacaggauuacaaacaggagacgaagcagauuacuauugcggaacauggcacagcucauuaagcgcaggaggagucuuuggaacaggaacaaaaguaaca

SEQ ID NO: 47322 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaaacaugucaaacauaggagacaacgcaguaucaugguacagacaaguaccagaagcaccaccacaacuacuaauauucggaaacgacaaaagaccaucaggaguaacagacagauucucaggaucaaaaucaggaacaucagcaacacuaggaauaacaggacuacaaacaggagacgaagcagacuacuacugcggaacaugggacagaucacuaucagcaggaggaguauucggaacaggaacaaaaguaacaguacua

SEQ ID NO: 47323 - RNA, 336 nt, Artificial Sequence
  derived and/or modified sequence opt6 from anti-HIV-1_LightChain
caaucaguacuaacacaaccaccaucaguaucaggagcaccaggacaaagaguaacaauaucauguacaggaucaucaucaaauauaggagcaggauacgacguacacugguaccuacaacuaccaggaacagcaccaagacuacuaauauacgacaacgauaaaagaccaucaggaauaccagacagauucucaggaucaaaaucaggaacaucagcaacacuaggaauaacaggacuacaaacaggagacgaagcagacuauuacugcggaacauggcacucaucacuaucagcaggaggaguauucggaacaggaacaaaaguaacaguacua

SEQ ID NO: 47324 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaucaacaucaaacauaggaaacaacuucguaucaugguaccaacaacuaccaggaacagcaccaaaacuacuauucuacgacaacuacaaaagaccaucaggaauaccagacagauucucaggaucaaaaucaggaacaucagcaacacuagcaauaacaggauuacaaacaggagacgaagcagacuacuacugcgcaacaugggacucaucacuaucagcaggaggaguauucggaacaggaacaaaaguaacaguacua

SEQ ID NO: 47325 - RNA, 336 nt, Artificial Sequence
  derived and/or modified sequence opt6 from anti-HIV-1_LightChain
caaaguguauuaacacaaccaccaucaguaucaggagcaccaggacaaagaguaacaauaucaugcacaggaggaagcucaaauauaggagcaggauaugauguacacugguaccaacacuuaccaggaacagcaccacaacuauuaauauaugaaaauacaaaaagaccaagcggaauaccagacagauuuucaggaucaaaaucaggaacaagcgcaacauuaggaauaacaggauuacaaacaggagacgaagcagauuauuauugcggaacaugggacagaaguuuaagcgcaggaggaguauuuggaacaggaacaaaaguaacaguacua

SEQ ID NO: 47326 - RNA, 333 nt, Artificial Sequence
  derived and/or modified sequence opt6 from anti-HIV-1_LightChain
caaucaguauuaacacaaccaccaucauuaagcgcagcaccaggacaaagaguaacaguaagcuguagcggaagcagcaguaauauaggagacaauuacguaagcugguaccaacaauuaccaggagcagcaccaagacuauuaauauaugaaaauaacaaaagaccaagcggaauaccagacagauucucaggaaguaaaucaggaacaagcgcaacauuaggaauaacaggacuacaaacaggagacgaagcagauuacuauugcggaacaugggacaauagcuuaagcacaggaggaguauuuggaacaggaacaaaaguaacaguacua

SEQ ID NO: 47327 - RNA, 333 nt, Artificial Sequence
  derived and/or modified sequence opt6 from anti-HIV-1_LightChain
caaagcguauuaacacaaccaccaagcguaagcgcagcaccaggacaaaaaguaacaauaagcuguagcggaagaucaagcaauauaggaaacuauuucguaagcugguaccaacaauuuccaggaacagcaccaaaacuauuaauauaugacaauaacaaaagaccaagcggaauaccagacagauucucaggaucaaaaucaggaacaagcgcaacauuaggaauaacaggacuacaaacaggagacgaagcagauuacuauugcggaacaugggacagaucauuaagcgcaggaggaguauuuggaacaggaacaaaaguaacaguacua

SEQ ID NO: 47328 - RNA, 333 nt, Artificial Sequence
  derived and/or modified sequence opt6 from anti-HIV-1_LightChain
caaucaguacuaacacaaccaccaucagcaucaggaacaccaggacaaagaguaacaauaucaugcucaggaucaucaucaaacauaggaucaaacgcaguacacugguucagacaacuaccaggaacagcaccaaaacuacuaauauacgaaaacaacaaaagaccaucaggaauaccagacagauucucaggaucaaaaucaggaacaucagcaacauuaggaauaacaggacuacaaacaggagaugaagcagacuacuacugcgcaacaugggacucaucacuaucagcaggaggaguauucggaacaggaacaaaaguaacaguacua

SEQ ID NO: 47329 - RNA, 333 nt, Artificial Sequence
  derived and/or modified sequence opt6 from anti-HIV-1_LightChain
caaucaguauuaacacaaccaccaucaguaucagcagcaucaggacaaaaaguaacaauaucaugcucaggaucaucaucaaacauaggaaacaacuacguaagcugguaccaccaacuaccaggaacagcaccaaaacuacuaauauacgacacaaacaaaagaccaucaggaauaccagacagauucucaggaucaacaucaggaacaucagcaacacuaggaauaacaggacuacaaacaggagacgaagcagacuacuacugcggaacaugggacaacucacuaucaacaggaggaguauucggaacaggaacaaaaguaacaguacua

SEQ ID NO: 47330 - RNA, 333 nt, Artificial Sequence
  derived and/or modified sequence opt6 from anti-HIV-1_LightChain
caaccaguacuaacacaaccaccaucaguaucagcagcaccaggacaaacaguaacaauaucauguucaggaucauucucaaauauagaaacaaauuacguaucaugguaccaacaacuaccaggaacagcaccaaaacuauuaauauacgacaauaacaugagaccaucaggaauaccagacagauucucaggaucaaaaucaggaacaucagcaacacuaggaauaacaggacuacaaacaggagacgaagcagacuacuacugcggaacaugggacacaagccuaucagcaggaggaguauucggaacaggaacaaaaguaacaguacua

SEQ ID NO: 47331 - RNA, 336 nt, Artificial Sequence
  derived and/or modified sequence opt6 from anti-HIV-1_LightChain
caaccaguauuaacacaaccaccaucaguaucaggagcaccaggacaaagaguaacaauaucaugcacaggaucaucaucaaacauaggagcaggauacgacguacacugguaccaacaacuaccaggaaccgcaccaaaacuacuaauauacgaaaacaacaaaagaccaucaggaauaccagacagauucucaggaucaaaaucaggaacaucagcaacacuaggaauaacaggacuacaaaccggagacgaagcagacuacuacugcggaacaugggacaauucacuaucaacaggaggaguauucggaacaggaacaaaaguaacaguacua

SEQ ID NO: 47332 - RNA, 333 nt, Artificial Sequence
  derived and/or modified sequence opt6 from anti-HIV-1_LightChain
caaucaguacuaacacaaccaccaucacuaucagcagcaccaggacaaagaauaacaauaucaugcucaggaucaucaucaaacauaggaaacaacuacguaucaugguaccaacaauucccaggaacagcaccaaaacuacuaauauacgaaaacaacaaaagaccaucaggaauaccagacagauucucagcaucaaaaucaggaacaucagcaacauuaggaauaacaggacuacaaacaggagacgaagcaaacuacuacugcggaacauggcacucaucacuaucagcaggaggaguauucggaacaggaacaaaaguaacaguacua

SEQ ID NO: 47333 - RNA, 333 nt, Artificial Sequence
  derived and/or modified sequence opt6 from anti-HIV-1_LightChain
caaucaguauuaacacaaccaccaucaguaucagcagcaccaggacaaagaguaacaauaucauguuucggaucaagauucaauguaggaacaucaucaguaucaugguaccaacaauuaccaggaacagcaccaaaacuauuaauagaugcaaauggagaaagaccaucaggaauaccagacagauucucaggaucaaaaucaggaacaucagcaacauuaggaauaacaggacuacaaacaggagacgaagcagauuacuauugcggaacaugggacucaucacuaucagcaggcggaguauuuggaacaggaacaaaaguaacaguacua

SEQ ID NO: 47334 - RNA, 333 nt, Artificial Sequence
  derived and/or modified sequence opt6 from anti-HIV-1_LightChain
caaucaguauuaacacaaccaccaagcguaagcgcaacaccaggacaaaaaguaacaauaagcuguagcggaagcagaagcaauauaggaagccauuacguaagcugguaccaacaauuuccaggaacagcaccaaaacuauuaauauaugacaauaacaaaagaccaagcggaauaccagacagauucucaggaucaaaaucaggaacaagcgcaacacuaggaauaacaggacuacaaacaggagacgaagcagauuacuauugcggaacauggcacagcucauuaagcgcaggaggaguauuuggaacaggaacaaaaguaacaguacua

SEQ ID NO: 47335 - RNA, 333 nt, Artificial Sequence
  derived and/or modified sequence opt6 from anti-HIV-1_LightChain
caaucaguauuaacacaaccaccaagcgcaaguggaacaccaggacaaagaguaacaauaagcuguagcggaagcucaagcaauauaggaagcaaucacguauacugguaccaacaauuaccaggaaaaacaccaaaacuauuaauauauagaaauaaccaaagaccaagcggaauaccagacagauucucaggaucaaaaucaggaacaagcgcaacauuaggaauaacaggacuacaaacaggagacgaagcagauuacuauugcggaacaugggacucaaguuuaagcacaggaggaguauuuggaacaggaacaaaaguaacaguacua

SEQ ID NO: 47336 - RNA, 333 nt, Artificial Sequence
  derived and/or modified sequence opt6 from anti-HIV-1_LightChain
caaucaguauuaacacaaccaccaucaguaucagcagcaccaggacaaaaaguaacaauaucaugcucaggaucaucagcaaacauaggaaacaacuacguaucaugguaccaacaauucccaggaacaggaccaagacuaauaauauacgaaucaaacaaaagaccaagcggaauaucagacagauucucaggaucacaaucagacgcagcagcaacacuagacauaacaggacuacaaacaggagacgaagcagacuacuacugcggaacaugggacucaucacuaucagcaggaggaguauucggaacaggaacaagaguaacaguacua

SEQ ID NO: 47337 - RNA, 336 nt, Artificial Sequence
  derived and/or modified sequence opt6 from anti-HIV-1_LightChain
caaaguguacuaacacaaccaccaucaguaucaggagcaccaggacaaacaguaacaauaucaugcacaggagauacaucaaacauaggagcagacuauagaguacacugguaccaacaauuaccaggaacagcaccaaaacuauuaauauaugaaaauaacaaaagaccaagcggaauaccagacagauucucaggaucaaaaucaggaacaagcgcaacauuaggaauaacaggacuacaaacaggagacgaagcagauuacuauugcggaacaugggacaauagcuuaagcacaggaggaguauuuggaacaggaacaaaaguaacaguacua

SEQ ID NO: 47338 - RNA, 333 nt, Artificial Sequence
  derived and/or modified sequence opt6 from anti-HIV-1_LightChain
caaucaguauuaacacaaccaccaucauuaagcgcagcaccaggacaaagaguaacaguaagcuguagcggaagcucaagcaauauaggaaacaauuacguaagcugguaccaacaauuaccaggagcagcaccaaaacuauuaauauauaacaauaacauaagaccaagcggaauaccagaaagauucucaggaucaaaaucaggaacaucagcaacauuaggaauaacaggacuacaaacaggagacgaaggagauuacuauugcggaacaugggacagaaguuuaagcgcaggaggaguauuuggaacaggaacaaaaguaacaguacua

SEQ ID NO: 47339 - RNA, 333 nt, Artificial Sequence
  derived and/or modified sequence opt6 from anti-HIV-1_LightChain
caaucaguacuaacacaaccaccaucagcaucaggaacaccaggacaaagaguaacaauaucaugcucaggaucaucaucaaauauaggaggcaacuacguaucaugguaccaacaacuaccaggaacagcaccaaaacuacuaauaucagaaaacaacaaaagaccaucaggaauaccagacagauucucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 47340 - RNA, 333 nt, Artificial Sequence
  derived and/or modified sequence opt6 from anti-HIV-1_LightChain
caaagucuacuaacacaaccaccaucaguaucagcagcaccaggacaaaaaguaacaauaucaugcagcggaucaucaucaaauauaggaaacaacuucguaucaugguaccaacaacuaccaggaacagcaccaaaacuauuaauauacgaaaauaacaugagaccaucaggaauaccagacagauucucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 47341 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaacaucaucaaacauagcaaacuacuacguaucaugguacagacaacuaccaggaacagcaccaaaauuacuaauauacgaaaacaacaaaagaccaucaggaauaccagacagauucagcggaucaaaaucaggaacaucagcaacauuaggaauaacaggacuccaaacaggagacgaagcagacuacuacugcggaacaugggacucaucacuaucagcaggaggaguauucggaacaggaacaaaaguaacaguacua

SEQ ID NO: 47342 - RNA, 333 nt, Artificial Sequence
  derived and/or modified sequence opt6 from anti-HIV-1_LightChain
caaccaguauuaacacaaccaccaagcguaagcggagcaccaggacaaagaguaacaauaagcuguagcggaagcagcagcaauauaggaaacaaugacguaagcugguaccaacaaguaccaggaacagcaccaaaauuauuaauauaugaaaauaacaaaagaccaagcggaauaccagacagauucucaggaucaaaaucaggaacaagcgcaacauuaggaauaacaggacuacaaacaggagacgaagcagauuacuauugcggaacaugggacacaucauuaagcgcaggaggaguauuuggaacaggaacaaaaguaacaguacua

SEQ ID NO: 47343 - RNA, 333 nt, Artificial Sequence
  derived and/or modified sequence opt6 from anti-HIV-1_LightChain
caauuaguauuaacacaaccaccaucaguaucagcagcaccaggacaaagaguaacaauaucauguuucggaucaagauucaauguaggaacaucaucaguaucaugguaccaacaauuaccaggaacagcaccaaaacuauuaauagaugcaaauggagaaagaccaucaggaauaccagacagauucuuuggaucagaaucaggaacaucagcaacauuaggaauaacaggacuacaaacaggagacgaagcagauuacuauugcggaacauggcacucaucauuaucagcaggaggaguauuuggaacaggaacaaaaguaacaguacua

SEQ ID NO: 47344 - RNA, 333 nt, Artificial Sequence
  derived and/or modified sequence opt6 from anti-HIV-1_LightChain
ucauacgaacuaacacaaccaccaucaguaucagcagcaccaggacaaaaaguaacaauaucaugcucaggaucaucaucaaacauaggaaacaacuacguaucaugguaccaacaacuaccaggaacagcaccaaaacuacuaauauacgaaaacaacaaaagaccaucaggaauaccagacagauucucaggaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 47345 - RNA, 333 nt, Artificial Sequence
  derived and/or modified sequence opt6 from anti-HIV-1_LightChain
caaucaguauuaacacaaccaccaucagcaucaggaacaccaggacaaagaguaacaauaucauguagcggaucaacaucaaauauaggaacauauuacguaucaugguaccaacaauuaccaggaacagcaccaaaacuauuaauauaugaaaauacaaaaagaccaucaggaauaccagacagauucucaggaucaaaaucaggaacaucagcaacauuaggaauaaccggacuacaaacaggagacgaaggagacuacuauugcggaacaugggacagaucauuaucagcaggaggaguauuuggaacaggaacaaaaguaacaguacua

SEQ ID NO: 47346 - RNA, 336 nt, Artificial Sequence
  derived and/or modified sequence opt6 from anti-HIV-1_LightChain
caaucagcacuaacacaaccagcaucaguaucagcaucaccaggacaaucaauagcaauaucaugcacaggaacaucaucagacguaggcucauacaacuacguaucaugguaccaacaauuaccaggaacagcacccaaacuacuaauauacgaaaacacaaaaagaccaaguggaauaccagacagauucucaggaucaaaaucaggaacaucagcaacacuaggaauaacaggacuacaaacaggagacgaagcagacuacuacugcggaacaugggacagaucacuaucagcaggaggaguauucggaacaggaacaaaaguaacaguacua

SEQ ID NO: 47347 - RNA, 330 nt, Artificial Sequence
  derived and/or modified sequence opt6 from anti-HIV-1_LightChain
caaucaguauuaacacaaccaccaucaguaucagcagcaccaggacaaagaguaacaauaucaugcucaggaggaucaucaaauauaggaaacaaucacguaucaugguaccaacaccuaccaggaagagcaccacaacuacuaauauaugacacaacacaaagaccaucaggaauaccagacagauucucaggaucaaaaucaggaacaucagcaacauuaggaauaacaggacuacaaacaggagacgaagcagacuacuacugcggaacaugggacucaucacuaucaacaggaggaguauucggaacaggaacaaaaguaacagua

SEQ ID NO: 47348 - RNA, 333 nt, Artificial Sequence
  derived and/or modified sequence opt6 from anti-HIV-1_LightChain
caaucaguauuaacacaaccaccaagcgcaagcggaacaccaggacaaagaguaacaauaagcuguagcggaagcucaagcaauauaggaagcaaauacguaugcugguaccaacaauuaccaggaacagcaccaaaacuauuaauauauagaaauaaccaaagaccaagcggaauaccagacagauucucaggaucaaaaucaggaacaagcgcaacauuaggaauaacaggacuacaaacaggagacgaagcagauuacuauugcggaacauggcacagcucauuaagcgcaggaggaguauuuggaacaggaacaaaaguaacaguacua

SEQ ID NO: 47349 - RNA, 333 nt, Artificial Sequence
  derived and/or modified sequence opt6 from anti-HIV-1_LightChain
caaucaguauuaacacaaccaccaagcguaagcgcagcaccaggacaaaaaguaacaauaagcuguagcggagacucaagcacauucgaaaacgauuacguaugcugguaccaacaauuaccaggaacagcaccaaaacuauuaauauaugacaauaacaaaagaccaagcggaauaccagacagauucucaggaucaaaaucaggaacaagugcaacauuaggaauaacaggacuacaaacaggagacgaagcagauuacuacugcggaacauggcacagcucauuaagcgcaggaggaguauuuggaacaggaacaaaaguaacaguacua

SEQ ID NO: 47350 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaucaucaucaaacauaggaaacaacuacguaucaugguaccaacaacuaccaggaacagcaccaaaacuauuaauauacggaaacucaaacagaccaucaggaguaccagacagauucucaggaucaaaaucaggaacaucagcaucacuagcaauaacaggacuacaagcagaagacgaagcagacuacuacugcggaacaugggacucaucacuaucagcaggaggaguauucggaacaggaacaaaaguaacaguacua

SEQ ID NO: 47351 - RNA, 333 nt, Artificial Sequence
  derived and/or modified sequence opt6 from anti-HIV-1_LightChain
caaucaguauuaacacaaccaccaagcguaagcgcagcaccaggacaaacaguaacaauaagcuguagcggaagcucaaguaauauaggaagcaauacaguaaacugguaccaacaauuaccaggaacagcaccaaaacuauuaauauaugaaaauaacaaaagaccaagcggaauaccagacagauucucaggaucaaaaucaggaacaagcgcaacauuaggaauaacaggacuacaaacaggugacgaagcagauuacuauugcggaacaugggacaauagcuuaagcacaggaggaguauuuggaacaggaacaaaaguaacaguacua

SEQ ID NO: 47352 - RNA, 336 nt, Artificial Sequence
  derived and/or modified sequence opt6 from anti-HIV-1_LightChain
caaagcguacuaacacaaccaccaucaguaucaggagcaccaggacaaagaguaacaauauuuugcacaggaucaaguucaaacguaggaggaggauaugacguacacugguaccaacaauuaccaggaacagcaccaaaacuacuaauauaugaaaauaacaaaagaccaagcggaauaccagacagauucucaggaucaaaaucaggaacaagcgcaacauuaggaauaacaggacuacaaacaggagacgaagcagauuacuauugcggaacaugggacagcucauuaagcgcaggaggaguauuuggaacaggaacaaaaguaacaguacua

SEQ ID NO: 47353 - RNA, 333 nt, Artificial Sequence
  derived and/or modified sequence opt6 from anti-HIV-1_LightChain
caaucaguacuaacacaaccaccaucaguaucagcagcaccaggacaaaaaguaacauuaucauguucaggaucaucaucaaacauaggaaacaauucaguaucaugguaccaacaauucccaggaacagcaccaaaacuauuaauauacgacucagacaaaagaccaucaggaauaccagacagauucucaggaucaaaaucaggaacaucagcaacacuaggaauaacaggacuacaaacaggagacgaaggagacuacuacugcggaacaugggacagaucacuaucagcaggaggaguauucggaacaggaacaaaaguaacaguacua

SEQ ID NO: 47354 - RNA, 333 nt, Artificial Sequence
  derived and/or modified sequence opt6 from anti-HIV-1_LightChain
caaaguguacuaacacaaccaccaucagcaucaggaacaccaggacaaaaaguaacaauaucaugcucaggaucaucaucacaaauaggaucaaacucaguauacugguaccaacaacuaccaggaacaacaccaaaauuacuaauauacggaaacaaccaaagaccaucaggaauaccagacagauucucaggaucaaaaucaggaacaucagcaacacuaggaauaacaggacuacaaacaggagacgaagccgacuacuacugcggaacaugggacucaucacuaucagcaggaggaguauucggaacaggaacaaaaguaacaguacua

SEQ ID NO: 47355 - RNA, 336 nt, Artificial Sequence
  derived and/or modified sequence opt6 from anti-HIV-1_LightChain
caaagcgcacuaacacaaccagcaucaguaucaggaucaccaggacaaucaauaacaauaucaugcacaggaacaggaucagacguaggaggauacaaucacguaagcugguaccaacaacauccaggaaaagcaccaaaacuauuaauauaugacaauaacaaaagaccaagcggaauaccagacagauucucaggaucaaaaucaggaacaagcgcaacauuaggaauaacaggacuacaaacaggagacgaagcagauuacuauugcggaacauggcacagcucauuaagcgcaggaggaguauuuggaacaggaacaaaaguaacaguacua

SEQ ID NO: 47356 - RNA, 333 nt, Artificial Sequence
  derived and/or modified sequence opt6 from anti-HIV-1_LightChain
caaucaguacuaacacaaccaccaucaguaucagcagcaccaggacaaagaguaacaauaucauguucaggaucaggaucaaauauaggagacagauucguaucaugguaccaacacuuaccaggaacaguaccaaaacuauuaauauacgacaaugaacauagaccaucaggaauaccagacagauucucaggaucaaaaucaggaacaucagcaacacuaggaauaacaggacuacaaacaggagacgaagcagauuacuacugcggaacaugggacucaucacuaucagcaggaggaguauucggaacaggaacaaaaguaacaguacua

SEQ ID NO: 47357 - RNA, 333 nt, Artificial Sequence
  derived and/or modified sequence opt6 from anti-HIV-1_LightChain
caaucaguacuaacacaaccaccaucaguaucagcagcaccaggacaaaaaauaacaauaucaugcucaggaucaucaucaaacauaggaaaaucaguaguaucaugguacagacaauucccaggaacagcaccaaaacuacuaauauacgacacauacaaaagaccaucaggaauaccagacagauucucaggaucaaaaucaggaacaucagcaacacuaggaauaacaggacuacaaacaggagacgaagcagacuacuacugcggaacauggcacucaucacuaucagcaggaggaguauucggaacaggaacaaaaguaacaguacua

SEQ ID NO: 47358 - RNA, 333 nt, Artificial Sequence
  derived and/or modified sequence opt6 from anti-HIV-1_LightChain
caaccaguauuaacacaaccaccaucagcaucaggaacaccaggacaaagaguaacaauaucauguucaggaucaucaucaaauauaggaggaaauacaguaaacugguaccaacaauuuccaggagcagcaccaagacuauuaauauaugaagauaacaaaagaccaucaggaauaccagacagauucucaggaaguaaaucaggaacaagcgcaacauuaggaauaacaggacuacaaacaggagacgaagcagauuacuauugcggaacaugggacucaucauuaucagcaggaggaguauuuggaacaggaacaaaaguaacaguacua

SEQ ID NO: 47359 - RNA, 333 nt, Artificial Sequence
  derived and/or modified sequence opt6 from anti-HIV-1_LightChain
aacuucaugcuaacacaaccacacucaguaucagaaucaccaggaaaaacaguaacaauaucaugcacaagaucaucaggaucaguagcaucaaacuacguacaaugguaccaacaacuaccaggaacagcaccaaaacuacuaauauacgaaaacaacaaaagaccaucaggaauaccagacagauucucaggaucaaaaucaggaacaucagcaacauuaggaauaacaggacuacaaacaggagacgaagcagacuacuacugcggaacauggcacucaucacuaucagcaggaggaguauucggaacaggaacaaaaguaacaguacua

SEQ ID NO: 47360 - RNA, 333 nt, Artificial Sequence
  derived and/or modified sequence opt6 from anti-HIV-1_LightChain
caaucaauguuaacacaaccaccaucaguaucagcagcaccaggacaaagaguaacaguaucauguucaggaucaucaucaaauauaggaucacauuucguaucaugguaccaacaauuaccaggaacagcaccaaaacuauuaauauaugacaauucaaauagaccaucagcaauaccagacagauucucaggaucaaaaucaggaacaucagcaacauuaggaauaucaggacuacauacaggagacgaagcagauuacuauugcgcaacaugggacaauucauuaucaacaggaggaguauuuggaacaggaacaaaaguaacaguacua

SEQ ID NO: 47361 - RNA, 333 nt, Artificial Sequence
  derived and/or modified sequence opt6 from anti-HIV-1_LightChain
caaucaguauuaacacaaccaccaagcguaagugcagcaccaggacaaaaaguaauaauaaguuguaguggaggaucaagcaauauaggaaacaauuucguaagcugguaccaucaauuaccaggaacagcaccaaaacuauuaauauaugaaaauacaaaaagaccaagcaaaauaccagcaagauucucaggaucaaaaucaggaacaagcgcaacauuaggaauaacaggacuacaaacaggagacgaagcagauuacuauugcggaacaugggacaguagcuuaagugcaggaggaguauuuggaacaggcacaaaaguaacaguauua

SEQ ID NO: 47362 - RNA, 315 nt, Artificial Sequence
  derived and/or modified sequence opt6 from anti-HIV-1_LightChain
caaucacuacuaacacaaccaccaucaguaucagcagcaccaggacaaaaaguaacaauaucaugcucaggaucaucaucaaacauaggaaacaacuacguaucaugguaccaacaacuaccaggaacagcaccaaaacuauuaauauacgaaaacaacaaaagaccaucaggaauaccagacagauucucaggaucaaaaucaggaacaucagcaacacuaggaauaacaggacuacaaacaggagacgaagcagacuacuacugcggaacaugggacucaucacuaucagcaggaggaguauucggaacagga

SEQ ID NO: 47363 - RNA, 336 nt, Artificial Sequence
  derived and/or modified sequence opt6 from anti-HIV-1_LightChain
caaagcgcacuaacacaaccagcaagcguaucaggaucaccaggacaaucaauaacaauaucaugcacaggaacaagcucagacauaggaucauacucauucguaagcugguaccaacaacauccaggaaaagcaccaaaacuaauaauauaugacguaaacaaaagaccaagcggaauaccagacagauucucaggaucaaaaucaggaacaagcgcaacauuaggaauaacaggauuacaaacaggagacgaagcagacuacuauugcggaacaugggacagaucauuaagcgcaggaggaguauuuggaacaggaacaaaaguaacaguacua

SEQ ID NO: 47364 - RNA, 336 nt, Artificial Sequence
  derived and/or modified sequence opt6 from anti-HIV-1_LightChain
caaaguguacuaacacaaccaccaucaguaucaggagcaccaggacaaagaguaacaauaucauguacaggaaauaguucaaauauaggagcaggauuugacguacacugguacagacaucuaccaggaacagcaccaaaacuauuaauauaugaaaauacaaaaagaccaaguggaauaccagacagauucucaggaucaaaaucaggaacaagugcaacauuaggaauaacaggauuacaaacaggagacgaagcagauuacuauugcggaacaugggacagaagccuaagugcaggaggaguauuuggaacaggaacaaaaguaacaguacua

SEQ ID NO: 47365 - RNA, 333 nt, Artificial Sequence
  derived and/or modified sequence opt6 from anti-HIV-1_LightChain
caaucaguauuaacacaaccaccaucaguaucagcagcaccaggacaaaaaguaacaauaucaugcucaggaggaucaucaaacauaggaaacuacuacguaucaugguaccuacaacuaccaggagcagcaccaaaacuacuaauauacgacacagacaaaagaccaucaggaauaccagacagauucucaggaucaaaaucaggaacaucagcaacacuaggaauaacaggacuacaaacaggagacgaagcagacuacuacugcggaacaugggacagaucacuaucagcaggaggaguauucggaacaggaacaaaaguaacaguacua

SEQ ID NO: 47366 - RNA, 333 nt, Artificial Sequence
  derived and/or modified sequence opt6 from anti-HIV-1_LightChain
caaucaguacuaacaagaccaccaucaguaucagcagcaccaggacaaaaaguaacaauaucaugcucaggaagaucaucaaauauaggaaacaacuacguaucaugguaccaacaacuaccaggagcagcaccaaaacuacuaauauacgaaaacaacaaaagaccaucaggaauaccagacagauucucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 47367 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaacaauaucaaacauaggagcaaacuuaguaucaugguacagacaacuaccaggaacaguaccaacaguacuaauacacgaaaacaacaaaagaccaucaggaauaccagacagauucagcggaucaaaaucaggaacaucagcaacacuaggaauaacaggacuacaaacaggagacgaagcagacuacuacugcggaacauggcacucaucauuaucagcaggaggaguauucggaacaggaacaaaaguaacaguacua

SEQ ID NO: 47368 - RNA, 327 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaucaucaucaaacauaggaaacaacuucguaucaugguaccaacaacuaccaggaacagcaccaaaacuacuaauauacgaaaacacaaaaagaccaucaggaauaccagacagauucucaggaucaaaaagcggaacaucagcaacacuaggaauaacaggacuacaaacaggagacgaagcagacuacuacugcggaacaugggacagaucacuaucagcaggaggaguauucggaacaggaacaaaaguaaca

SEQ ID NO: 47369 - RNA, 333 nt, Artificial Sequence
  derived and/or modified sequence opt6 from anti-HIV-1_LightChain
caaucaguauuaacacaaagcccaagcguaagugcagcaccaggacaaagaguaacaauaucauguagcggaggaucaagcaauauaggaagcaaugcaguaagcugguaccaacaauuaccaggaacagcaccaaaacuauuaauauauggagauacaaugagaccaagcggaauaccagacagauucucaggaucaaaaucaggaacaagcgcaacauuaggaauaacaggacuacaaacaggagacgaagcagauuacuauugcggaacaugggacagaaguuuaagcgcaggaggaguauuuggaacaggaacaaaaguaacaguacua

SEQ ID NO: 47370 - RNA, 333 nt, Artificial Sequence
  derived and/or modified sequence opt6 from anti-HIV-1_LightChain
caaucaguacuaacacaaccaccaucaguaucagcagcaccaggacaacaaguaacaauaucaugcucaggaacaacaucaaacauaggaacaaacuacguaucaugguaccaacaaaugccaccagcagcaccaaaacuacuaauauacgacaacaaaaaaagaccaucagacauaccagacagauucucaggaucaaaaucaggaacaucagcaacacuaggaauaacaggacuacaaacaggagacgaagcagacuacuacugcggaacaugggacagaucacuaucagcaggaggaguauucggaacaggaacaaaaguaacaguccua

SEQ ID NO: 47371 - RNA, 333 nt, Artificial Sequence
  derived and/or modified sequence opt6 from anti-HIV-1_LightChain
caaucaguaguaacacaaagcccaagcgcaagcggaacaccaggacaaagaguaauaauaagcuguagcggaagcucaagcaauauaggaaacauauacguaagcugguaccaacaauuaccaggaacagcaccaaaacuauuaauauaugaaaauaacaaaagaccaagcggaauaccagacagauucucaggaucaaaaucaggaacaucagcaacauuaggaauaacaggacuacaaacaggagacgaagcagauuacuauugcggaacauggcacagcucauuaagcgcaggaggaguauuuggaacaggaacaaaaguaacaguacua

SEQ ID NO: 47372 - RNA, 333 nt, Artificial Sequence
  derived and/or modified sequence opt6 from anti-HIV-1_LightChain
caaagcguauuaacacaaccaccaagcaugagcgcagcaccaggacaaaaaguaacaauaagcuguagcggaagcacaagcauaauaggaaacaauuacauaagcugguaccaacaauuaccaggaacagcaccaaaacuauuaauauaugaagauaacaaaagaccaagcggaauaccagacagauucucaggaucaaaaucaggaacaagcgcaacauuaggaauaacaggacuacaaacaggagacgaagcagauuacuauugcggaacaugggacagaucauuaagcgcaggaggaguauuuggaacaggaacaaaaguaacaguacua

SEQ ID NO: 47373 - RNA, 336 nt, Artificial Sequence
  derived and/or modified sequence opt6 from anti-HIV-1_LightChain
caaagcgcacuaacacaaccaccaucagcaucaggaucaagaggacaaucaguaauaauaucaugcacaggaacaagcucagacguaggaguauacaaucuaguaagcugguaccaacaauuaccaggaacagcaccaaaacuauuaauauaugaaaauaacaaaagaccaagcggaauaccagacagauucucaggaucaaaaucaggaacaagcgcaacauuaggaauaacaggauuacaaacaggagacgaagcagauuacuauugcggaacauggcacucaaguuuaagcgcaggaggaguauuuggaacaggaacaaaaguaacaguacuc

SEQ ID NO: 47374 - RNA, 333 nt, Artificial Sequence
  derived and/or modified sequence opt6 from anti-HIV-1_LightChain
caaucaguauuaacacaaccaccaaguaugagcgcagcaccaggacaaagcguaaguauaagcuguagcggaagcucagacaauauagaaagaaaucaaguaauauggcuaagacaaguaccaggagcagcaccaacaguauuaauaauauucaauaacagaagaccaagcggaguaccagacagauucucaggaucaagaucaggaacaagcgcaacauuaggaauaacagggcuacaaacaggagacgaagcagauuacuauugcggaacaugggacagaaguuuaagcgcaggaggaguauuuggaacaggaacaaaaguaacaguacua

SEQ ID NO: 47375 - RNA, 333 nt, Artificial Sequence
  derived and/or modified sequence opt6 from anti-HIV-1_LightChain
caaucaguacuaacacaaccaccaucaguaucagcagcaccaggacaaacaguaacaauaucaugcucaggaucauucucaaacauagaaacaaacuacguaucaugguaccaacaacuaccaggaaccgcaccaaaacuauuaauauacgaaaacacaaaaagaccaucaggaauaccagacagauucucaggaucaaaaucaggaacaucagcaacacuaggaauaacaggacuacaaacaggagacgaagcagacuacuacugcggaacaugggacagaucacuaucagcaggaggaguauucggaacaggaacaaaaguaacaguacua

SEQ ID NO: 47376 - RNA, 333 nt, Artificial Sequence
  derived and/or modified sequence opt6 from anti-HIV-1_LightChain
caaucauuacuaacacaaccaccaucaguaucagcagcaccaggacaaaaaguaacaauaaguugcucaggaucaucaucaaacauaggaucaaaauacguaugcugguaccaacaauuaccaggaacagcaccaaaacuacuaauauacgaaaacacaaaaagaccaucaggaauaccagacagauucucaggaucaaaaucaggaacaucagcaacauuaggaauaacaggacuacaaacaggagacgaagcagacuacuacugcggaacaugggacagaucacuaucagcaggaggaguauucggaacaggaacaaaaguaacaguacua

SEQ ID NO: 47377 - RNA, 336 nt, Artificial Sequence
  derived and/or modified sequence opt6 from anti-HIV-1_LightChain
caaagcgcacuaacacaaccaagaucaguaucaggaucaccaggacaaucaguaacaauaucaugcacaggaacaacaucagacguaggaggauacaauuacguaagcugguaccaacaauuaccaggaacagcaccaaaacuauuaauauaugaaaauaacaaaagaccaagcggaauaccagacagauucucaggaucaaaaucaggaacaagcgcaacauuaggaauaacaggacuacaaacaggagacgaagcagauuacuauugcggaacaugggacaauagcuuaagcacaggaggaguauuuggaacaggaacaaaaguaacaguacua

SEQ ID NO: 47378 - RNA, 333 nt, Artificial Sequence
  derived and/or modified sequence opt6 from anti-HIV-1_LightChain
caaucaguauuaacacaaccaccaagcguaagcgcagcaccaggacaaagaguaacaauaagcuguacaggauucacaagcaauauaggauuaaauuacguaagcugguaccaacaaguaccaggaacaacaccaaaauuaguaauauuugaaaaugacagaagauuucuaggaauaccagacagauucucaggaucaaaaucaggagcaagcgcaacacuaggaauaacaggacuacaaacaggagacgaagcagauuacuauugcggaacaugggacucaagccuaagcgcaggaggaguauuuggaacaggaacaaaaguaacaguauua

SEQ ID NO: 47379 - RNA, 333 nt, Artificial Sequence
  derived and/or modified sequence opt6 from anti-HIV-1_LightChain
caaucaguacuagcacaaccaccaucaguaucagcagcaccaggacaaaaaguaacaauaucaugcucaggaagaacaucaaacauaggaaacaacuacguaucaugguaccaacaacuaccaggaacagcaccaaaacuacuaauauacgaaaacaacaaaagaccaucaggaauaccagacagauucucaggaucaaaaucaggaacaucagcaacacuaggaauaacaggacuacaaacaggagacgaagcagacuacuacugcggaacaugggacacaagccuaucagcaggaggaguauucggaacaggaacaaaaguaacaguacua

SEQ ID NO: 47380 - RNA, 333 nt, Artificial Sequence
  derived and/or modified sequence opt6 from anti-HIV-1_LightChain
caaucaguacuaacacaaccaacaucaguaucagcagcaccaggaagauggguaacaguaucaugcucaggaacaagaucaaauauaggagaccacagcguaucaugguuccaacaccuaccaggagcagcaccaaaauuacuaauauacgaaaacaacaaaagaccaucaggaauaccagacagauucucaggaucaaaaucaggaacaucagcaacacuaggaauaacaggacuacaaacaggagacgaagcagacuacuacugcggaacaugggacucaucacuaucaacaggaggaguauucggaacaggaacaaaaguaacaguauua

SEQ ID NO: 47381 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaucaucaucaaacauaggagacaacuacguaucaugguaccaacaauucccaggaacagcaccaaaacuacuaauaucagaaaacaacaaaagaccaucaggaauaccagacagauucucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 47382 - RNA, 333 nt, Artificial Sequence
  derived and/or modified sequence opt6 from anti-HIV-1_LightChain
caagcacuacuaacacaaccaccaucaguaucagcagcaccaggacaaaaaguaacaauaucaugcucaggaucaucaucaaacauaggaaacaacuauguaucaugguaccaacaacuaccaggaacagcaccaaaacuauuaauaucagaaaacaacaaaagaccaucaggaauaccagacagauucucaggaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 47383 - RNA, 333 nt, Artificial Sequence
  derived and/or modified sequence opt6 from anti-HIV-1_LightChain
caacuaguacuaacacaaccaccaucagcaucaggaacaccaggacaaagaguaacaauaucaugcucaggaucaacaucaaacauaggaacauacuacguauacugguaccaacuacuaccaggaacaacaccaaaaguacuaauauacgcaaacgaccaaaggccaucaggaauaccagacagauucucaggaucaaaaucaggaacaagcgcaacacuaggaauaaccggacuacaaacaggagacgaagcagacuacuacugcggaacaugggacucaucacuaucaacaggaggaguauucggaacaggaacaaaaguaacaguacua

SEQ ID NO: 47384 - RNA, 333 nt, Artificial Sequence
  derived and/or modified sequence opt6 from anti-HIV-1_LightChain
caaagcguauuaacacaaccaccaagcguaagcgcagcaccaggacaaaaaguaacaauaaguuguagcggaacaucaagcaauauaggaaacaauuucguaagcugguaccaaagauuaccaggaacagcaccaaaacuauuaauauuugaaaaugacaaaagaccaagcggaauaccagacagauucucaggaucaaaaucaggaacaagugcaacauuaggaauaacaggacuacaaacaggagacgaagcagauuacuauugcggaacaugggacagaucauuaagcgcaggaggaguauuuggaacaggaacaaaaguaacaguacua

SEQ ID NO: 47385 - RNA, 333 nt, Artificial Sequence
  derived and/or modified sequence opt6 from anti-HIV-1_LightChain
caaucaguauuaacacaaagcccaagcguaagugcaacaccaggacaaagaguaacaauaagcuguagcggaaacacaagcaauauaggaaaaaauuucguaagcugguaccaacaauuuccaggaacagcaccaaaauuauuaauauaugacaaugacaaaagaccaagcggaauaccagacagauucucaggaucaaaaucaggaacaagugcaacauuaggaauaacaggacuacaaacaggagacgaagcagauuacuauugcggaacaugggacucaagcuuaagcgcaggaggaguauuuggaacaggaacaaaaguaacaguacua

SEQ ID NO: 47386 - RNA, 333 nt, Artificial Sequence
  derived and/or modified sequence opt6 from anti-HIV-1_LightChain
caaucaguauuaacacaaccaccaucaguaucagcagcaccaggaagagaaguaauaauaucaugcucaggaucaucaucaaacauaggaaacaaccacguaucaugguaccaacaacuaccaggaacagcaccaaaaguacuaauauacgaaucaaacaaaagacacucaggaauaccagacagauucucaggaucaaaaucaggaacaucagcaacacuagcaauaacaggacuacaaacaggagacgaagcagacuacuacugcggagcaugggacucaucacuaagcgcaggaggaguauucggcacaggaacaaaaguaacaguacua

SEQ ID NO: 47387 - RNA, 333 nt, Artificial Sequence
  derived and/or modified sequence opt6 from anti-HIV-1_LightChain
caaagcguacuaacacaaccaccaucagcaagcggaacaccaggacaaagaguaacaauaagcuguagcggaagcucaaguaauauaggagacucaacaguaaacugguaccaacaauuaccaggaacagcacccaaacuauuaauauaugaaaauacaaaaagaccaagcggaauaccagacagauucucaggaucaaaaucaggaacaagcgcaacauuaggaauaacaggacuacaaacaggagacgaagcagauuacuauugcggaacaugggacagaucauuaagcgcaggaggaguauuuggaacaggaacaaaaguaacaguacua

SEQ ID NO: 47388 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaucaacaucaaacauaggaaacaacuacguaucaugguaccaacaacuaccaggaacagcaccaaaacuacuaauauacgaaaacaacagacaaccaucaggaauaccagacagauucucaggaucaaaaucaggaacaucagcaacacuaggaauaacaggacuacaaacaggagacgaaggagacuacuacugcggaacaugggacagaucacuaucagcaggaggaguauucggaacaggaacaaaaguaacaguacua

SEQ ID NO: 47389 - RNA, 333 nt, Artificial Sequence
  derived and/or modified sequence opt6 from anti-HIV-1_LightChain
caaucaguauuaacacaaccaccaucaguaucagcagcaccaggacaaaaaguaacaauaucaugcucaggaucaucaucaaauauaggaucaaacuacguaucaugguaccaacaacuaccaggaacagcaccaaaacuauuaauauaugaaaacaacaaaagaccaucaggaauaccagacagauucucaggaucaaaaucaggaacaucagcaacacuaggaauaacaggacuacaaacaggagacgaagcaguauacuacugcggaacaugggacucaucacuaacagcaggaggaguauucggaucaggaacaaaaguaacaguacua

SEQ ID NO: 47390 - RNA, 336 nt, Artificial Sequence
  derived and/or modified sequence opt6 from anti-HIV-1_LightChain
caaaguguacuaacacaaccaccaucaguaucaggagcaccaggacaaagaguaacaauaucaugcauaggaucaagcucaaacauaggagcagacuauagaguacacugguaccaacaauuaccaggaacagcaccaaaacuauuaauauaugaaaauaacaaaagaccaaguggaauaccagauagauucucaggaucaaaaucaggaacaagcgcaacauuaggaauaacaggacuacaaacaggagacgaagcagauuacuauugcggaacaugggacagcucauuaagcacaggaggaguauuuggaacaggaacaaaaguaacaguacua

SEQ ID NO: 47391 - RNA, 336 nt, Artificial Sequence
  derived and/or modified sequence opt6 from anti-HIV-1_LightChain
caaagcguacuaacacaaccaccaagcguaucaggagcaccaggacaaagaauaacaguaucaugcacaggaacaagcucaaacauaggagcaccauaugacguaaacugguaccaacaauuaccaggaacagcaccaaaacuauuaauauaugaaaauacaaaaagaccaagcggaauaccagacagauucucaggaucaaaaucaggaacaagcgcaacauuaggaauaacaggacuacaaacaggagacgaagcagauuacuauugcggaacaugggacagaucauuaagcgcaggaggaguauuuggaacaggaacaaaaguaacaguacua

SEQ ID NO: 47392 - RNA, 333 nt, Artificial Sequence
  derived and/or modified sequence opt6 from anti-HIV-1_LightChain
caaucaguacuaacacaaccaccagcaaugagugcagcaccaggacaaagcguaacaauaucauguagcggaagcgcauucaauauagaaagacaucaaguaacauggcuaagacacuuaccaggaacagcaccaacaaguguaauaauaaugaauaaccaaagaccaagcggaguaccagacagauucucaggaucacgaucaggaacaagcgcaacauuaggaauaacaggacuacaaacaggagacgaaggagauuacuauugcggaacaugggacagaaguuuaagcgcaggaggaguauuuggaacaggaacaaaaguaacaguacua

SEQ ID NO: 47393 - RNA, 333 nt, Artificial Sequence
  derived and/or modified sequence opt6 from anti-HIV-1_LightChain
caaagcguauuagcacaaccaccaagcgcaagcggaacaccaggacaaagaguaacaauaagcuguagcggaagcgcaaguaauauaggauucaauagcguaacaugguaccaacaauuaccaggaacagcaccaacaguauuaauauauggaaaugacuuaagaccaagcggaauaccagacagauucucaggaucaaaaucaggaacaagcgcaacauuaggaauaacaggacuacaaacaggagacgaaggagauuacuauugcggaacaugggacagaucauuaagcgcaggaggaguauuuggaacaggaacaaaaguaacaguauua

SEQ ID NO: 47394 - RNA, 336 nt, Artificial Sequence
  derived and/or modified sequence opt6 from anti-HIV-1_LightChain
caaagugcacuaacacaaccagcaucaguaucaggaucaccaggugaaucaauaacaauaucaugcacaggaacaagaucugacauaggaaauuacgcauacguaagcugguaccaacaauuaccaggaacagcaccaaaacuauuaauaucagaaaauaacaaaagaccaaguggaauaccagacagauucucaggaucaaaaucaggaacaagcgcaacauuaggaauaacaggacuacaaacaggagacgaagcagauuacuauugcggaacaugggacagcucauuaagcgcaggaggaguauuuggaacaggaacaaaaguaacaguacua

SEQ ID NO: 47395 - RNA, 333 nt, Artificial Sequence
  derived and/or modified sequence opt6 from anti-HIV-1_LightChain
caaucaguacuaacacaaccaccaucaguaucagcaccaccaggacaaaaaguaacaauaucaugcucaggaacaacaucaaacauaggaucaaacuacguagcaugguaccaacaacuaccaggaacagcaccaaaacuacuaauauacgacaacgacaaaagaccaucaggaauaccagacagauucucaggaucaaaaucaggaacaucagcaacacuaggaauaacaggauuacaaacaggagacgaagcagacuacuacugcggaacaugggacagaucacuaucagcaggaggaguauucggaacaggaacaaaaguaacaguacua

SEQ ID NO: 47396 - RNA, 333 nt, Artificial Sequence
  derived and/or modified sequence opt6 from anti-HIV-1_LightChain
caaagcguauuaacacaaagcccaagcguaagcggaacaccaggacaaagaguaacaauauucuguagcggaagcgauagcgauauaggaauaaauagcguaagcugguaccaacaauuaccaggaacagcaccaaaacuauuaauauaugacaauaacaaaagaccaagcggaauaccagacagauucucaggaucaaaaucaggaacaagugcaacauuaggaauaacaggauuacaaacaggagacgaagcagauuacuauugcggaacaugggacagaucauuaagcgcaggaggaguauuuggaacaggaacaaaaguaacaguacua

SEQ ID NO: 47397 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaaacucaucaaacauaggaaacaacuacgucucaugguaccaacaccuaccaggaacagcaccaaaacuacuaauauacgaaaacacaaaaagaccaucaggaauaccagacagauucucaggaucaaaaucaggaacaucagcaacacuaggaauaacaggacuacaaacaggagacgaagcagacuacuacugcggaacaugggacagaucacuaucagcaggaggaguauucggaacaggaacaaaaguaacaguacua

SEQ ID NO: 47398 - RNA, 333 nt, Artificial Sequence
  derived and/or modified sequence opt6 from anti-HIV-1_LightChain
caaucacuauuaacacaaccaccaagcguaagcgcagcaccaggacaaaaaguaacaauaagcuguagcggaggaaauagcgauauaggaaaaaauuucguaagcugguaccaacaauuaccaggaacagcaccaaaacuauuaauauaugaaaauaacaaaagaccaagcggaauaccagacagauucucaggaucaaaaucaggaacaagcgcaacauuaggaauaacaggauuacaaacaggagacgaagcagauuacuauugcggaacaugggacaauagcuuaagcacaggaggaguauuuggaacaggaacaaaaguaacaguacua

SEQ ID NO: 47399 - RNA, 333 nt, Artificial Sequence
  derived and/or modified sequence opt6 from anti-HIV-1_LightChain
caaucaguacuaacacaaccaccaucaguaucagcagcaccaggacaaaaaguaauaauaucaugcucaggaucaucaucaaacauaggaaaaaacuacguagcaugguaccaacaacuaccaggaacagcaccaaaacuacuaguauacgaaaacacaaacagacccucaggaauaccagacagauucucaggaucaaaaucaggaacaucagcaacacuaggaauaacaggacuacaaacaggagacgaagcagacuacuacugcggaacaugggacucaucauuaucagcaggaggaguauucggaacaggaacaaaaguaacaguacua

SEQ ID NO: 47400 - RNA, 333 nt, Artificial Sequence
  derived and/or modified sequence opt6 from anti-HIV-1_LightChain
caaucaguauuaacacaaccaccaucaguaucagcagcaccaggacaaaaaguaacaauaucauguucaggaucaaugucagauauaggacuaaacccaguaucaugguacagacaauuaccagaagcaccaccacaucuauuaauauuugacaaugacgaaagaccaucaggaacagcaggaagauucucagcaucaaaaucaggaacaucagcaacauuagacauaacaggacuacaaacaggagacgaagcagauuacuauugcggaacaugggacucaucauuaucagcaggaggaguauuuggaacaggaacaaaaguaacaguacua

SEQ ID NO: 47401 - RNA, 336 nt, Artificial Sequence
  derived and/or modified sequence opt6 from anti-HIV-1_LightChain
caaucagcacuaacacaaccagcaucaguaucaggaucaccaggacaaucaauaacaauaucaugcacaggaacaucaucagacguaggaucauacaaccuaguaucaugguaccaacaauacccaggaagagcaccaaaacuacuaauauacgaaaacaacaaaagaccaucaggaauaccagacagauucucaggaucaaaaucaggaacaucagcaacacuaggaauaacaggacuacaaacaggagacgaagcagacuacuacugcggaacaugggacaacucacuaucaacaggaggaguauucggaacaggaacaaaaguaacaguacua

SEQ ID NO: 47402 - RNA, 333 nt, Artificial Sequence
  derived and/or modified sequence opt6 from anti-HIV-1_LightChain
caaucacuacuaacacaaccaccaagcguaucagcaucaccaggacaaaaaguaacaauaucaugcucaggaacaucaucaaacauaggaaacaacuacguaucaugguaccaacaauucccaggaacagcaccaaaacuacuaauauacgaaaacaacaaaagaucaucaggaauaccagacagauucucaggaucaaaaucagacacaucagcaacacuaggaauaacaggauuacaaacaggagacgaagcagacuacuacugcggaacaugggacagaucacuaucagcaggaggaguauucggaacaggaacaaaaguaacaguacua

SEQ ID NO: 47403 - RNA, 336 nt, Artificial Sequence
  derived and/or modified sequence opt6 from anti-HIV-1_LightChain
caaagcguacuaacacaaccaccaucaguaucaggagcaccaggacaaagaguaacaauaagcuguacaggaagaagaaguaauauaggagcaggauaugacguacacugguaccaacaauuaccaggaacagcaccaaaauuauuaauauaugaaaauaauaaaagaccaagcggaauaccagacagauucucaggaucaaaaucaggaacaagcgcaacauuaggaauaacaggauuacaaacaggagacgaagcagauuacuauugcggaacaugggacacaaguuuaagcgcaggaggaguauuuggaacaggaacaaaaguaacaguacua

SEQ ID NO: 47404 - RNA, 333 nt, Artificial Sequence
  derived and/or modified sequence opt6 from anti-HIV-1_LightChain
caaucaguauuaacacaaccaccaagcguaagugcagcaccaggacaaagaguaacaauaagcuguagcggaagcucaagcaauauaggaaacaauuucguaagcugguaccaauucuuuccaggaacagcaccaaaauuaguaauauaugaaaaugacaaaagaccaagcggaacaccagacagauucucaggaucaaaaucaggaacaagcgcaacacuagcaauaauaggacuacaaacaggagacgaaggagauuacuauugcggaacaugggacaauagcuuaagcacaggaggaguauuuggaacaggaacaaaaguaacaguacua

SEQ ID NO: 47405 - RNA, 333 nt, Artificial Sequence
  derived and/or modified sequence opt6 from anti-HIV-1_LightChain
caaucaguauuaacacaaccaccaagcguaagcgcagcaccaggacaaagaguaacaauaagcuguagcggaggaucaagcaauauaggaaacaaucacguaagcugguaccaacaauuaccaggaacagcaccaaaacuauuaauaucagaaaauaacaaaagaccaagcggaauaccagacagauucucaggaucaaaaucaggaacaagcgcaacauuaggaauaacaggacuacaaacaggagacgaagcagauuacuauugcggaacaugggacagcucauuaagcgcaggaggaguauuuggaacaggaacaaaaguaacaguacua

SEQ ID NO: 47406 - RNA, 333 nt, Artificial Sequence
  derived and/or modified sequence opt6 from anti-HIV-1_LightChain
caaucaguauuaacacaaccaccaagcguaagugcagcaccaggacaaaaaguaacaauaagcuguagcggaagcucaaguaauauaggaagagauuucguaaguugguaccaacaaguaccaggaacagcaccaaaacuauuaauauaugacaaugacaaaagaccaagcggaauaccagacagauucucaggaucaaaaucaggaacaagcgcaacauuaggaauaacaggacuacaaacaggagacgaagcagauuacuauugcggaacaugggacagcucauuaagcgcaggaggaguauuuggaacaggaacaaaaguaacaguacua

SEQ ID NO: 47407 - RNA, 336 nt, Artificial Sequence
  derived and/or modified sequence opt6 from anti-HIV-1_LightChain
caaacaguaguaacacaaccaccaucaguaucaggagcaccaggacaaacagcaacaauaucauguacaggaagcucaucaaauauaggagcagacuacgacguacacugguaccaacaacuaccaggaacagcaccaaaacuacuaauauacgacaacaauaaaagaccaucaggaauaccagacagauuuucaggaucaaaaucaggaacaucagcaacacuaggaauaacaggacuacaaacaggagacgaagcagacuacuacugcggaacaugggacagaucacuaagugcaggaggaguauucggaacaggaacaaaaguaacaguauua

SEQ ID NO: 47408 - RNA, 333 nt, Artificial Sequence
  derived and/or modified sequence opt6 from anti-HIV-1_LightChain
aacuuuauguuaacacaaccaccaagcgcaagcggaacaccaggacaaagaguaacaauaagcuguagcggaagcucaagcaauauaggaagcaauuacguauacugguaccaacaauuaccaggaacaacaccaaaacuauuaauauaucgaaauaaccaaagaccaagcggaauaccagacagauucucaggaucaaaaucaggaacaagugcaacauuaggaauaacaggacuacaaacaggagacgaagcagauuacuauugcggaacaugggacagcucauuaagcgcaggaggaguauuuggaacaggaacaaaaguaacaguacua

SEQ ID NO: 47409 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaucaucaccaaacauaggaaacaacuuccuaucaugguaccaacaauuaccaggaacagcaccaaaacuacuaauauacgaaaacacaaaaagaccaucaggaauaccagacagauucucaggaucaaaaucaggaacaucagcaacacuaggaauaacaggacuacaaacaggagacgaagcagacuacuacugcggaacaugggacagaucacuaucagcaggaggaguauucggaacaggaacaaaaguaacaguacua

SEQ ID NO: 47410 - RNA, 333 nt, Artificial Sequence
  derived and/or modified sequence opt6 from anti-HIV-1_LightChain
caaucaguauuaacacaaagcccaagcguaagcgcagcaccaggacaaaaaguaacaauaagcuguagcggaagcucaagcgauauaggaaacaauuucguaagcugguaccaacaacuaccaggaacagcaccaaaacuauuaauauaugaaaauaacaaaagaccaagcggaauaccagacagauucucaggaucaaaaucaggaacaagugcaacauuaggaauaacaggacuacaaacaggagacgaagcagauuacuauugcggaacaugggacagcucauuaagcgcaggaggaguauuuggaacaggaacaaaaguaacaguacua

SEQ ID NO: 47411 - RNA, 333 nt, Artificial Sequence
  derived and/or modified sequence opt6 from anti-HIV-1_LightChain
caauuuuucuuaacacaaccaccaucauuaucagcaacaccaggacaaagaguaucaauaucauguucaggaggaggaucaaauauagcaaacaaugacguauucugguuccaacaauuuccaggagcaggaccaagacuauuaauauaugacaauuuaaaaagacauuacggaacaccagacagauucucaggaaguaaaucaggaacaucagcaacauuaggaauaacaggacuacaaacaggagacgaagcagauuacuauugcggaacaugggacaauagccuaucaacaggaggaguauucggaacaggaacaaaaguaacaguacua

SEQ ID NO: 47412 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaucaggaccaaacauaggaucaaacucaguaucaugguaccaacacuucccaggaacagcaccaaaacuacuaauauacgacaacaacaaaagaccaucaggaauaccagacagauucucaggaucaaaaucaggaacaucagcaacauuaggaauaacaggacuacaaacaggagacgaagcagacuacuacugcggaacaugggacagaucacuaucagcaggaggaguauucggaacaggaacaaaaguaacaguauua

SEQ ID NO: 47413 - RNA, 333 nt, Artificial Sequence
  derived and/or modified sequence opt6 from anti-HIV-1_LightChain
caaucaguauuaacacaaucaccaucagcaucaggaacaccaggacaaagaguaacaauaagcuguucaggaucaucaucaaauauaggaagcaauacaguaucaugguuccaacacuuaccaggaacagcaccaaaacuauuaauauaugaaaauaacaaaagaccaucaggaauaccagacagauucucaggaaguaaaaguggaacaucagcaacacuaggaauaacaggacuacaaacaggagacgaagcagauuacuauugcggaacauggcacucaucauuaucagcaggaggaguauuuggaacaggaacaaaaguaacaguacua

SEQ ID NO: 47414 - RNA, 333 nt, Artificial Sequence
  derived and/or modified sequence opt6 from anti-HIV-1_LightChain
caaucaguacuaacacaaccaccaucaguaucaggagcaccaggacaaaacguaauaauaucaugcucaggaucaucaucaaacauaggaaaaaacuacguagcaugguaccaacaauuaccaggaacagcaccaaaaauaguaauauacgaaacaacaaacagaccaucaggaauaccagcaagauucucaggaucaaaaucaggaacaucagcaacacuaggaauaacaggacuacaagcaggagacgaagcagacuacuacugcggaacaugggacucaucacuaaacgcaggaggaguauucggaacaggaacaaaaguaacaguacua

SEQ ID NO: 47415 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaucaucaucaaacauaggaaacaacuuccuaucaugguaccaacaccuaccaggaacagcaccaagacuacuaauauacgacaacgaccaaagaccaucaggaauaccagacagauucucaggaucaaaaucaggaacaucagcaacacuaggaauaacaggacuacaaacaggagacgaagcagacuacuacugcggaacauggcacucaucacuaucagcaggaggaguauucggaacaggaacaaaaguaacaguacua

SEQ ID NO: 47416 - RNA, 333 nt, Artificial Sequence
  derived and/or modified sequence opt6 from anti-HIV-1_LightChain
caaagcguacuaacacaaccaccaucagcaucaggaacaccaggacaaaaaguaacaauaucaugcucaggaucaucaucaaacauaggaaacaacuacguaucaugguaccaacaacuaccaggaacagcaccaaaacuacuaauauacgaaaacaacaaaagaccaucaggaauaccagacagauucucaggaucaaaaucaggaacaucagcaacacuaggaauaacaggacuacaaacaggagacgaagcagacuacuacugcggaacaugggacucaucacuaucaacaggaggaguauucggaacaggcacaaaaguaacaguacua

SEQ ID NO: 47417 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaacaacaucaaacauaggaaaccacuacguaucaugguaccaacaauucccaggaacagcaccaaaacuaauaauauacgaaacagacagaagaccaucaggaauaccagcaagauucagcggaagcaaaucaggaacaucagcaacacuagcaauagcaggacuacaaacaggagacgaagcagacuacuacugcggaacaugggacucaucacuaagcacaggaggaguauucggaacaggaacaaaaguaacaguacua

SEQ ID NO: 47418 - RNA, 333 nt, Artificial Sequence
  derived and/or modified sequence opt6 from anti-HIV-1_LightChain
caacuaguacuaacacaaccaccaagcguaucagcagcaccaggacaaaaaguaacaauaucaugcucaggaucaucaucaaacauaggaaacaacuacguaucaugguaccaacaacuaccaggaacagcaccaaaacuacuaauauacgaaaacaacaaaagaccaucaggaauaccagacagauucucaggaucaaaaucaggaacaucagcaacacuaggaauaacaggacuacaaacaggagacgaagcagacuacuacugcggaacaugggacucaucacuaucaacaggaggaguauucggaacaggaacaaaaguaacaguacua

SEQ ID NO: 47419 - RNA, 333 nt, Artificial Sequence
  derived and/or modified sequence opt6 from anti-HIV-1_LightChain
caaucaguauuaacacaaccaccaagcguaucagcagcaccaggacaaagaguaacaauaucaugcagcggaggaucaucaaauauaggaaacaaucacguaucaugguaccaacacuuaccaggaagagcaccacaauuacuaauauacgacacaacacaaagaccaucaagaauaccagacagauucucaggaucaaaaucaggaacaucagcaacacuaggaauaacaggacuacaaacaggagacgaagcagacuacuauugcggaacaugggacaauucauuaucaacaggaggaguauucggaacaggaacaaaaguaacaguacua

SEQ ID NO: 47420 - RNA, 333 nt, Artificial Sequence
  derived and/or modified sequence opt6 from anti-HIV-1_LightChain
caaucaguacuaacacaaccaccaucaguaucagcagcaccaggacaaaaaauaacaauaucaugcucaggaucaagaucaaacauaggaaacaacuacguaucaugguaccaacaauucccaggaacagcaccaaaacuacuaauauacgacaacaaccaaagaccaucaagaauaccagacagauucucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 47421 - RNA, 321 nt, Artificial Sequence
  derived and/or modified sequence opt6 from anti-HIV-1_LightChain
caaucaguauuaacacaacccccaucaguaucagcagcaccaggacaaagaguaacaauaucauguuucggaucaagauucucaucaguaucaugguaccaacaauuaccaggaacagcaccaaaacuauuaauauauccaaauggagaaagaccaucaggaauaccagacagauucuuuggaucagaaucaggaacaucagcaacauuaggaauaacaggacuacaaacaggagacgaagcagauuacuauugcgcaacaugggacucaucauuaucagcaggaggaguauuuggaacaggaacaaaauuaacaguauua

SEQ ID NO: 47422 - RNA, 333 nt, Artificial Sequence
  derived and/or modified sequence opt6 from anti-HIV-1_LightChain
caaucaguauuaacacaaccaccaucauuaagcgcagcaccaggacaaaaaguaacaauaaguuguaguggaagcucacuaaauauaggaaaccauuacguaagcugguaccaacaaguaccaggaacagcaccaaaacuauuaauauaugaagauaacaaaagaccaagcggaauaccagacagauucucaggaucaaaaucaggaacaagcgcaacauuaggaauaacaggacuacaaacaggagacgaagcagauuacuauugcggaacauggcacagcagcuuaagcgcaggaggaguauuuggaacaggaacaaaaguaacaguacua

SEQ ID NO: 47423 - RNA, 333 nt, Artificial Sequence
  derived and/or modified sequence opt6 from anti-HIV-1_LightChain
caauuuguauuaacacaaccaccaucaguaucagcagcaccaggacaaaaaguaacaguaucauguucaggaacaacaucagauauaggagaaaauuacguaucaugguaccaaaaauuuccagaagcagcaccaaaacuauuaauauacgacaaugacaaaagaccaucaggaauaccagacagauucucaggaucaaaaucaggaacaucagcaacacuaggaauaacaggacuacaaacaggagacgaagcagacuacuacugcggaacaugggacagaucauuaucagcaggaggaguauucggaacaggaacaaaaguaacaguacua

SEQ ID NO: 47424 - RNA, 333 nt, Artificial Sequence
  derived and/or modified sequence opt6 from anti-HIV-1_LightChain
uuaucaguacuaacacaaccaccaucaguaucagcagcaccaggacaacaaguaacaauaucaugcucaggaacaacaucaaacauaggcacaaacuacguaucaugguaccaacaaaugccaccaacagcaccaaaacuacuaauauacgaaaacaacaaaagaccaucaggaauaccagacagauucucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 47425 - RNA, 336 nt, Artificial Sequence
  derived and/or modified sequence opt6 from anti-HIV-1_LightChain
caaagcaugcuaacacaaccaccaucaguaucaggagcaccaggacaaagaguaacaauaucaugcacaggaucaagaucaaacauaggagcaggauaugacguacacugguacuuacaauuaccaggaacagcaccaaaacuauuaauauaugaaaauaacaaaagaccaaguggaauaccagacagauucucaggaucaaaaucaggaacaagcgcaacauuaggaauaacaggacuacaaacaggagacgaagcagauuacuauugcggaacaugggacaauaguuuaagcacaggaggaguauuuggaacaggaacaaaaguaacaguacua

SEQ ID NO: 47426 - RNA, 333 nt, Artificial Sequence
  derived and/or modified sequence opt6 from anti-HIV-1_LightChain
caaucaguauuaacacaaccaccaucaguaucagcaacaccaggacaaaaaguaacaauaucauguucaggaucaagaucaaauauaggaucacauuacguaagcugguaccaacaauuuccagaaucagcaccaacacuauuaauauaugaaaauguagaaagaccaucaggaauaccagacagauucucaggaucaaaaucaggaacaucagcaacauuaggaauaacaggacuacaaacaggagacgaagcagacuacuauugcggaacaugggacucaucauuaucagcaggaggaguauuuggaacaggaacaaaaguaacaguacua

SEQ ID NO: 47427 - RNA, 333 nt, Artificial Sequence
  derived and/or modified sequence opt6 from anti-HIV-1_LightChain
caauuuuucuuaacacaaccaccaucauuaucagcaacaccaggacaaagaguaucaauaucauguucaggaggaggaucaaauauagcaaacaaugacguauucugguuccaacaauuuccaggagcaggaccaagacuauuaauauaugacaaucuaaaaagacauuacggaacaccagacagauucucaggaucaaaaucaggagcaacaggaacauuagaaauaacagaaguacaaacagcagacgaagcagauuacuauugcggaacaugggacucaucauuaucagcaggaggaguauucggaacaggaacaaaaguaacaguacua

SEQ ID NO: 47428 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaggaucaucaaacauaggagacaacucaguaucaugguaccaacaauuaccaggaacagcaccaaaacuacuaauauacgaaaacaacaaaagaccaucaggaauaccagacagauucucaggaucaaaaaguggaacaucagcaacacuaggaauaacaggacuacaaacaggagacgaagcagacuacuacugcggaacaugggacagcucacuaucaacaggaggaguauucggaacaggaacaaaaguaacaguacua

SEQ ID NO: 47429 - RNA, 333 nt, Artificial Sequence
  derived and/or modified sequence opt6 from anti-HIV-1_LightChain
caaucaguauuaacacaaccaccaucaguaagcgcagcaccaggacaaacaguaacaauaucauguucaggaucagcaucaaauauaggaagaaauucaguaucaugguaccaauacguaccaggagcagcaccaaaaagauuaauauaugaaaauaacaaaagaccaucaggaauaccagacagauucucaggaucaaaaucaggaacaucagcaacauuaggaauaacaggacuacaaacaggagacgaagcagauuacuauugcggaacaugggacacaucauuaucagcaggaggaguauuuggaacaggaacaaaaguaacaguacua

SEQ ID NO: 47430 - RNA, 333 nt, Artificial Sequence
  derived and/or modified sequence opt6 from anti-HIV-1_LightChain
caaucaguacuagcacaaccaccaucaguaucagcagcaccaggacaaaaaguaacaauaucaugcucaggaagaacaucaaauauaggaaacuacuucguaucaugguaccaacaauucccaggaacagcaccaagacuacuaauauacgacaaugaccaaagaccaucaggaauaccagacagauucucaggaagcaaaucaggaacaucagcaacacuaggaauaacaggacuacaaacaggagacgaagcagacuacuauugcggaacaugggacucaucacuaucagcaggaggaguauucggaacaggaacaaaaguaacaguacua

SEQ ID NO: 47431 - RNA, 333 nt, Artificial Sequence
  derived and/or modified sequence opt6 from anti-HIV-1_LightChain
caaucagcacuaacacaaccagcaucaguaucagcagcaccaggacaaaaaguaaccauaucaugcucaggaucaucaucaaacauaggaaacauauacguaucaugguaccaacaacuaccaggaacagcaccaaaacuacuaauauacgaaaauaacaaaagaccaucaggaauaccagacagauucucaggaucaaaaucaggaacaucagcaacacuaggaauaacaggacuacaaacaggagacgaagcagacuacuacugcggaacauggcacucaucacuaucagcaggaggaguauucggaacaggaacaaaaguaacaguauua

SEQ ID NO: 47432 - RNA, 333 nt, Artificial Sequence
  derived and/or modified sequence opt6 from anti-HIV-1_LightChain
caaucaguauuaacacaaccaccaucaguaagcgcaacaccaggacaaagaguaacaguaagcuguagcggaucaucaucaaauauaggaaaccauuacguaagcugguaccaacaaguaccaggaacagcaccaaaacuauuaauauaugacaauagcaauagaccaagcggaauaccagacagauucucaggaucaaaaucaggaacaucagcaacauuaggaauaacaggauuacaaacaggagacgaagcagauuacuauugcggaacaugggacucaucauuaucagcaggaggaguauuuggaacaggaacaaaaguaacaguacua

SEQ ID NO: 47433 - RNA, 333 nt, Artificial Sequence
  derived and/or modified sequence opt6 from anti-HIV-1_LightChain
caaucaguacuaacacaaccaccaucauuaucagcagcaccaggacaaagaguaacaguaucaugcucaggaucaucaucaaauauaggagacaacuacguaucaugguaccaacaauuaccaggagcagcaccaagacuauuaauauacgacaacucaauaagaccaucagcaauaccagcaagauucucaggaucaaaaucaggaacaucagcaacacuagcaauaacaggacuacaaacaggagacgaagcagacuacuacugcggaacaugggacucaucacuaucagcaggaggaguauucggaacaggaacaaaaguaacaguccua

SEQ ID NO: 47434 - RNA, 336 nt, Artificial Sequence
  derived and/or modified sequence opt6 from anti-HIV-1_LightChain
caaagcgcacuaacacaaccagcaucaguaucaggaucaccaggacaaucaauaacaauaucaugcacaggaacaaguucagacguaggaggauacgauuacguaagcugguaccuacaauuaccaggaacagcaccaaaacuauuaauauaugaaaauaacaaaagaccaagcggaauaccagacagauucucaggaucaaaaucaggaacaagcgcaacauuaggaauaacaggauuacaaacaggagacgaagcagauuacuauugcggaacaugggacagcucauuaagcgcaggaggaguauuuggaacaggaacaaaaguaacaguacua

SEQ ID NO: 47435 - RNA, 333 nt, Artificial Sequence
  derived and/or modified sequence opt6 from anti-HIV-1_LightChain
caaucaguauuaacacaaccaccaagcguaagcgcagcaccaggacaaagaguaacaguaagcuguagcggaagcucaaguaauauaggaaacaauuacguaagcugguaccaacaauuuccaggaacagcaccaaaauuaguaauauaugacacagacaaaagaccaagcggaauaccagacagauucucaggaucaaaaucaggaacaagcgcaacauuaggaauaacaggacuacaaacaggagacgaagcagauuacuauugcgcaacaugggacucaagccuaagcgcaggaggaguauuuggaacaggaacaaaaguaacaguauua

SEQ ID NO: 47436 - RNA, 336 nt, Artificial Sequence
  derived and/or modified sequence opt6 from anti-HIV-1_LightChain
caaucaguacuaacacaaccaccaucaguaucaggagcaccaggacaaagaguaacaauaucaugcacaggaaacucaucaaacauaggagcaggauacgacguacacugguaccaacaacuaccaggaacagcaccaaaacuacuaauaucagaaaacaacaaaagaccaucaggaauaccagacagauucucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 47437 - RNA, 333 nt, Artificial Sequence
  derived and/or modified sequence opt6 from anti-HIV-1_LightChain
caaucaguacuaacacaaccaccaucagcaucaggaacaccaggacaaagaguaacaauaucaugcucaggaucaucaucaaacauaggaucaaacuacguagacugguaccaacaacuaccaggaacagcaccaaaacuacuaauauacgaaaacaacaaaagaccaucaggaauaccagacagauucucaggaucaaaaucaggaacaucagcaacacuaggaauaacaggacuacaaacaggagacgaagcagacuacuacugcggaacauggcacucaucacuaucagcaggaggaguauucggaacaggaacaaaaguaacaguacua

SEQ ID NO: 47438 - RNA, 333 nt, Artificial Sequence
  derived and/or modified sequence opt6 from anti-HIV-1_LightChain
caaucaguacuaacacaaccaccaucaguaucagcaacaccaggacaaacaguaacaauaucaugcucaggaucaucaucaaacauaggaaacaacuaccuaucaugguacagacaauuaccaagaacagcaccaaaacuacuaauauacgaaaacaacagaagaccaucaggaguaccagcaagauucucaggaagcaaaucaggaacaucagcaacacuagcaauaacaggacuacaaacaggagacgaagcagacuacuacugcggaacaugggacucaucccuaucagcaggaggaguauucggaacaggaacaaaaguaacaguacua

SEQ ID NO: 47439 - RNA, 321 nt, Artificial Sequence
  derived and/or modified sequence opt6 from anti-HIV-1_LightChain
caaucaguauuaacacaaccaccaucaguaucagcagcaccaggacaaagaguaacaauaucauguuucggaucaagauucucaucaguaucaugguaccaacaauuaccaggaacagcaccaaaacuauuaauauauccaaauggagaaagaccaucaggaauaccagacagauucuuuggaucagaaucaggaacaucagcaacauuaggaauaacagcaguacaaacaggagacgaagcagauuacuauugcggaacaugggacgauagcuuaucaacaggaggaguauuuggaacaggaacaaaaguaacaguacua

SEQ ID NO: 47440 - RNA, 333 nt, Artificial Sequence
  derived and/or modified sequence opt6 from anti-HIV-1_LightChain
caaucaguacuaacacaaccaccaucaguaucagcagcaccaggacaaaaaguaacauuaucaugcucaggaacaucaucaaacauaggaaacaacuacguaucaugguaccaacaaguaccaggagcagcaccaaaaguauuaauauacgaaaacgacaaaagaccaucaggaauaccagacagauucucaggaucaaaaucaggaacaucagcaacacuaggaauaacaggacuacaaacaggagacgaagcagacuacuacugcggaacaugggacagaucacuaucagcaggaggaguauucggaacaggaacaaaaguaacaguacua

SEQ ID NO: 47441 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauauccugcucaggaucaaacucaaacauaggaaacaacuacguaucaugguaccaacaauuaccaggaacagcaacaaaacuacuaauauacgaaaacgacaaacgaccaagcggaauaccagacagauucucaggaucaaaaucaggaacaucagcaacacuaggaauaacaggacuacaaacaggagacgaagcagacuacuacugcggaacauggcacucaucacuaucagcaggaggaguauucggaacaggaacaaaaguaacaguacua

SEQ ID NO: 47442 - RNA, 333 nt, Artificial Sequence
  derived and/or modified sequence opt6 from anti-HIV-1_LightChain
caaucaguacuaacacaaccaccaucacuaucagcagcaccaggacaacaaguaucaauaagcugucuaggaagaucaucaaauauaggaacaaauuacguaucaugguaccaacaauuuccaggaacagcaccaaaacuauuaauauacgaaaauaaaaaaagaccaucagaaauaccagacagauucucaggaucaaaaucaggaacaucagcaacacuaggaauaacaggacuacaaccaggagacgaagcagacuacuacugcggaacaugggacucaucacuaucagcaggaggaguauucggaacaggaacaaaaguaacaguacua

SEQ ID NO: 47443 - RNA, 336 nt, Artificial Sequence
  derived and/or modified sequence opt6 from anti-HIV-1_LightChain
caaucagcacuaacacaaccaccaucagcaucaggaucaccaggacaaucaguaacaauaucaugcacaggaacaucaucagacguaggcgcauacaacucaguaucaugguaccaacaacuaccaggaacagcaccaaaacuacuaauaucagaaaacaacaaaagaccaucaggaauaccagacagauucucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguauua

SEQ ID NO: 47444 - RNA, 333 nt, Artificial Sequence
  derived and/or modified sequence opt6 from anti-HIV-1_LightChain
caaucagcauuaacacaaccaccaagcgcaagcggaucaccaggacaaagcguaacaauaagcuguagcggaggaucaagcaauauaggaaacaaucacguaagcugguaccaacacuuaccaggaagagcaccacaacuauuaauauaugacacaacacaaagaccaagcagaauaccagacagauucucaggaucaagaucaggaacaagcgcaacauuagcaauaacaggacuacaaacaggagacgaagcaguauacuauugcggaacaugggacaauagcuuaagcacaggaggaguauuuggaacaggaacaaaaguaacaguacua

SEQ ID NO: 47445 - RNA, 333 nt, Artificial Sequence
  derived and/or modified sequence opt6 from anti-HIV-1_LightChain
caaucaguauuaacacaaccaccaagcguaagcgcagcaccaggacaaagaguaacaauaagcuguagcggaggaacaagcaauauaggaaacgaauacguaagcugguaccaacaauuaccaggaacagcaccaaaacuacuaauauaugaaaauaacaaaagaccaagcggaauaccagacagauucucaggaucaaaaucaggaacaagcgcaacauuaggaauaacaggacuacaaacaggagacgaagcagauuacuauugcggaacaugggacagcucauuaagcgcaggaggaguauuuggaacaggaacaaaaguaacaguacua

SEQ ID NO: 47446 - RNA, 333 nt, Artificial Sequence
  derived and/or modified sequence opt6 from anti-HIV-1_LightChain
caaucaguacuaacacaaccaccaucaguaucagcagcaccaggacaaagaguaacaguaucaugcucaggaucaucaucaaacauaggaaacaacuacguaucaugguaccaacaacuaccaggagcagcaccaaaacuacuaauauacgacacagacaaaagaccaucaggaauaccagacagauucucaggaucaaaaucaggaacaucagcaacacuaggaauaacaggacuacaaacaggagacgaagcagacuacuacugcggaacaugggacagaucacuaucagcaggaggaguauucggaacaggaacaaaaguaacaguacua

SEQ ID NO: 47447 - RNA, 333 nt, Artificial Sequence
  derived and/or modified sequence opt6 from anti-HIV-1_LightChain
caaucacuauuaacacaaccaccaaguguaagcgcagcaccaggacaaaaaguaacaauaaguuguagcggaggaaauagcgauauaggaaaaaauuucguaagcugguaccaacaaucaccaggagcagcaccaagacuauuaauauaugaaaaugacagaagaccaagcggaauaccagacagauucucaggaucaaaaucaggaacaagcgcaacauuaggaauaacaggacuacaaacaggagacgaagcagauuacuauugcggaacaugggacagaagcuuaagcgcaggaggaguauuuggaacaggaacaaaaguaacaguacua

SEQ ID NO: 47448 - RNA, 333 nt, Artificial Sequence
  derived and/or modified sequence opt6 from anti-HIV-1_LightChain
caaucaguacuaacacaaccaccaucaguaucagcagcaccaggacaaaaaguaaacauaucaugcucaggaucaucaucaaacauaggaaaaaacuacguaucaugguaccaacaaauaccaggaacagcaccaaaaguacuaauauacgaaaacaacaaaagaccaucaggaauaccagacagauucagcggaucaaaaucaggaacaucagcaacauuaggaauagcaggacuacaaacaggagacgaagcagacuacuacugcgcaacaugggacucaucacuaucagcaggaggaguauucggaacaggaacaaaaguaacaguacua

SEQ ID NO: 47449 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaucaucaucaaacauaggaaacagacacguaucaugguaccaacaacuaccaggaacaguaccaaaacuacuaauauacgaaacaaacaaaagaccaagcggaauaccagacagauucucaggaucaaaaucaggaacaucagcaacauuaggaauaacaggacuacaaacaggagacgaagcagacuacuacugcggaacaugggacaacucacuaucaacaggaggaguauucggaacaggaacaaaaguaacaguacua

SEQ ID NO: 47450 - RNA, 336 nt, Artificial Sequence
  derived and/or modified sequence opt6 from anti-HIV-1_LightChain
caaagcguauuaacacaaccaccaucaguaucaggagcaccaggacaaagaguaacaauaucauguacaggaucaaguucaaauauaggagcaggauaugacguacacugguaccaacaauuaccaggaacagcacccaaauuauuaauauuuggacaugacaaaagaccaagcggaauaccagacagauucucaggaucaaaaucaggaacaagugcaacauuaggaauaacaggacuacaaacaggagacgaagcagauuauuauugcggaacaugggacagcucauuaagugcaggaggaguauuuggaacaggaacaaaaguaacaguacua

SEQ ID NO: 47451 - RNA, 333 nt, Artificial Sequence
  derived and/or modified sequence opt6 from anti-HIV-1_LightChain
caaucaguacuaacacaacuaccaucagcaucaggacuaccaggacaaacaguaacaauaucaugcucaggaagcacaucaucaauaggaucaaaccacguauacugguaccaacaaguagcaggaacagcaccaaaauuauuaauauacgaaaacaacaaaagaccaucaggaauaccagacagauucucaggaucaaaaucaggaacaucagcaacacuaggaauaacaggacuacaaacaggagacgaagcagacuacuacugcgcaacaugggacucaucacuaucagcaggaggaguauucggaacaggaacaaaaguaacaguacua

SEQ ID NO: 47452 - RNA, 333 nt, Artificial Sequence
  derived and/or modified sequence opt6 from anti-HIV-1_LightChain
caaucaguauuaacacaaacaccaucagcaucaggagcaccaggacaaggaguaacaauaucauguucaggaucaucaucaaauguaggaagaaauuacguaucaugguaccaacaauuaccaggaacagcaccaaaacuauuaauauacgaaaacacaaaaagaccaucaggaauaccagacagauucucaggaucaaaaucaggaacaucagcaacauuaggaauaacaggacuacaaacaggagacgaagcagacuacuacugcggaacaugggacagaucauuaucagcaggaggaguauucggaacaggaacaaaaguaacaguacua

SEQ ID NO: 47453 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaucaucaucaaacauaggaaacaacuacguaucaugguaccaacaauucccaggaacagcaccaaaacuacuaauaucagacaacaacaaaagaccaucaggaauaccagacagauucucaguaucaaaaucaggaacaucagcaacacuaggaauaacaggacuacaagcaggagacgaagcagacuacuacugcggaacaugggacucaucacuaucagcaggaggaguauucggaacaggaacaaaaguaacaguacua

SEQ ID NO: 47454 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaucaaacucaaacauaggaaacaacuacguaacaugguaccaacaauucccaggaacagcaccaaaaguacuaauauacgacaacucaagaagaccaucaggaauaccagacagauucucaggaucaaaaucaggaacaucagcaacauuaggaauaacaggacuacaaacaggagacgaagcagacuacuacugcggaacaugggacucaucacuaucagcaggaggaguauucggaacaggaacaaaaguaacaguacua

SEQ ID NO: 47455 - RNA, 333 nt, Artificial Sequence
  derived and/or modified sequence opt6 from anti-HIV-1_LightChain
caaucaguauuaacacaaccaccaucaguaucaggagcaccaggacaaagaguaacaauaucaugcucaggaucaucaucaaacauaggaaacaacuacguaucaugguaccaacaacuaccaggaacagcaccaaaacuacuaauauacgaaaacacaaaaagaccaucaggaauaccagacagauucucaggaucaaaaucaggaacaucagcaacacuaggaauaacaggacuacaaacaggagacgaagcagacuacuacugcggaacaugggacagaucacuaucagcaggaggaguauucggaacaggaacaaaaguaacaguacua

SEQ ID NO: 47456 - RNA, 333 nt, Artificial Sequence
  derived and/or modified sequence opt6 from anti-HIV-1_LightChain
caaucaguacuaacacaaccaccaucaguaucagcagcaccaggacaaacaguaacaauaucaugcucaggaucaacaucaaacauaggacaaaacuuccuaucaugguuccaacacguaccaggaacagcaccaaaacuacuaauauacgaaaacaacaaaagaccaucaggaauaccagacagauucucaggaucaaaaucaggaacaucagcaacacuaggaauaacaggacuacaaacaggagacgaagcagacuacuacugcggaacauggcacucaucacuaucagcaggaggaguauucggaacaggaacaaaaguaacaguacua

SEQ ID NO: 47457 - RNA, 333 nt, Artificial Sequence
  derived and/or modified sequence opt6 from anti-HIV-1_LightChain
aacuuuauguuaacacaaccaccaagugcaagcggaacaccaggacaacgaguaacaauaagcuguagcggaagcucaagcaauauaggaagcaaauacguaagcugguaccaacaauuaccaggaacagcaccaaaacuauuaauauaugaaaauacaaaaagaccaucaggaauaccagacagauucucaggaucaaaaucaggaacaagugcaacauuaggaauaacaggacuacaaacaggagacgaagcagauuacuauugcggaacaugggacagaaguuuaagcgcaggaggaguauuuggaacaggaacaaaaguaacaguacua

SEQ ID NO: 47458 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaucaucaucaaacauaggaaacaacuacguaucaugguaccaacuacuaccaggaacagcaccaaaacuacuaauauacgaaaacaacaaaagaccaucaggaauaccagacagauucucaggaucaaaaucaggaacaucagcaacacuaggaauaacaggacuacaaacaggagacgaagcagacuacuacugcggaacaugggacaacucacuaucaacaggaggaguauucggaacaggaacaaaaguaacaguacua

SEQ ID NO: 47459 - RNA, 333 nt, Artificial Sequence
  derived and/or modified sequence opt6 from anti-HIV-1_LightChain
caaucaguacuaacacaaccaccaucaguaucagcagcaccaggacaaaaaguaacaauaucaugcucaggaagcucaucaaacauaggaaacaacuacguaucaugguaccaacaacuaccaggaacagcaccaaaaauaauaauauacgacaacaacaaaagaccaucaggaauaccagacagauucucaggaucaaaaucaggaacaucagcaacacuaggaauaacaggacuacaaacaggagacgaagcagacuacuacugcggaacauggcacucaucacuaucagcaggaggaguauucggaacaggaacaaaaguaacaguacua

SEQ ID NO: 47460 - RNA, 333 nt, Artificial Sequence
  derived and/or modified sequence opt6 from anti-HIV-1_LightChain
caaucaguacuaacacaaccaccaucagcaucagcaacaccaggacaaagaguaacaauaucaugcucaggaucaucaucaaacauaggauccaaacacguauacugguaccaaaaacuaccaggaacagcaccaaaacuacuaauauacgaaaacacaaaaagaccaucaggaauaccagacagauucucaggaucaaaaucaggaacaucagcaacacuaggaauaacaggacuacaaacaggagacgaagcagacuacuacugcggaacaugggacagaucacuaucagcaggaggaguauucggaacaggaacaaaaguaacaguacua

SEQ ID NO: 47461 - RNA, 432 nt, Artificial Sequence
  derived and/or modified sequence opt6 from anti-HIV-1_HeavyChain
caagcacaauuaguagaaaguggaggaggaguaguacaaccaggaagaaguuuaagauuaaguugugcagcaaguggauuuacauuuaguaguuauggaauacauuggguaagacaagcaccaggaaaaggauuagaauggguagcgguaaugaguagcgauggaacauauaaauauuauggagauaguaugaaaggaagauuuacaauaaguagagauaauaguaaaaauaguuuauaucuacaaaugaauaguuuaagggcaguagauacagcaguauauuauugugcaaaagauuuaggagaaggagaaaaugaagaaugggcaacagauuauuaugauuucaguauaggauauccaggacaagauccaagaggaguaguaggaacauuugauauauggggacaaggaacaaugguaacaguaagcagu

SEQ ID NO: 47462 - RNA, 426 nt, Artificial Sequence
  derived and/or modified sequence opt6 from anti-HIV-1_HeavyChain
caaguacaauuaguagaaaguggaggaggaguaguacaaccaggaagaaguuuaagauuaaguugugcagcaaguggauuuacauuuaguagcuauggaaugcauuggguaagacaagcaccaggaaaaggauuagaauggguagcaguaauaagugaugauggaucaaauaaauauuaugcagauaguguaaaaggaagauuuacaauaaguagagauaauaguaaaaauacauuauauuuacaaaugaauaguuuaagagcagaagacacagcaguauauuauugugcaaaagauuuaggagaaagugaaaacgaagaaugggcaagugauuauuaugauuucggaagugauuauccaggacaagauccaagagcaguaguaggagcauucuggggacaaggaacaaugguaacaguaaguagu

SEQ ID NO: 47463 - RNA, 432 nt, Artificial Sequence
  derived and/or modified sequence opt6 from anti-HIV-1_HeavyChain
caaguacaauuaguagaaaguggaggaggaguaguacaaaguggaagaaguuuaagauuaaguugugcagcaaguggauuuacauuuagugcauaugcauuacauuggguaagacaagcaccaggaaaaggauuagaauggguagcaguaauaaguuaugauggaagagauaaagauuaugcagauagcguaaaaggaagauuuacaauaaguagagauaauagcaaaaauacauuauauuuacaaaugaauagcuuaagagcagaagauacagcaguauauuauugugcaaaagauuuaggagaaagugaaaaugaagaaugggcaagugauuauuaugauuuuggaagugauuauccaggacaagauccaagagcaguaguaggagcauuugacauauggggacaaggaacaaugguaacaguaaguagc

SEQ ID NO: 47464 - RNA, 432 nt, Artificial Sequence
  derived and/or modified sequence opt6 from anti-HIV-1_HeavyChain
caaguacaauuaguacaaaguggaggaggguuaguacaaccaggaagaaguuuaagacuaaguuguguagcgaguggauuuagauuuaguuuucauggaaugcauuggguaagacaagcaccaggaaaaggacuagaauggguagcaguaguaagugaugauggaagugaucaaaaauauguagauaguguaaaaggaagauuaacaauaaguagagauaauaguaaaaauacaguauauuuacaaaugaauaguuuaagagcagaagauacagcaguauauuauugugcaaaagauuuaggagaaagugaaaaugaagaaugggcaagugauuauuaugauuuuggaagugauuauccaggacaagauccaagagcaguaguaggagcauuugauauauggggacaaggaacaaugguaacaguaaguagc

SEQ ID NO: 47465 - RNA, 432 nt, Artificial Sequence
  derived and/or modified sequence opt6 from anti-HIV-1_HeavyChain
gaaguacauuuaguagaaaguggaggaggaguaguacaaccaggaagaaguuuaagauuaaguugugcagcaagcggauuuacauuuaauaguuaugcaaugauauggguaagacaagcaccaggaaaaggauuagaauggguagcaguaauaaguuaugauggaaauaauaaauauuacgcagauaguguaaaaggaagauuuacaauaaguagagaaaauaguaaaaauacauuauauuuacaaaugaauagcuuaagagcagaagauacagcaguauaucauugugcaaaagauuuaggagaaagugaaaaugaagaaugggcaagugauuauuaugauuucggaagagauuauccaggacaagauccaagaggaguaguaggaacauuugauauauggggacauggaacaaugguaacaguaaguagu

SEQ ID NO: 47466 - RNA, 432 nt, Artificial Sequence
  derived and/or modified sequence opt6 from anti-HIV-1_HeavyChain
caaguacaauuaguagaaaguggaggaggaguaguaagaccaggaggaaguuuaagauuaagcuguacagcaagcggauuccauuucaauaaauauggaaugaacuggguaagacaagcaccaggaaaaggacuagcauuaguagcauuuauacaaagcggagcaaguuacaauuacuaugcagauagcguaaaaggaagauuuacaauaagcagagacaauagcaaaaacacacuauaucuacaaaugaauagcuuaagagcagaagauacagcaguauauuacugugcaaaagacuuaggagauagcgaaaacgaagaaugggcaagugacuauuacgauuucggaagagauuacccaggacaagacccaagaggaguaguaggagcauucgauauauggggacauggaacaaugguaacaguaagcuca

SEQ ID NO: 47467 - RNA, 432 nt, Artificial Sequence
  derived and/or modified sequence opt6 from anti-HIV-1_HeavyChain
caaguacacuuaguagaaagcggaggaggaguaguacaaccaggaaaaucauuaacaauauacugugcaguaagcgaauuuacacuaagcaacuaugcaaugcacuggguaagacuaacaccaggaaaaggacuacaauggguagcaguaauaucauacgauggaucaaacaaauacuaugcagauagcguaaaaggaagauucacaauaagcagggacaauagcaaaaacacacuauaucuacaaaugaauagcuuaagagcagaagauacagcaguauauuacugugcaaaagacuuaggagaaagcgaaaacgaagaaugggcaucagacuauuacgauuucggaagagauuacccaggacaagacccaagaggaguaguaggaguauucgauauauggggacaaggaacaaugguaacaguaagcuca

SEQ ID NO: 47468 - RNA, 432 nt, Artificial Sequence
  derived and/or modified sequence opt6 from anti-HIV-1_HeavyChain
gaaguacaauuauuagaaaguggaggaggaguaguacaaccaggaagaaguuuaagauuaaguugugcagcaaguggauuuacauuuaguacauaugcauuacauuggguaagacaagcaccaggaaaaggauuagaauggguagcaguaauaaguuaugauggaucaacaaaauuuuaugcagauaguguaaaaggaagauuuacaauaaguagagauaauaguaaaaauacauuauauuuacaaaugaauaguuuaagagcagaagauacagcaguauauuauugugcaaaagaucuaggagaaagugaaaaugaagaaugggcaagugauuauuaugauuuuggaagugauuauccaggacaagauccaagagcaguaguaggagcauuugauauauggggacaaggaacaaugguaacaguaaguagu

SEQ ID NO: 47469 - RNA, 432 nt, Artificial Sequence
  derived and/or modified sequence opt6 from anti-HIV-1_HeavyChain
caaguacaauuaguagaaaguggaggaggaguaguacaaccaggaggaaguuuaagauuaagcugugcagcaagcggauuuacauuuaguaguuauggaaugcauuggguaagacaagcaccaggaaaaggauuagaauggguagcauuuauaagauaugauggaaguaauaaauauuaugcagauaguguaaaaggaagauuuacaauaaguagagaaaauaguaaaaauacacuauauuuacaaaugaauaguuuaagagcagaagauacagcaguauaucauugugcaaaagauuuaggagaaagugaaauagaagaauggacaagugauuauuaugauuuuggaagagauuauccaggacaagauccaagaggaguauuuggaacauuugauauauggggacauggaacaaugguaacaguaaguagu

SEQ ID NO: 47470 - RNA, 432 nt, Artificial Sequence
  derived and/or modified sequence opt6 from anti-HIV-1_HeavyChain
gaaguacaauuaguagaaaguggaggaggaguaguaaaaccaggaggaaguuuaagauuaaguuguguaguaaguggauuuacauuuaguaaugcguggaugaguuggguaagacaagcaccaggaaaaggauuagaauggguagcaguaauaagugaugauggaaguaauaaauauuaugcagauaguguaaaaggaagauuuacaauaaguagagauaauaguaaaaauacauuauauuuacaaaugaauaguuuaagagcagaagauacagcaguauauuauugugcaaaagauuuaggagaaagugaaaaugaagaaugggcaucagauuauuaugauuuuggaagugauuauccaggacaagauccaagagcaguaguaggagcauuugauauauggggacaaggaacaaugguaacaguaaguagu

SEQ ID NO: 47471 - RNA, 432 nt, Artificial Sequence
  derived and/or modified sequence opt6 from anti-HIV-1_HeavyChain
caaguacaauuaguagaaaguggaggaggaguaguacaaccaggaggaaguuuaagacuaagcugugcagcaaguggauuuacauuuaguacauauggaaugcauuggguaagacaagcaccaggaaaaggauuagaauggguagcauuuauaagauaugauggaagaaauaaaaauuaugcagauaguguaaaaggaagauuuacaauaagcagagauaauaguaaaaauacauuauauuuacaaaugaauaguuuaagagcagaagauacagcgguauauuauugugcaaaagauuuaggagaaagugaaaaugaagaaugggcaacagauuauuaugauuuuaguauaggauauccagggcaagauccaagaggaguaguaggaauauuugauauauggggacaaggaacaaugguaacaguaaguagu

SEQ ID NO: 47472 - RNA, 432 nt, Artificial Sequence
  derived and/or modified sequence opt6 from anti-HIV-1_HeavyChain
caaguacacuuaguagaaagcggaggaggaguaguacaaccaggaggaaguuuaagauuaagcugugcagcaaguggauucucauucaguauauauggaaugcacuggguaagacaagcaccaggaaaaggacuagaauggguaacauuuacaagauaugauggaucaaacaaauacuauacagauagcguaaaaggaagauuuacaauaagcagagacaauagcaaaaacacacuauaucuacaaaugaauagcuuaagaacagaagauacagcaguauauuacugugcaaaagacuuaggagaaagcgaaaacgaagaaugggcaucagacuauuacgauuucggaagcgauuacccaggacaagacccaagagcaguaguaggagcauucgauauauggggacaaggaacaaugguaacaguaaguuca

SEQ ID NO: 47473 - RNA, 432 nt, Artificial Sequence
  derived and/or modified sequence opt6 from anti-HIV-1_HeavyChain
caaguacaauuaguagaaaguggaggaggaguaguacaaccaggaggaaguuuaagauuaaguugugcagcaaguggauuuacauuuaguaguuauggaaugcauuggguaagacaagcaccaggaaaaggauuagaauggguagcauuuauaagauaugauggaucaaauaaauauuaugcagauccaguaaaaggaagauuuacaauaaguagagauaauaguaaaaauacauuauauuuacaaaugaauaguuuaagagcagaagauacagcaguauauuauugugcaaaagauuuaggagaaagugaaaacgaagaaugggcaagugauuauuaugauuuuggaagagauuauccaggacaagauccaagaggaguaguaggaguguuugauauauggggacaaggaacaaugguaacagcaagcuca

SEQ ID NO: 47474 - RNA, 432 nt, Artificial Sequence
  derived and/or modified sequence opt6 from anti-HIV-1_HeavyChain
gaaaugcaauuaguagaaaguggaggaggauuaguacaaccaggaggaaguuuaagauuaagcugugcagcaaguggauuuacauuuaguaguuauuggaugaguuggguaagacaagcaccaggaaaaggauuagaauggguagcaguaauaaguuacgauggaaauaauaaauauuaugcagacaguguaaaaggaagauuuacaauaaguagagaaaauagcaaaaauacauuauauuuacaaaugaauaguuuaagagcagaagauacagcaguauauuauugugcaaaagauuuaggagaaagugaaaaugaagaaugggcaagugauuauuaugauuuuggaagugauuauccaggacaagauccaagaggaguaguaggaacauuugauauauggggacauggaacaaugguaacaguaaguagu

SEQ ID NO: 47475 - RNA, 432 nt, Artificial Sequence
  derived and/or modified sequence opt6 from anti-HIV-1_HeavyChain
caaguacaauugguagaaaguggagguggaguaguacaaccaggaagaaguuuaagauugaguugugcagcaaguggauuuacauuuaguaguugugcaaugcauuggguaagacaagcaccaggaaaaggauuagaauggguagcaguaauaaguuaugauggaaauaacaaacauuaugcagauaguguaaaaggaagauuuacaauaaguagagauaauaguaaaaauacauuauauuuacaaaugaauaguuuaagagcagaagauauggcaguauauuauugugcaaaagauuuaggagaaagugaaaaugaagaaugggcaagugauuauuaugauuuuuggagagauuauccgggacaagauccaagaggauggguaggaacauuugauauauggggacaaggaacaauggugacaguaaguagu

SEQ ID NO: 47476 - RNA, 432 nt, Artificial Sequence
  derived and/or modified sequence opt6 from anti-HIV-1_HeavyChain
caaguacaauuaguagaaagcggaggaggaguaguacaaccaggaagaaguuuaagauuaagcugugcagcaagcggauuuacauucucaaauuauggaaugcacuggguaagacaagcaccaggaaaaggacuagaauggguaacaguaauaucaagugauggaucaaaaaaauacuaugcagauaguguaaaaggaagauuuacaauaagcagagacaauaguaaaaacacauuauaucuacaaaugaauggauuaagagcagacgauacagcaguauauuacugugcaaaagacuuaggagauagugaaaaugaagaaugggcaucagacuauuacgauuucggaagagauuacccaggacaagacccaagaggaguaguaggagcauucgauauauggggacaugguacaaugguaacaguaaguuca

SEQ ID NO: 47477 - RNA, 432 nt, Artificial Sequence
  derived and/or modified sequence opt6 from anti-HIV-1_HeavyChain
caaguacaauuaguagaaaguggaggaggaguaguacaaccaggaggaaguuuaagauuaaguugugcagcaaguggauuuacauuuucaaguuacggaaugcauuggguaagacaagcaccaggaaaaggauuagaauggguagcauuuauaagauaugauggaaguaauaaauauuaugcagauaguguaaaaggaagauuuacaauaaguagagauaauaguaaaaauacauuauauuuacaaaugaauaguuuaagagcaguagauacagcaguauauuauugugcaaaagauuuaggagaaggagaaaaugaagaaugggcaacagauuauuaugauuuuaguauaggauauccaggacaagauccaagaggaguaguaggagcauuugauauauggggacaaggaacaaugguaacaguaaguagu

SEQ ID NO: 47478 - RNA, 432 nt, Artificial Sequence
  derived and/or modified sequence opt6 from anti-HIV-1_HeavyChain
caaguacaauuaguagaaaguggaggaggaguaguacaaccaggaagaagucuaagauuaaguugugcagcaaguggauuuacauuuagaaauuauggaaugcauuggguaagacaaaguccaggaaaaggauuagaauggguagcaguaauaaguuaugauggaaaaauaauaaauuauauagauuuuguaaaaggaagauuuacaauaagcagagaaaauaguaaaaauacauuauauuuacaaaugaauaguuuaagagcagaagauacagcaguauauuauugugcaaaagauuuaggagaaagugaaaaugaagaaugggcaagugauuauuaugauuuuggaagugauuauccaggacaagauccaagaggaguaguaggaacauuugauauauggggacaugggacaaugguaacaguaaguagu

SEQ ID NO: 47479 - RNA, 432 nt, Artificial Sequence
  derived and/or modified sequence opt6 from anti-HIV-1_HeavyChain
gaaguacaauuacuagaaagcggaggaggauuaguacaaccaggaaggagucuaagauuaagcugugcagcaagcggauucacauuuucaaguuauguaaugcacuggguaagacaagcaccaggaaaaggauuagaauggguagcaguaauaucauacgauggaucaaacaaacacuaugcagauagcguaaaaggaagauuuacaauaaguagagacaauagcaaaaacacacuauaucuacaaaugaauagcuuaagagcagaagauacagcaguauauuacagagcaaaagacuuaggagaaagugaaaaugaagaaugggcaucagacuauuacgauuucggaagagauuacccaggacaagacccaagaggaguaguaggaguauuauauauauggggacaaggaacaaugguaacaguaagcuca

SEQ ID NO: 47480 - RNA, 432 nt, Artificial Sequence
  derived and/or modified sequence opt6 from anti-HIV-1_HeavyChain
gaaguacaauuaguagaaagcggaggaggauuaguaaaaccaggaggaagucuaagauuaagcugugcagcaagcggauucacauucucaacauauagcaugcacuggguaagacaagcaccaggaaaaggacuagaauggguagcaguaauaucauacgauggaaauaacaaauacuaugcagauagcguaaaaggaagauuuacaauaagcagagaaaauaguaaaaacacacuauaucuacaaaugaauaguuuaagagcagaagauacagcaguauaucacugugcaaaagacuuaggagaaagcgaaaacgaagaaugggcaucagacuauuacgauuucggaagagauuacccaggacaagacccaagaggaguaguaggaacauucgauauauggggacauggaacaaugguaacaguaagcagu

SEQ ID NO: 47481 - RNA, 432 nt, Artificial Sequence
  derived and/or modified sequence opt6 from anti-HIV-1_HeavyChain
caagugcaauuaguagauaguggaggaggaguagugcaaccaggaagaucauuaagauuauucugugcaguaagcggauucacauucagcacauauacaaugcacuggguaagacaagcaccaggaagaggacuagaauggguagcaguaauaucauacgauggaaguacaaaauacuaugcagauagcguacaaggaagauuuacaauaagcagagacaauagcaaaaacacacuauaucuacaaaugaauagcuuaagagcagaagauacagcaguauauuacugugcaaaagacuuaggagaaagcgaaaaugaagaaugggcaucagacuauuacgauuucggaagcgauuacccaggacaagacccaagagcgguaguaggagcauuugauauauggggacaaggaacaaugguaacaguaagcuca

SEQ ID NO: 47482 - RNA, 426 nt, Artificial Sequence
  derived and/or modified sequence opt6 from anti-HIV-1_HeavyChain
caaguacaauuaguagaaaguggaggaggaguaguacaaccaggaagaaguuuaagauuaaguugugcagcaaguggauuuacauuuaguaguuuuggaaugcauuggguaagacaagcaccaggaaaaggauuagaauggguagcaguaauaucauaugauggaaauaauaaauauuaugcagauaguguaaaaggaagauuuacaauaaguagagaaaauaguaaaaauacauuauauuuacaaaugaauaguuuaagaccagaagauacagcaguauauuauugugcaaaagauuuaggagaaagugaaaaugaagaaugggcaagugauuacuaugauuuuggaagagauuauccaggacaagauccaagaggaguaguaggaacauuugauauauggggacauggaacaaugguaacagug

SEQ ID NO: 47483 - RNA, 432 nt, Artificial Sequence
  derived and/or modified sequence opt6 from anti-HIV-1_HeavyChain
caaguacaauuaguagaaaguggaggaggaguaguacaaccaggaaggagcuuaagauuaaguugugcagcaaguggauuuauguuuaguagauauggaaugcauuggguaagacaagcaccaggaaaaggauuagaauggguagcaguaauaagucaugauggaaguaauaaauauuaugcagauaguguaaaaggaagauuuauaauaaguagagauaauagcaaaaauacauuauauuuacaaaugaauaguuuaagagcagaugauacagcaguauauuauugugcaaaagauuuaggagaaagugaaaaugaagaaugggcaagugauuauuaugauuuuuggauaggauauccaggacaagauccaagaggaguaguaggagcauuugauauauggggacaaggaacaaugguaacaguaaguuca

SEQ ID NO: 47484 - RNA, 432 nt, Artificial Sequence
  derived and/or modified sequence opt6 from anti-HIV-1_HeavyChain
caaguacaauuaguagaaaguggaggaggaguaguacaaccaggaggaaguuuaagauuaaguugugcagcaagugcauuuacauuuaguaguuauggaaugcauuggguaagacaagcaccaggaaaaggauuagaauggguagcauuuauaagauaugauggaaguaauaaauauuaugcagauaguguaaaaggaagauuuacaauaaguagagauaauaguaaaaauacauuauuuuuacaaaugaauagcuuaagagcagaagauauggcaguauauuauugugcaaaagauuuaggagaaagugaaaaugaagaaugggcaagugauuauuaugauuuuuggagagauuauccaggacaagauccaagaggauggguaggaacauuugauauauggggacaaggaacaaugguaacaguaaguagu

SEQ ID NO: 47485 - RNA, 426 nt, Artificial Sequence
  derived and/or modified sequence opt6 from anti-HIV-1_HeavyChain
caaguacaauuaguagaaaguggaggaggaguaguacaaccaggaagaucauuaagauuaagcugugcagcaagcggauucacauucagcaguuuuggaaugcacuggguaagacaagcaccaggaaaaggacuagaauggguagcaguaauaucauacgauggaucaaacaaauacuauguagauagcguaaaaggaagauuuacaauaaguagagacaauaguaaaaauacacuauauuuacaaaugaauagcuuaagagcagaagauacagcaguauaugcaaaagacuuaggagaaagcgaaaaugaagaaugggcaucagacuauuacgauuucggaagugauuacccaggacaagacccaagaggaguaguaggaacauucgauauauggagucaaggaacaaugguaacaguaagcuca

SEQ ID NO: 47486 - RNA, 432 nt, Artificial Sequence
  derived and/or modified sequence opt6 from anti-HIV-1_HeavyChain
caaguacaauuaguagaaaguggaggaggaguaguacaaccaggaggaaguuuaagacuaaguugugcagcaaguggauuuacauuuaguacauauggaaugcauuggguaagacaagcaccaggaaaaggauuagauuggguagcauuuauaagauaugauggaagucauaaauauuaugcagauaguguaaaaggaagauuuacaauaagcagagaaaauagcaaaaauacauuauauuuacaaaugaauaguuuaagaccagaagauacagcaguauauuauugugcaaaagauuuaggagaaagcgaaaaugaagaaugggcaagugauuauuaugauuuuggaagagauuauccaggacaagauccaagaggaguaguaggaacauuugauauauggggacauggaacaaugguaacaguaaguagu

SEQ ID NO: 47487 - RNA, 432 nt, Artificial Sequence
  derived and/or modified sequence opt6 from anti-HIV-1_HeavyChain
caaguacaauuaguagaaaguggaggaggaguaguacaaccaggaagaagucuaagauuaaguugugcagcaaguggauuuacauuuaguaguuaugcaaugcauuggguaaggcaagcaccaggaaaaggauuagaauggguagcaguaauaaguuaugauggaucaggagauuauuaugcagauaguguaaaaggaagauuuacaauaaguagagauaauaguaaaagcacauuauauuuacaaaugaauaguuuaagaccagaagauacagcaguauauuauugugcaaaagauuuaggagaaagcgaaaaugaagaaugggcaagugauuauuaugauuuuggaagagauuauccaggacaagauccaagaggaguaguaggaacauuugauauauggggacauggaacaaugguaacaguaaguagu

SEQ ID NO: 47488 - RNA, 432 nt, Artificial Sequence
  derived and/or modified sequence opt6 from anti-HIV-1_HeavyChain
caaguacauuugguagaaaguggaggaggaguaguacaaccaggaggaaguuuaagauuaaguugugcagcaaguggguuuacauuuaguacauauggaaugcaauggguaagacaagcaccaggaaaaggauuagaauggguagcauuuauaaaaaaugauggaacaaaugaauuuuauggagauaguguaaaaggaagauuuacgauaaguagagauaauaguaaaaauacaguaaguuuacauauggauaguuuaagaccagaagauacagcauuauauuauugugcaaaagauuuaggagaaagugaaaaugaggaaugggcaagugauuauuaugauuuuggaagugauuauccaggacaagauccaagagcaguaguaggagcauuugauauauggggacaaggaacaaugguaacaguaaguuca

SEQ ID NO: 47489 - RNA, 432 nt, Artificial Sequence
  derived and/or modified sequence opt6 from anti-HIV-1_HeavyChain
caaguacaauuaguagaaaguggaggaggaguagugcaaccaggaggaaguuuaagauuaaguuguguagcaagcggauuuacauuuucaaguuauggaaugcauuggguaagacaagcgccaggaaaaggacuagaauggguagcauuuauaagauaugauggaagaaauaaauauuaugcagauaguguaaaaggaagauuuacaauaaguagagauaaaaguaaaaauacauuaugucuacaaaugaauaguuuaagaguagaagauacagcaguauauuauugugcaaaagauuuaggagauagugaaaaugaagaaugggcaagugauuauuaugauuuugggagagauuauccaggacaagauccaagaggaguaguaggagcauuugauauauggggacauggaacaaugguaacaguaaguagu

SEQ ID NO: 47490 - RNA, 432 nt, Artificial Sequence
  derived and/or modified sequence opt6 from anti-HIV-1_HeavyChain
caaguacaauugguagaaaguggaggaggaguaguacaaccaggaagaaguuuaagauuaagcugugcagcaaguggauuuacauuuaguaguuauggaaugcauuggguaagacaagcaccaggaaaaggauuagaauggguagcaguaauaaguuaugauggaucaaauaaauauuauagagauaguguaaaaggaagauuuacaauaaguagagauaauaguaaaaauacaguauauuuacaaaugaauaguuuaagagcagaagauacagcaguauauuauugugcaaaagauuuaggagaaagugaaagugaagaaugggcaagugauuauuaugauuuuggaagagauuauccaggacaagauccaagaggaguaguaggagcauuagauauauggggacaaggaauaaugguaacaguaaguagu

SEQ ID NO: 47491 - RNA, 432 nt, Artificial Sequence
  derived and/or modified sequence opt6 from anti-HIV-1_HeavyChain
gaaguacaauuaguagaaaguggaggaggaaugguacaaccaggaagaccauuaagauuaaguugugcagcaaguggauuuauauuuaguggauuuggacuacauuggguaagacaagcaccaggaaaaggauuagaauggguagcaaguauaaguuaugauggaggaaauaaauauuaugcagauaguguaagaggaagguuuacaauaaguagagauaauaguaaaaauacauuauauuuacaaaugaauaguuuaagagcagaagauacagcaguauauuauugugcaaaagauuuaggagaaagugaaaaugaagaaugggcaagugauuauuaugauuuuggaagugauuauccaggacaagauccaagagcaguaguaggagcauuugauauauggggacaaggaacaaugguaacaguaaguagu

SEQ ID NO: 47492 - RNA, 432 nt, Artificial Sequence
  derived and/or modified sequence opt6 from anti-HIV-1_HeavyChain
gaaguacaauuaguagaaaguggaggaggaguaguaagaccaggaggaagucuaagauuaaguugugcagcaaguggauuuacauuuaaugauuauggaauggcauggguaagacaagcaccaggaaaaggauuagaauggguagcagauauaaguuaugauggaagcaauaaauauuaugcagauaguguaaaaggaagauuuacaauaaguagagauaauaguaaaaauacauuauauuuacaaaugaauaguuuaagagcagaagauacagcaguauauuauugugcaaaagauuuaggagaaagugaaaaugaagaaugggcaagugauuauuaugauuuuggaagagauuauccaggacaagauccaagaggaguaguaggagcauuugauauauggggacaaggaacaaugguaacaguaaguagu

SEQ ID NO: 47493 - RNA, 429 nt, Artificial Sequence
  derived and/or modified sequence opt6 from anti-HIV-1_HeavyChain
caaguacaauuaguagaaaguggaggaggaguaguacaaccaggaaggucauuaagauuaagcugugcagcaaguggauucacauuuaguaguuauggaaugcauuggguaagacaagcaccaggaaaaggauuagaauggguagcaguaguaaguuaugaugaaaguaaauauuaugcagauaguguaaaaggaagauuuacaauaaguagagauaauaguaaaaauacauuauauuuacaaaugaauaguuuaagagcagaagauauggcaguauauuauugugcaaaagauuuaggagaaagugaaaaugaagaaugggcaagugauuauuaugaauuuuggagagauuauccaggacaagauccaagaggauggguaggaacauuugauauauggggacaaggaacaaugguaacaguaaguagu

SEQ ID NO: 47494 - RNA, 432 nt, Artificial Sequence
  derived and/or modified sequence opt6 from anti-HIV-1_HeavyChain
caaguacaauuaguagaaccaggaagaggaguaguacacccaggaggaaguuuaagacuaagcuguguaacaagcggauucacauuugaaaauuuuccaaugcacuggguaagacaagcaccaggaaaaggacuagaauggguagcauuaauaucauaugauggaucagacaaauacuauagcgauagcguaaaaggaagauuuacaauaagcagagacaauagcaaaaacacauuauauuuacaaaugaauagcuuaagagcagaagauacagcaguauauuacugugcaaaagacuuaggagaaagugaaaaugaagaaugggcaucagacuauuacgauuucggaagcgauuacccaggacaagacccaagaggaguaguaggaacauucgauauauggggacauggaacaaugguaacaguaaguuca

SEQ ID NO: 47495 - RNA, 432 nt, Artificial Sequence
  derived and/or modified sequence opt6 from anti-HIV-1_HeavyChain
caagcacaauuaguagaaaguggaggaggaguaguacaaccaggaagaaguuuaagauuaaguugugcagcaaguggauuuaguuuugcaacacaugcaaugcauuggguaagaagaaguccaggaaaaggauuagaauggguagcaacaauaaguuauggaggaaaaaaugaauauuaugcagauagcguaaaaggaagauuuacaauaaguagagaaaauaguaaaaauacauuauauuuacaaaugaauaguuuaagagcagaagauacagcaguauauuauugugcaaaagauuuaggagaaagugaaaaugaagaaugggcaagugauuauuaugauuuuggaagugauuauccaggacaagauccaagaggaguaguaggaacauuugauauauggggacauggaacaaugguaacaguaaguagu

SEQ ID NO: 47496 - RNA, 432 nt, Artificial Sequence
  derived and/or modified sequence opt6 from anti-HIV-1_HeavyChain
gcaguacaauuaguagaaaguggaggaggauuaguaaaaccaggaggaaguuuaagauuaaguugugcagcaaguggauuuacauuuuuuaauacauggaugagcuggguaaggcaaaguccaggaaaaggauuagaauggguagcagauauaaguuaugauggaaguaauaaauauuaugcagauaguguaaaaggaagauuuacaauaaguagagauaauaguaaaaauacauuauauuuacaaaugaauaguuuaagagcagaagauacagcaguauauuauugugcaaaagauuuaggagaaagugaaaaugaagaaugggcaagugauuauuaugauuuuggaagagauuauccaggacaagauccaagaggaguaguaggaguguuugauauauggggacaaggaacaaugguaacaguaaguagu

SEQ ID NO: 47497 - RNA, 432 nt, Artificial Sequence
  derived and/or modified sequence opt6 from anti-HIV-1_HeavyChain
caaguacaauuaguagaaagcggaggaggaguaguacaaccaggaagaaguuuaagauuaagcugugcagcaagcggauuuacauuuucaagcuauggaaugcacuggguaagacaagcgccaggaaaaggacuagaauggguagcaguaauaucauaugauggaucaaauaaauauuaugcagauaguguaaaaggaagauuuacaauaagcagagacaauaguaaaaauacauuauaucuacaaaugaauaguuuaagagcagaagauacagcaguauauuacugugcaaaagacuuaggagaaagugaaaaugaagaaugggcaucagacuauuaugauuucggaagugauuauccaggacaagacccaagagcaguaguaggagcauuugauauauggggacaaggaacaaugguaacaguaagcagu

SEQ ID NO: 47498 - RNA, 432 nt, Artificial Sequence
  derived and/or modified sequence opt6 from anti-HIV-1_HeavyChain
caaguaagauuaguagaaaguggaggaagaguaguacaaccaggaggaaguuuaagauuaaguuguguagcaagcggauuuacauuuaguaguuauggaauacauuggguaagacaagcaccaggaaaaggauuagaauggguaacauuuauauggcaugauggaagagauacauauuaugcagaugcaguaaaaggaagauuuacaauaaguagagauaauaguaaaaauacauuauauuuacaaaugaauaguuuaagagcagaagauacagcgguauauuauugugcaaaagauuuaggagaaagugaaaaugaagaaugggcaacagauuauuaugauuuuuggacaggauauccaggacaagauccaagagcaguaguaggagcauuugauauauggggacaaggaacaaugguaacaguaaguagu

SEQ ID NO: 47499 - RNA, 432 nt, Artificial Sequence
  derived and/or modified sequence opt6 from anti-HIV-1_HeavyChain
caaguacauuuaguagaaagcggaggaggaguaguacaaccaggaagaaguuuaagaauauacugugcaguaagugaauuuacauucagaaauuaugcaaugcacuggguaagacuagcaccaggaaaaggacuacaauggguagcaguaauaucauaugauggaucaaauaaauauuauggagauaguguaaaaggaagauuuacaauaagcagagacaauaguaaaaauacacuauauuuacaaauggauagcuuaagagcagaagauacagcaguauauuacugugcaaaagacuuaggagaaagugaaaaugaagaaugggcaucagacuauuaugauuucggaagagauuauccaggacaagacccaagaggaguaguaggaacauuugauauauggggacauggaacaaugguaacaguaaguuca

SEQ ID NO: 47500 - RNA, 432 nt, Artificial Sequence
  derived and/or modified sequence opt6 from anti-HIV-1_HeavyChain
gaaguacaauuaguagaaaguggaggaggauuaguaaaaccaggaggaaguuuaagauuaaguugugcagcaaguggauuuacauuuagugaugcauggaugagcuggguaagacaagcaccaggaaaaggaauggaauggguagcaguaauaaguuaugauggaaguaauaaauauuaugcagauagugugaaaggaagauuuacaauaaguagagauaauaguaaaaauacauuauaucuacaaaugaauaguuuaagagcaguagauacagcaguauauuauugugcaaaagauuuaggagaaggagaaaaugaagaaugggcaacagauuauuaugauuuuaguauaggauauccaggacaagauccaagaggaguaguaggagcauuugauauauggggacaaggaacaaugguaacaguaaguagu

SEQ ID NO: 47501 - RNA, 432 nt, Artificial Sequence
  derived and/or modified sequence opt6 from anti-HIV-1_HeavyChain
gaaguacaaguaguagaaaguggaggaggauuaguaaaaccaggaggaaguuuaagauuaaguugugaagcaaguggauuuacauuuaguaaugcauggaugaguuggguaagacaagcaccaggaaaaggauuagaauggguagcaguaauaaguuaugauggaaauaauaaauauuaugcagauagcguaaaaggaagauuuacaauaaguagagaaaauaguaaaaauacauuauauuuacaaaugaauaguuuaagagcagaagauacagcaguauaucauugugcaaaagauuuaggagaaagugaaaaugaagaaugggcaagugauuauuaugauuuuggaagagauuauccaggacaagauccaagaggaguaguaggaacauuugauauauggggacauggaacaaugguaacaguaaguagu

SEQ ID NO: 47502 - RNA, 432 nt, Artificial Sequence
  derived and/or modified sequence opt6 from anti-HIV-1_HeavyChain
caaguacaauuaguagaaagcggaggaggaguaguacaaccaggaggaaguuuaagauuaagcugugcagcaaguggauuuacauuuaguaguuauggaauacauuggguaagacaagcaccagggaaaggauuagaauggguagcauuuauaagaagugaugcaacaaauaaauauuaugcagauaguguaaaaggaagauuuacaauaaguagagaaaauaguaaaaauacauuauaucuacaaaugaauaguuuaagagcagaagauacagcaguauauuauugugcaaaagauuuaggagaaagugaaaaugaagaaugggcaagugauuauuaugauuuuggaagugauuauccaggacaagauccaagaggaguaguaggaacauuugauauauggggacauggaacaaugguaacaguaaguagu

SEQ ID NO: 47503 - RNA, 432 nt, Artificial Sequence
  derived and/or modified sequence opt6 from anti-HIV-1_HeavyChain
caaguacaauuaguagaaaguggaggaggaguaguacaaccaggaagaaguuuaagauuaaguugugcagcaaguggauuuacauuuucaaguuuuggaaugcacuggguaagacaagcaccaggaaaaggauuagaauggguagcaguaauaaguuaugauggaaauaauaaauauuaugcagauaguguaaaaggaagauuuacaauaagcagagaaaauaguaaaaauacacuuuauuuacaaaugaauaguuuaagagcagaagauacagcaguauauuauugugcaaaagauuuaggagaaagugaaaaugaagaaugggcaucagauuauuaugauuuugggagugauuauccaggacaagauccaagaggaguaguaggaacauuugauauauggggacauggaacaaugguaacaguaaguagu

SEQ ID NO: 47504 - RNA, 432 nt, Artificial Sequence
  derived and/or modified sequence opt6 from anti-HIV-1_HeavyChain
caaguacaauuaguagaaaguggaggaggaguaguacaaccaggaagaaguuuaagacuaaguugugcagcaaguggauuuacauuuaguaauuaugcaauggauuggguaagacaagcaccaggaaaaggauuagaauggguagcaguaauaaguuaugauggaaguaauaaauauuaugcagauaguguaaaaggaagauuuacaauaaguagagauaauagcaaaaauacauuauauuuacaaaugaauaguuuaagagcagaagauacagcaguauauuauugugcaaaagauuuaggagaaagugaaaaugaagaaugggcaacagauuauuaugauuuuuggacaggauauccaggacaagauccaagagcaguaguaggagcauuugauauauggggacaaggaacaaugguaacaguaaguagu

SEQ ID NO: 47505 - RNA, 432 nt, Artificial Sequence
  derived and/or modified sequence opt6 from anti-HIV-1_HeavyChain
caaguacaauuaguagaaaguggaggaggaguaguacaaccaggaaggagcuuaagauuaaguugugcagcaaguggauuuacauuuaguaguuauggaaugcauuggguaagacaagcaccaggaaaaggauuagaauggguagcaguaguaaguuaugaugaaaguaauaaauauuaugcaggaaguguaaaaggaagguuuacaauaaguagagauaauaguaaaaauacauuauauuuacaaaugaauaguuuaagaacagaagauauggcaguauauuauugugcaaaagauuuaggagaaagugaaaaugaagaaugggcaagugauuauuaugauuuuggaagagaauauccaggacaagauccaagaggauggguaggaacauuugauauauggggacaaggaacaaugguaacaguaaguagu

SEQ ID NO: 47506 - RNA, 432 nt, Artificial Sequence
  derived and/or modified sequence opt6 from anti-HIV-1_HeavyChain
caaguacaauuaguagaaaguggaggaggaguaguacaaccaggaagaaguuuaagauuaaguugugcagcaaguggauuuacauuuaguaguuauggaaugcauuggguaagacaagcaccaggaaaaggauuagaauggguagcaguaauaaguuaugauggaaguaauaaauauuauguagauaguguaaaaggaagauuuacaauaaguagagauaauaguaaaaauacauuauauuuacaaaugaauaguuuaagagcagaagauacagcaguauauuauugugcaaaagauuuaggagaaagugaaaaugaagaaugggcaacagauuauuaugauuuuaguauaggauauccaggacaagauccaagaggaguaguaggaauauuugauauauggggacaaggaacaaugguaacaguaaguagu

SEQ ID NO: 47507 - RNA, 432 nt, Artificial Sequence
  derived and/or modified sequence opt6 from anti-HIV-1_HeavyChain
caaguacaauuaguagaaaguggaggaggaguaguacaaccaggaagaaguuuaagauuaaguugugcagcaaguggauuuacauuuaguacaaguggaaugcauuggguaagacaagcaccaggaaaaggaauggaauggguagcaguaauaaguuaugauggaaguaauaaauauuaugcagauaguguaaaaggaagauuuacaauaaguagagauaauagcaaaaauacacuauauuuacagaugaauaguuuaagagcaguagauacagcaguauauuauugugcaaaagauuuaggagaaggagaaaaugaagaaugggcaacagauuauuaugauuuuaguauaggauauccaggacaagauccaagaggaguaguaggagcauuugauauauggggacaaggaacaaugguaacaguaagcagu

SEQ ID NO: 47508 - RNA, 363 nt, Artificial Sequence
  derived and/or modified sequence opt6 from anti-HIV_C38-VRC18.02_HeavyChain
caaguaagauuaguacaaaguggaaaucaaguaagaaaaccaggagcaaguguaagaauaaguugugaagcaaguggauauaaauuuauagaucauuuuauacauuggguaagacaaguaccaggacauggauuagaauggcuaggauggauaaauccaagaggaggaggaguaaauuauaguagaaguuuucaaggaaaauuaaguaugacaaugacaagagauaauuuugaagaaacagcauauuuagauuuaaguaaacuaaauccaggagauacagcaguauauuuuugugcaagaggauuugcaggauaugaauggaguuuuauauggggacaaggaacauuaguaauaguaagcagu

SEQ ID NO: 47509 - RNA, 396 nt, Artificial Sequence
  derived and/or modified sequence opt6 from anti-HIV_44-VRC13.02_HeavyChain
caaguacaauuaguacaaucaggaacagcacuaaaaaguccaggaucaagugcaaaauuaaguuguacaguacuaggagaugaauuuggaacauauuucauaagcuggauaagacaagcaccaggacaaggacuagaauggguaggaggaauaguaccacauagccaauuacaaaguucagcacaaaaauuucacggaagaauaauaauaagcgcaggagcaggaguaacaccaccaguaguaucacuacaacuaacaaacuuaacauuugaagauacaggaacauauuucugugcaagagaaagaggaagacacagagacccaaaaacaggagaugcauuaagaggaagauauuucgauuucuggggaagaggaacaggauuaagaguaagcaca

SEQ ID NO: 47510 - RNA, 321 nt, Artificial Sequence
  derived and/or modified sequence opt6 from anti-HIV-1_LightChain
gauauaaaacuaacacaaucaccagcauucuuaagugcaagcguaggagaaagaguaacauuuacauguagagcaagccaagacauaagccaugacuuaguaugguuccaacaaaaagcaggaagagcaccaucacuauuaauguuuuacggaagcacacuagaaagaggaguaccaccaagauucucaggaagaagaucaggaacagaauuuacaguaacaauagacucacuacaaccagaagacguaggaacauacuauugccaacaauuaagcgcauucccacuaacauucggaggaggaacaacaguagauauaaaa

SEQ ID NO: 47511 - RNA, 321 nt, Artificial Sequence
  derived and/or modified sequence opt6 from anti-HIV-1_LightChain
gauauaaaaaugacacaaucaccagcauucuuaagcgcaagcguaggagaaagaguaacauuuacauguagagcaagccaagacauaagccaugacguaguaugguuccaacaaaaaucaggaagcgcaccaaaacuauuaauguuuuacggaagcacacuagaaagaggaguaccaccaagauucagcggaagaagaucaggaacagaauuuacaguaacaauagacggacuacaaccagaagacguaggaacauacuauugccaacaauuaagcgcauucccacuaacauucggaggaggaacaacaguagauauaaaa

SEQ ID NO: 47512 - RNA, 321 nt, Artificial Sequence
  derived and/or modified sequence opt6 from anti-HIV-1_LightChain
gauauaaaacuaacacaaucaccagcauucuuaagugcaagcguaggagaaagaguaacauuuacauguagagcaagccaagacauaagacaugaauuaguaugguaccaacaaaaaccaggaagaggaccaaaauuauuaauauauuacggaaguacacuagaaggaggaguaccaagcagauucucaggaagaagaucaggaacagaauuuacaguaacaauaagcucacuacaaccagaagacguaggaacauacuauugccaacaauuaaacucauucccacuaacauucggaggaggaacaacaguagauauaaga

SEQ ID NO: 47513 - RNA, 321 nt, Artificial Sequence
  derived and/or modified sequence opt6 from anti-HIV-1_LightChain
gacauacaacuaacacaaucaccaucauuccuaucagcaucaguaggagacagaguaucaauaacaugcagagcaucacaaggaauaaaacacgaacuagcaugguaccaacaaaaaccaggaagagcaccaucacuacuaauauacuacgcaucaacacuagcaagaggaguaccaucaagauucucagcaucauggucaggaacacuauucacacuaacaauaaacggacuacaaccagaagacuucgcaacauacuucugccaacaaaugaacucacuaccacuaacauucggaggaggaacaaaaauggacguaaga

SEQ ID NO: 47514 - RNA, 321 nt, Artificial Sequence
  derived and/or modified sequence opt6 from anti-HIV-1_LightChain
gacauacaacuaacacaaucaccaucauuccuaucagcaucaguaggagacaaaguaacaauaacaugcagagcaucacacggaguaagaaacgaacuagcaugguaccaacaaaaaccaggaaaagcaccaaaccuacuaauauacuacgcaucaacacuacaaucaggaguaccaucaagauucucagcaacaggaucaggaacacacuucacacuaacaguaucaucacuacaaccagaagacuucgcaacauacuucugccaacacaugucaucauacccacuaacauucggaggaggaacaaaaguagaaauaaaa

SEQ ID NO: 47515 - RNA, 321 nt, Artificial Sequence
  derived and/or modified sequence opt6 from anti-HIV-1_LightChain
gacauacaacuaacacaaucaccaucauuccuaucagcaucaguaggagacaaaguaacauucacaugcagagcaucacaaggaguaagaaacgaacuagcaugguaccaacaaaaaccaggaaaagcaccaaaccuacuaauauacuacgcaucaacauuacaaucaggaguaccaucaagauucucagcaacaggaucaggaacacacuucucacuaacaguaucaucacuacaaccagaagacuucgcaacauacuucugccaacacaugucaucauacccacuaacauucggaggaggaacaaaaguagaaauaaaa

SEQ ID NO: 47516 - RNA, 321 nt, Artificial Sequence
  derived and/or modified sequence opt6 from anti-HIV-1_LightChain
gacauacaacuaacacaaucaccaucauuccuaucagcaucaguaggagacaaaguaacaauaacaugccgagcaucacaaggaguaagaaacgaacuagcaugguaccaacaaaaaccaggaaaagcaccaaaccuacuaauauacuacgcaucaacauuacaaucaggaguaccaucaagauucucagcaacaggaucaggaacacacuucacauuaacaguaucaucacuacaaccagaagacuucgcaacauacuucugccaacacaugucaucauacccacuaacauucggaggaggaacaaaaguagaaauaaaa

SEQ ID NO: 47517 - RNA, 366 nt, Artificial Sequence
  derived and/or modified sequence opt6 from anti-HIV-1_HeavyChain
agucaauauuuagcacaaccaggagcagaaguagcaaaaccaggagcaaguguaaaaguaaguuguaaaguacacggagacaauuucagaggacauuauuuacacuggguaagacaagcaccaggacaaggacuacaauggauaggaggaauaaauccauuuagcggagaagcagcauauggaaaaagauuugaaggaagauuaagauuaacaagagacacaaguguaaauacagcauauauggaauuagcaaaacuaacaccagacgauacagcaguauauuucugugcaagagauaaaacauauaacgaugaauuuacagcaauggauauauggggacauggaacaacaguuauaguaagcagu

SEQ ID NO: 47518 - RNA, 366 nt, Artificial Sequence
  derived and/or modified sequence opt6 from anti-HIV-1_HeavyChain
agucaauauuuagcacaaccaggagcagaaguagcaaaaccaugggcaaguguaaaaguaaguuguagaguacauggagauaauuuuagaggauuuuaucuacauuggguaagacaagcaccaggacaaggauuagaauggauaggaggaauaaauccauuuaguggagaagcagcauauggaagaagauuugaaggaagauuaagauuaacaagagauacgaguauaaauacagcauauauggaaguaacaaaauuaacaagugaugauacagcaguauauuuuugugcaagagauaaaacauauaaugaugaauuuacagcaauggauauauggggacaaggaacaacaguaauaguaaguagu

SEQ ID NO: 47519 - RNA, 366 nt, Artificial Sequence
  derived and/or modified sequence opt6 from anti-HIV-1_HeavyChain
ucacaauauuuagcacaaucaggaucagaaguaaaaaaaccaggagcaucaguaaaaguaucaugcagacuacauggagauaaauuuggagcacacuauauacauuggguaagacaagcaccaggacaaggauuagaauggcuaggauucuuucacccaggaacaggagaugccguaagugcacaaaaauuucaaggaagaauaucauuaacaagagauacaucaauaucaacaggauacuuagaaguaagaagauuaucaagugaugacacagcaguauacuauugcgcaagagauaaaacauacucagacgaagcaacaggaauggacauauggggacaaggaacaacaguaauaguaucaagc

SEQ ID NO: 47520 - RNA, 366 nt, Artificial Sequence
  derived and/or modified sequence opt6 from anti-HIV-1_HeavyChain
ucacuagaacuaguacaaucaggaacagaaguaaaaaaaccaggagcaucaguaaaaguaucaugcaaacuauuuggagauacaauaacaucaggaccaauacauuggguaagacaagcaccaggacaaggauuagaauggaugggauggacaaacccacacucaggagauacagcaacagcaccaaaauuccaaggaagaguauauaugacaaacgauaaaaaaauaaauacagcauucuuagacguaacaagauuagcaagcgaugacacagcaauauacuuuugcgcaagagauauguauuacucaaacgaagcaguaggaauggacguauggggacaaggaacaacaguaucaguaucaagc

SEQ ID NO: 47521 - RNA, 366 nt, Artificial Sequence
  derived and/or modified sequence opt6 from anti-HIV-1_HeavyChain
caagaaguauuaguacaaaguggagcagaaguaaaaaaaccaggagcaaguguaaaaguaaguuguagagcauuuggauauacauuuacagcacaugcauuacauuggguaagacaagcaccaggacaaggauuagaaugguuaggauggauaaauccacauaguggagauacaacaacaagucaaaaauuucaaggaagaguauauaugacaagagauaaaaguauaaauacagcauauuuagaaguaacaagauuaacaagugaugauacagcaauauuuuauugugcaagagauaaauauuauggagaugaagcaguaggaauggauguauggggacaaggaacaaguguaacaguaaguagu

SEQ ID NO: 47522 - RNA, 366 nt, Artificial Sequence
  derived and/or modified sequence opt6 from anti-HIV-1_HeavyChain
caagaaguauuaguacaaagcggagcagaaguaaaaaaaccaggagcaaguguaaaaguaaguuguagagcauuuggauauacauuuacaggaaaugcauuacauuggguaagacaagcaccaggacaagggcuagaaugguuaggauggauaaauccacauaguggagauacaacaacaagucaaaaauuucaaggaagaguauauaugacaagagauaaagcaauaaauacagcauauuuagauguaacaagauuaacaagugaugauacagcaauauauuauugugcaagagauaaauauuauggaaaugaagcaguaggaauggauguauggggacaaggaacaaguguaacaguaaguagu

SEQ ID NO: 47523 - RNA, 366 nt, Artificial Sequence
  derived and/or modified sequence opt6 from anti-HIV-1_HeavyChain
caagaaguauuaguacaaagcggagcagaaguaaaaaaaccaggagcaaguguaaaaguaaguuguagagcauuuggauauacauuuacaggaaaugcauuacauuggguaagacaagcaccaggacaaggauuagaaugguuaggauggauaaauccacauaguggagauacaacaacaagucaaaaauuucaaggaagaguauauaugacaagagauaaaaguauaaauacagcauuuuuagauguaacaagauuaacaagugaugauacaggaauauauuauugugcaagagauaaauauuauggaaaugaagcaguaggaauggauguauggggacaaggaacaaguguaacaguaaguagu

SEQ ID NO: 47524 - RNA, 303 nt, Artificial Sequence
  derived and/or modified sequence opt6 from anti-HIV_45_LightChain
ucacuaacacaaucaccaggaacacuaucacuaucaccaggagaaacagcaauaauaucaugcagaacaucacaauacggaucacuagcaugguaccaacaaagaccaggacaagcaccaagauuaguaauauacucaggaucaacaagagcagcaggaauaccagacagauucucaggaucaagauggggaccagacuacaaccuaacaauaucaaaccuagaaucaggagacuucggaguauacuacugccaacaauacgaauucuucggacaaggaacaaaaguacaaguagacauaaaa

SEQ ID NO: 47525 - RNA, 303 nt, Artificial Sequence
  derived and/or modified sequence opt6 from anti-HIV_45_LightChain
guacuaacacaaucaccaggaacacuaucacuaucaccaggagaaacagcaacaauaucaugcagaacaucacaauacggaucauuagcaugguaccaacaaagaccaggacaagcaccaagacuaguaauauacucaggaucaacaagagcagcaggaauaccagacagauucucaggaucaagaucaggaccagacuacacauuaacaauaucaaaccuagaaucaggagacuucggaguauacuacugccaacaauacgaauucuucggacaaggaacaaaaguacaacaagacaacaaa

SEQ ID NO: 47526 - RNA, 303 nt, Artificial Sequence
  derived and/or modified sequence opt6 from anti-HIV_45_LightChain
guacuaacacaaucaccaggaacacuaucacuaucaccaggagaaacagcaauaauaucaugcagaacaucacaauacggaucauuagcaugguaccaacaaagaccaggacaagcaccaagacuaguaauauacucaggaucaacaagagcagcaggaauaccagacagauucucaggaucaagauggggaccagacuacaaccuaacaauaucaaaccuagaaucaggagacuucggaguauacuacugccaacaauacgaauucuucggacaaggaacaaaaguacaaguagacauaaaa

SEQ ID NO: 47527 - RNA, 363 nt, Artificial Sequence
  derived and/or modified sequence opt6 from anti-HIV_45_HeavyChain
caaguaagauuaagucaaaguggaggacaaaugaaaaaaccaggagaaaguaugagaauaaguuguagagcaaguggauaugaauuuauagauuguacauuaaauuggauaagauuagcaccaggaagaagaccagaauggaugggaugguuaaaaccaagaggaggagcaguaaauuaugcaagaguauuucaaggaagaguaacaaugacaagagauguauauagugauacagcauuuuuagaauuaagaaguuuaacagcagaugauacagcaguauauuuuuguacaagaggaaaaacaguagauuauaauugggauuuugaacauguaggaccaggaacaccaguaacaguaaguagu

SEQ ID NO: 47528 - RNA, 363 nt, Artificial Sequence
  derived and/or modified sequence opt6 from anti-HIV_45_HeavyChain
caaguaagauuaagucaaaguggaggacaaaugaaaaaaccaggagaaaguaugagaauaaguugucaagcaaguggauaugaauuuauagauuguacauuaaauuggguaagauuagcaccaggaagaagaccagaauggaugggaugguuaaaaccaagaggaggagcaguaaauuaugcaagaauauuucaaggaagaguaacaaugacaagagauguauauagugacacagcauuuuuagaauuaagaaguuuaacagcagaugauacagcaguauauuuuuguacaagaggaaaaaauugugauuauaauugggauuuugaacauguaggaccaggauauccaguaacaguaagucca

SEQ ID NO: 47529 - RNA, 375 nt, Artificial Sequence
  derived and/or modified sequence opt6 from anti-HIV_45_HeavyChain
caaguaagauuaagucaaagcggaggacaaaugaaaaaaccaggagauaguaugagaauaaguuguagagcaaguggauaugaauuuauaaauuguccaauaaauuggauaagauuagcaccaggaaaaagaccagaauggaugggauggaugaaaccaagaggaggagcaguaaguuaugcaagacaauuacaaggaagaguaacaaugacaagagauauguauagugaaacagcauuuuuagaauuaagaagcuuaacaagugaugauacagcaguauauuuuuguacaagaggaaaauauuguacagcaagagauuauuauaauugggauuuugaacauuggggacaaggaacaccaguaacaguaaguagu

SEQ ID NO: 47530 - RNA, 435 nt, Artificial Sequence
  derived and/or modified sequence opt6 from anti-HIV_cap256-206-252885_VR-Chain
caagaacaauuaguagaaaguggaggaggaguaguaccaccaggaaguaguuuaacauuaaguuguguagcaaguagauuuacauuuagugcauuuggaaugcauuggguaagacaagcaccaggaaaaggauuagaauggguagcaggaguaaguuuuguaggaauaaaaaaauauuaugcagauaguguaaaaggaagguuuacaauaaguagagauaauaguaaaaauacauuauuuuuacaaaugaauggauuaagaggagaagauacaggauuauauuauuguguaaaagauaugagauauuuagaaugugaagaaugggcaagugauuauuaugauuuuggaaaaccaaaucaaccauguuuagauagaagaggaguaagugggauaagugcauuuuggggacaaggaacaacaguaacaguaaguagu

SEQ ID NO: 47531 - RNA, 438 nt, Artificial Sequence
  derived and/or modified sequence opt6 from anti-HIV_cap256-206-249183_VR-Chain
caaguauuauuaguagaaagcggagguggaguaguagaaccaggaacaagcuuaacacuaaguugugcagcaaguagauuuacauuuaguaauuuuggaaugcauuggguaagacaaacaccaggaggaggauuagaauggguagcaaguauaaguaaugaaggaaauaaaaaauaucaugcagaaaguguauggggaagauuuauaauaaguagagauaauaguaaaaauacaguauuuuuacauaugagcaguuuaagaccagaugauagugcauuauauuuuuguguaagagauagacaagaagaugauugugaaguaugguggagugauuaugaagcauuuggaagagaaauaccauguagacaauauagaggacaaggacuagcaggaauauuugauauauggggaagaggaacaaugguaacaguaaguagu

SEQ ID NO: 47532 - RNA, 438 nt, Artificial Sequence
  derived and/or modified sequence opt6 from anti-HIV_cap256-206-220956_VR-Chain
caaaugauguuaguagaaaguggaggagauguaguagaaccaggaagaaguuuaacauuaaguugugcaacaagucaauuuacauuuaguaauuauggaaugcauuggguaagacaagcaccaggaagaggacuagaauggguagcaaguauaaguaaugaaggaaauaaaaaauaucaugcagaaaguguauggggaagauuaauaauaaguagagauaauaguaaaaauacauuauuuuuacauaugaguaguuuaagagcagaugauagugcauuauauuuuuguguaagagauagacaagaagaugaaugugaagaaugguggaguaauuauuaugcauuuggaagaggaggaccauguagaaaauauagaggacaaggauuagcaggaauauuugauguauggggaagaggaacaaugguaacaguaagcagu

SEQ ID NO: 47533 - RNA, 432 nt, Artificial Sequence
  derived and/or modified sequence opt6 from anti-HIV_cap256-206-220629_VR-Chain
caagaacaauuaguagaaaguggaggaggaguaguaccaccaggaaaaaguuuaaaauuaaguuguguagcaaguagauuuaguuuuggagcauuuggaaugcauuggguaagacaagcaccaggaaaaggauuagaauggguagcaggaauaaguuuugcaggaauaaaaaaauauuauggagauaguguaaaaggaagauuuuauauaagcagagauaauagucaaaauacacuauuuuuagaaaugaauggauuaagaggagaugauacagcaagauauuauuguguaaaagauuuaagagaauuagaaugugaagaaugggcaagugauuauuaugauuuuggaaaaccacaaccauguuuagauaguagaggaguaaguggaauaagugcaauguggggaccaggaacaaugguaacaguaaguagu

SEQ ID NO: 47534 - RNA, 381 nt, Artificial Sequence
  derived and/or modified sequence opt6 from anti-HIV_cap256-206-200599_VR-Chain
caagaaaaauuaguagaaaguggaggaggagcaguacaaccaggaggaaguuuaagauuaagcuguguagcaaguggauuuacauuuaauggauuuggaaugcauuggguaagacaagcaccaggaaaaggauuagaauggguagcaacaauaaguuuuaguggaguauauauaaguagagaaaauaguaaaaauacauuauauuuacaaaugaauggauuaagaggagaagauacagcauuauauuauugugcaaaagauuuaagauauuuagaauguggagaauggaguacauauuauccacaaccauguuuagauacaagaggaguaaguggaauaagcaauguauggggaccaggaacaagaguaacaguaaguagu

SEQ ID NO: 47535 - RNA, 432 nt, Artificial Sequence
  derived and/or modified sequence opt6 from anti-HIV_cap256-206-186347_VR-Chain
caagaauuauuaguagaaaguggaggaggaguaguaccaccaggaaaaaguuuaacaauaaguuguguagcaaguagauuuacauuuagugcauuuggaaugcauuggguaagacaagcaccaggaaaaggauuacaauggguagcaaguauaaguuuugcaggaacaaaaaaauauuaugcagauuuuguaaaaggaagauuuacaauaagcagagauaauaguaaaaauacaauauuuuuacaaaugaauggauuaagaggagaagauacggcauuauaucauuguguaaaagauaugagacaauuagaaugugaagaauggacaagugauuauuaugauuuuggaagaccacaaccauguauagauagaagaggaguaaguggaauaagugcaauguggggaccaggaacaaugguaacaguaaguagu

SEQ ID NO: 47536 - RNA, 438 nt, Artificial Sequence
  derived and/or modified sequence opt6 from anti-HIV_cap256-206-186226_VR-Chain
caaauguuauuaguagaaaguggaggaggaguaguagaaccaggaagaaguuuaacauuaaguugugcaacaagucaauuuacauuuaguaauuauggaaugcauuggguaagacaaacaccaggaacaggauuagaauggguagcaaguauaaguaaugaaggaaauaaaaaauaucauggagaagcaguauggggaagauuuauaauaaguagagauaauaguaaaaaaacauuauuuuuacauaugaguaauuuaagagcagaugauaguggauuauauuuuuguguaagagauagacaagaagaugaaugugaagaaugguggagugauuauuauaguuuuggaagaggaggaccauguagaaaauaucauggacaaggacuagcaggaauauuugauauauggggaagaggaacauuaguaacaguaaguagu

SEQ ID NO: 47537 - RNA, 435 nt, Artificial Sequence
  derived and/or modified sequence opt6 from anti-HIV_cap256-206-179686_VR-Chain
caagaacaauuaguagaaaguggaggaggaguaguaccaccauggaaaaguuuaacacuaaguugugaagcaaguagauuuacauuuagugcauuuggaaugcauuggguaagacaagcaccaggaaaaggauuagaauggguagcaggaauaaguuuugcaggaauaaaaaaauauuaugcagauaguguaaaaggaagauuuuuuauaagcagagauaauaguaaaaauagaguauuauuagaaaugaauggauuaagaagagaagauacagcaagauauuuuuguguaaaagauuuaagagaauuagaaugugaagaaugggcaagugauuauuaugauuuuggaaaaccaaaucaaccauguuuagauagaagagggguaaguggaauaagugcaauguggggacaaggaacaaugguaacaguaaguagu

SEQ ID NO: 47538 - RNA, 417 nt, Artificial Sequence
  derived and/or modified sequence opt6 from anti-HIV_cap256-206-173707_VR-Chain
caagaaaaauuaguagaaaguggaggaggagcaguacaaccaggaggaaguuuaagauuaaguuguguagcaaguggauuuacauuuaaaggauuuggaaugcauuggguaagacaagcaccaggaaaaggacuagaauggguggcaacaauaaguuuuaguggaguaaaaaaauauuauggaaauagugcaaaaggaagauuuuuuauaaguagagauaauuuaaaaaauacaguauauuuagaaaugaauggauuaagaggagaagauacagcauuauauuauugugcaaaagauuuaagauauuuagaauguggagaauggaguacauauuauccacaaccauguuuagauacaagaggaguaaguggaauaaguaauguguggggaccaggaacaaaaguaacaguaaguagu

SEQ ID NO: 47539 - RNA, 432 nt, Artificial Sequence
  derived and/or modified sequence opt6 from anti-HIV_cap256-206-173339_VR-Chain
caagaacuauuaguagaaaguggaggaggaguaguaccaccaggaaaaaguuuaaaacuaaguuguguagcaaguagauuuacauuuggagcauuuggaaugcauuggguaagacaagcaccaggaaaaggauuagaauggguagcaggaauaucauuugcaggaacaaaaaauuauuaugcagauaguguaaaaggaagauuuacaauaaguagagauaauccaaaaaauacauuauuucuacaaaugaauggauuaagaggagaugauacaggauuauauuauuguguaaaagauaugagagaauuagaaugugaauuauggacaucagauuauuaugauuuuggaagaccacaaccauguauagaucaaagaggaguaaguggaauaagugcaauguggggacaaggaacaaugguaacaauaaguagu

SEQ ID NO: 47540 - RNA, 438 nt, Artificial Sequence
  derived and/or modified sequence opt6 from anti-HIV_cap256-206-172689_VR-Chain
caaaugauguuaguagaaaguggaggaggaguaguagaaccaggaagaaguuugacauuaaguugugcaacaagucauuuuacauuuaguaauuauggaaugcauuggguaagacaagcaccaggaggaagauuagaauggguagcaaguauaaguaaugcaggaaauaaaaaauaucauggagauaguguauggggaagauuaauaauaagcagagauaauaguaaaaauacauuauuuuuacauaugaguaguuuaagaguagaugauagugcauuauauuuuuguguaagggauagacaagaagaugaaugugaagaaugguggagugauuauuaugcauuuggaagaggaggaccauguagaaaauauagagggcaaggauuagcaggaauauuugauauauggggaagaggaacaaugguaacaguaaguagu

SEQ ID NO: 47541 - RNA, 432 nt, Artificial Sequence
  derived and/or modified sequence opt6 from anti-HIV_cap256-206-162744_VR-Chain
caagaaaaauuaguagaaaguggaggaggaguaguaccaccaggaaaaaguuuaagauuaaguuguguagcaaguggauuuacauuuagugcauuuggaaugcauuggguaagacaagcaccaggaaaaggauuagaauggguagcaggaauaaguuuugcaggaauaaaaaauuauuaugcagauaguguaaaagggagauuuacaauaaguagagauaauagcaaaaauagucuauuuuuacaaaugaauggacuaagaggagaugauacagcaagauauuauuguguaaaagauaugagagaauuagaaugugaagaauggacaagugauuauuacgauuuuggaaaaccacaaccauguauagauagaagaggaguaaguggaauaagcgcaauguggggacaaggaacaaugguaacaauaaguagu

SEQ ID NO: 47542 - RNA, 438 nt, Artificial Sequence
  derived and/or modified sequence opt6 from anti-HIV_cap256-206-146057_VR-Chain
caaaugcaauuaguagaaagcggaggaggaguaguacaaccaggaacaaguuuaacauuaaguuguguagcaagucaauuuacauuuucaaauuauggaaugcauuggauaagacaagcaccaggacaaggauuagaauggguagcaucaauaucaaaugauggaggaaaaagauaucauggagaugcaguaugggcaagauuuauaauaagcagagauaauaguaaaaauacaguauuuuuacaaaugacaaguuuaagagcagaagauacagcgagauauuuuuguguaagagauagacaagaagaugaauguuuagaaugguggucagauuauuauaauuuuggaagacaacuaccaugugcaaaauuuagaggauuaggauuagcaggaguauuugauauauggggacauggaacaaugguaacaguaaguuca

SEQ ID NO: 47543 - RNA, 435 nt, Artificial Sequence
  derived and/or modified sequence opt6 from anti-HIV_cap256-206-139519_VR-Chain
caagaacaauuaguagaaaguggaggaggagugguaccaccaggaacaaguuuaagauuaaguuguguagcaaguagauuuaguuuuggaaguuuuggaaugcauuggguaagacaagcaccaggaaaaggacuagaauggguagcaggaauaaguuuuguaggaauaaaaaaauauuauggagauaguguaaaaggaagauuuuuuauaagcagagauaauaguaaaaauacauuauuuuuagaaaugaauggauuaagaggagaagauacggcaagauauuauuguguuaaagauaugagagaauuagaaugugaagaaugggcaagugauuauuaugauuuuggaaaaccaaaucaaccauguuuagauagaagaggaguaaguggaauaagugcaauguggggaccaggaacaauguuaacaguaaguagu

SEQ ID NO: 47544 - RNA, 432 nt, Artificial Sequence
  derived and/or modified sequence opt6 from anti-HIV_cap256-206-136316_VR-Chain
caagaacaauuaguagaaaguggaggaggaguaguaccaccaggaaaaaguuuaacauuaaguuguguagcaaguggauuuacauuuagugcauuuggaaugcauuggguaagacaagcaccaggaaaaggauuagaauggguagcaggaauaaguuuuguaggaauaaaaaaauauuauggagauaguguaaaaggaagauuuacaauaaguagagauaauaguaaaaauacauuauuuuuacaaaugaauggauuaagaggagaugauacagcauuauaucauuguguaaaagauaugagacaauuagaaugugaagaauggacaagugauuauuaugauuuuggaaaaccacaaccauguauagauccaagaggaguaaguggaauaagugcaauguggggacaaggaacaaugguaacaguaaguagu

SEQ ID NO: 47545 - RNA, 438 nt, Artificial Sequence
  derived and/or modified sequence opt6 from anti-HIV_cap256-206-116098_VR-Chain
caaaugauguuaguagaaaguggaggaggaguaguagaaccaggaaggaguuuaacauuaaguugugcagcaagccaauuuacauuuaguaauuaugguaugcauuggguaagacaagcaccaggaagagaacuagaauggguagcaaguauaaguaaugcaggaaauaaaaaauaucauggagaagcaguauggggaagauuaauaauaaguagagauaauaguaaaaauacauuauuuuuacauaugaguaauuuaagaccagaugauagugcauuauauuuuuguguaagagauagacaagaagaugaaugugaagaaugguggagugauuauuaugcauuuggaagaggaggaccauguagaaaauaucauggacaaggauuagcaggaauauuugauauauggggaagaggaacgauggugacagugaguagu

SEQ ID NO: 47546 - RNA, 432 nt, Artificial Sequence
  derived and/or modified sequence opt6 from anti-HIV_cap256-206-115862_VR-Chain
caagaacaauuaguagaaagcggaggaggaguaguaccaccaggaaaaaguuuaagauuaaguuguguaggaaguagauuuacauuuagugcauuuggaaugcauuggguaagacaagcaccgggaaaaggauuagaauggguagcaagcauaaguuuugcaggaacaaaaaaauauuauguagauagugugaaaggaagauuuuuuauaaguagagauaauaguaaaaauacaguauuuuuagaaaugaauggauuaagaggagaagauacaggacuauauuauuguguaaaagauaugagagaauuagaaugugaagaaugggcaagugauuauuaugauuuuggaaaaccacaaccauguuuagauagaagaggaguaaguggaauaagugcaauguggggacaaggaacacuaguaauaauaaguagu

SEQ ID NO: 47547 - RNA, 435 nt, Artificial Sequence
  derived and/or modified sequence opt6 from anti-HIV_cap256-206-107018_VR-Chain
caagaacaauuaguagaaaguggaggaggaguaguaccaccaggaaaaaguuuaacauuaaguuguguagcaaguagauuuaguuuuagugcauuuggaaugcauuggguaagacaagcaccgggaaaaggauuagaauggguagcaaguauaaguuuuguaggaauaaaaaaauauuauggagauaguguaaaaggaagauuuuuuauaaguagagauaauaguaaaaauacaguauuuuuagaaaugaauggauuaaggggagaagauacaggauuauauuauuguguaaaagauaugagagaauuagaaugugaagaaugggcaagugauuauuaugauuuuggaaaaccaaaucaaccauguuuagauagaagaggaguaaguggaauaagugcaauguggggacaaggaacauuaguaauaguaaguagu

SEQ ID NO: 47548 - RNA, 438 nt, Artificial Sequence
  derived and/or modified sequence opt6 from anti-HIV_cap256-206-098644_VR-Chain
caaauguuauuaguagaaagcggaggaggaguaguagaaccaggaagaaguuuaacauuaaguugugcagcaagucaauuuacauuuaguaauuauggaaugcauuggguaagacaagcaccaggaggaggguuagaauggguagcaaguauaaguaaugaaggaaauaaaagauaucauggagaaaguguauggggaagauuuguaauaaguagagauaauaguaaaaauacauuauuuuuacauaugaguacauuaagaccagaugauagugcauuauauuuuuguguaagagauagacaagaagaugaaugugaagaaugguggagugauuauuaugcauuuggaagaggaggaccauguaggaaauaucauggacaaggauuagcaggaauauuugauguauggggaagaggaacaaugguaacaggauuauuu

SEQ ID NO: 47549 - RNA, 417 nt, Artificial Sequence
  derived and/or modified sequence opt6 from anti-HIV_cap256-206-098135_VR-Chain
caagaaaaauuaguagaaagcggaggaggagcaguacaaccaggaggaaguuugagauuaaguuguguagcaagcggauucacauuuaguggauuuggaaugcacuggguaagacaagcaccaggaaaaggauuagaauggguagcaacaauaucauucucaggaaugaaaaaauauuauggaacaagcgcaaaaggaagauuuaguauauacagagacaauaguaaaaacacauuauauuuacaaauggauggauuaagagaaaaagauacagcauuauauuacugugcaaaagacuuaagauauuuagaaugcggagaauggaguacauauuauccacaaccaugucuagauagaagaggaguaaguggaauaucaaauguauggggaccaggaacaaugguaacaguaaguagc

SEQ ID NO: 47550 - RNA, 435 nt, Artificial Sequence
  derived and/or modified sequence opt6 from anti-HIV_cap256-206-096276_VR-Chain
caagaacaauuaguagaaaguggaggaggaguaguaccaccaggaaguaguuuaagauuaaguuguguagcaaguagauuuacauuuagugcauuuggaaugcauuggguaagacaagcgccaggaaaaggauuagaauggguagcaggaauaaguuuuguaggaauaaaaaaauauuaugcagauaguguaaaaggaagauuuacaauaaguagagauaauaguaaaaauacauuauuuuuacaaaugaauggauuaagaggagaagauacgggauuauauuauuguguaaaagauaugagagaauuagaaugugaagaauggagaucagauuauuaugauuuuggaaaaccaaaucaaccauauuuagauagaagaggaguaaguggaauaagugcauuuuggggacaaggaacaaugguaacaguaaguagu

SEQ ID NO: 47551 - RNA, 438 nt, Artificial Sequence
  derived and/or modified sequence opt6 from anti-HIV_cap256-206-092794_VR-Chain
caaaugauguuaguagaaaguggaggaggaguaguagaaccaggaagaaguuuaacauuaaguugugcaacaagucaauuuacauuuaguaauuauggaaugcauuggguaagacaagcaccaggaagaggauuagaauggguagcaaguauaucaaaugaaggaaauaaaagguaucauggagaaaguguauggggaagauuuauaauaaguagagauaauaguaaaaauacauuauuuuuacauaugaguacauuaagagcagaugauagcgcauuauauuuuuguguaagagauagacaagaagaugaaugugaagaaugguggucagauuauuaugcauuuggaagaggaggaccauguagaaaauaucauggacaaggauuagcaggaauauuugauauaguaggaagaggaacauuaguaacaguaagcagu

SEQ ID NO: 47552 - RNA, 432 nt, Artificial Sequence
  derived and/or modified sequence opt6 from anti-HIV_cap256-206-086817_VR-Chain
caagaacaauuaguagaaaguggaggaggaguaguaccaccaggaaaaaguuuaagauuaaguugugcagcaaguggauuuaguuuuggagcauuuggaaugcauuggguaagacaagcaccaggaaaaggauuagaauggguagcaggaauaaguuuuguaggaauaaaauauuauuaugcagauaguguaaaaggaagauuuacaauaaguagagauaauaguaaaaauacaguauuuuuacaaaugaauggauugagaggagaugauacaggaagauauuauuguguaaaagauaugagagaauuagaaugugaagaauggacaagugauuauuaugauuuuggaaaaccacaaccauguauagauagaagaggaguaaguggaauaagugcaauguggggacaaggaacaaugguaacaauaaguagu

SEQ ID NO: 47553 - RNA, 432 nt, Artificial Sequence
  derived and/or modified sequence opt6 from anti-HIV_cap256-206-086446_VR-Chain
caagaacaauuaguagaaaguggaggaggaguaguaccaccaggaaaaagcuuaagauuaaguuguguagcaaguagauuuacauucucagcauuuggaaugcauuggguaagacaagcaccaggaaaaggauuagaauggguagcaggaauaaguuuuguaggaauaaaaaaauauuauagugaugcaguaaaaggaagauuuuauauaaguagagauaauaguaaaaauacauuauuuuuagaaaugaauggauuaagaggagaugauacagcaagauauuauuguguaaaagauuuaagagaauuagaaugugaagaaugggcaagugauuauuaugauuuuggaaaaccacaaccauguuuagauaguagaggaguaaguggaauaagugcaauguggggacaaggaacaaugguaacaguaaguagu

SEQ ID NO: 47554 - RNA, 432 nt, Artificial Sequence
  derived and/or modified sequence opt6 from anti-HIV_cap256-206-086180_VR-Chain
caagaacaauuagaagaaaguggaggaggaguaguaccaccaggaaaaaguuuaagauuaaguuguguagcaaguagauuuacauuuagugcauuugguaugcauuggguaagacaagcaccaggaaaaggauuagaauggguagcaggaauaaguuuuguaggaauaaaaaaauauuaugcagauagcguaaaaggaagauuuacaauaagcagagauaauaguaaaaauacacuauuuuuacaaaugaauggauuaagaggagaugauacaggauuauauuuuuguguaaaagauaugagagaauuagaaugugaacaauggacaucagauuauuaugauuuuggaaaaccacaaccauguauagauccaagaggaguaucaggaauaagugcaauguggggacaaggaacaaugguaacaguaaguuca

SEQ ID NO: 47555 - RNA, 435 nt, Artificial Sequence
  derived and/or modified sequence opt6 from anti-HIV_cap256-206-083708_VR-Chain
caagaacaauuaguagaaaguggaggaggaguaauaccaccaggacaaaguuuaagauuaaguuguguagcaaguagauuuacauuuagugcauuuggaaugcauuggguaagacaagcaccaggaaaaggauuagaauggguaaguaguguaaguuuugcaggaauaaaaaaauauuaugcagauaguguaaaaggaagauuuuuuauaaguagagauaauaguaaaaacacaguauuuuuagaaaugaauggauuaagaggagaagauacaggauuauacuauuguguaaaagauaugagagaauuagaaugugaagaaugggcaagugauuauuaugauuuuggaaaaccagaucaaccauguuuagauagaagaggaguaagcggaauaagugcaauguggggacaaggaacauuaguaauaguaaguagu

SEQ ID NO: 47556 - RNA, 432 nt, Artificial Sequence
  derived and/or modified sequence opt6 from anti-HIV_cap256-206-079556_VR-Chain
caagaacaauuaguagaaaguggaggaggaguaguaccaccaggaaaaaguuuaagauuaaguuguguagcaaguggguuuacauuuaguggauuuggaaugcauuggguaaggcaagcaccaggaaaaggacuagaauggguagcaggaauaucauuuguaggaauaaaauauuauuaugcagauagcguaaaaggaagauuuagcauaaguagagauaauaguaaaaauacauuauuucuacaaaugaauggauuaagaggagaugauacagcguuauauuauuguguaaaagauaugagagaauuagaaugugaagaauggacaucagauuauuaugauuuuggaaaaccacaaccauguauagauagaaggggaguaucaggaauaagugcgauguggggacaaggaacaaugguaacgguaaguagu

SEQ ID NO: 47557 - RNA, 438 nt, Artificial Sequence
  derived and/or modified sequence opt6 from anti-HIV_cap256-206-078657_VR-Chain
caaauguuauuaguagaaaguggaggaggaguaguagaaccaggaagaaguuuaacauuaaguugugcaacaagucaauuuacauuuaguaauuauggaaugcauuggguaagacaagcaccaggaagaggauuagaauggguggcaaguauaaguaaugaaggaaguaaaaaauaucauggagaaccaguauggggaagauuuauaauaaguagagauaauaguaaaaaaacauuauuuuuacauaugaguaaucuaagaguagaugauagugcauuauauuuuuguguaagagauagacaagaagaugaaugugaagaaugguggagugauuauuaugcauuuggaagaggaggaccauguagaaaauaucauggacaaggauuagcaggaauauuugauauauggggaagaggaacaaugguaacaguaaguagu

SEQ ID NO: 47558 - RNA, 438 nt, Artificial Sequence
  derived and/or modified sequence opt6 from anti-HIV_cap256-206-075802_VR-Chain
caaauguuauuaguagaaaguggaggagauguaguagaaccaggaaaaaguuuaacauuaaguugugcaacaaguagauuuacauuuaguaauuauggaaugcauuggguaagacaagcaccaggaggaggguuagaauggguagcaucaauaucaaaugaaggaaauaaaaaauaucauggagaaaguguauggggaagauuuauaauaaguagagauaauaguaaaaauacauuauuuuuacauaugagugcauuaagaacagaugauagugcauuauauuuuuguguaagagauagacaagaagaugaaugugaagaaugguggagugauuauuaugcauuuggaagaggaggaccauguagaaaauaucaugggcaaggauuagcaggaauauuugauauauggggaagaggaacaaugguaacaguaaguagu

SEQ ID NO: 47559 - RNA, 438 nt, Artificial Sequence
  derived and/or modified sequence opt6 from anti-HIV_cap256-206-069097_VR-Chain
caaauguuauuaguagaaaguggaggaggaguaguagaaccaggaaggaguuuaacauuaaguugugcaacaaguagauuuacauuuaguaauuauggaaugcauuggguaagacaagcaccaggaagagaauuagaauggguagcaaguauaaguaaugaaggaaauaaaaaauaucaugcagaaaguguauggggaagauuuauaauaaguagagauaauaguaaaaauacacuauuuuuacauaugaguaauguaagaggagaugauagugcauuauauuuuuguguaagagauaggcaagaagaugaaugugaagaaugguggagugauuauuaugcauuuggaagaggaggaccauguagaaaauaucauggacaaggauuagcaggaauauuugauguauggggaagaggaacaguaguaacaguaaguagu

SEQ ID NO: 47560 - RNA, 438 nt, Artificial Sequence
  derived and/or modified sequence opt6 from anti-HIV_cap256-206-067758_VR-Chain
caaauguuauuaguagaaaguggaggaggaguaguagaaccaggaagaaguuuaacauuaaguugugcagcaagucaauuuacauuuucacauuauggaaugcauuggguaaggcaagcaccagggagaggauuagaauggguagcaucaauaaguaaugaaggaaauaaaagauaucauggagaaaguguauggggaagauuuauaauaaguagagauaauagcaaaaauacauuauuuuuacauaugagugcauuaagaacagaugauagugcauuauauuuuuguguaagagauagacaagaagaugagugugaagaaugguggagcgauuauuaugcauuuggaagaggaggaccauguagaaaauggcaugggcaaggguuagcaggaauauuugacauauggggaagaggaacaguaguaacaguaaguagu

SEQ ID NO: 47561 - RNA, 417 nt, Artificial Sequence
  derived and/or modified sequence opt6 from anti-HIV_cap256-206-057019_VR-Chain
caagaaaaauuaguagaaaguggaggaggagcaguacaaccaggaggaaguuuaagauuaaguuguguagcaaguggauuuaguuuuaguggauauggaaugcauuggguaagacaagcaccaggaaaaggauuagaaugguuagcaacaauaaguuuuaguggaguaaaaaaauauuauggaacaagugcaaaaggaagauuuuauauauauagagauaauacaaaaaauacaauguauuuagaaaugaauggauuaagaggagaagauacagcacuauauuauugugcaaaagauuuaagauauuuagaauguggagaauggaguacauauuauccacaaccauguuuagauacaagaggaguaaguggaauaaguaauguauggggaccaggaacaaugguaacaguaaguagu

SEQ ID NO: 47562 - RNA, 438 nt, Artificial Sequence
  derived and/or modified sequence opt6 from anti-HIV_cap256-206-055385_VR-Chain
caaaugauguuaguagaaagugggggagggguaguagaaccaggaagaaguuuaacauugaguugugcagcaaguaaauuuacauuuaguaauuauggaaugcauuggguaagacaagcaccaggaagaggauuagaauggguagcaaguauaaguaaugaaggaaauaaaaaauaucauggagaaccaguauggggaagauuaauaauaaguagagauaauaguaaaaauacauuauuuuuacauaugagugauuuaagagcagaugauagugcauuauauuuuuguguaagagauagacaagaagaugaaugugaagaaugguggaguaauuauuaugcauuuggaagaggaggaccauguagaaaauggagaggacaaggauuagcaggaauauuugauguauggggaagaggaacaaugguaacaguaaguagu

SEQ ID NO: 47563 - RNA, 435 nt, Artificial Sequence
  derived and/or modified sequence opt6 from anti-HIV_cap256-206-053187_VR-Chain
caagaacaauuaguagaaaguggaggaggaguaguaccgccaggaaguaguuuaagauuaaguuguguagcaaguagauuuacauuuagcgcauuuggaaugcauuggguaagacaagcaccaggaaaaggauuagaauggguagcaggaauaaguuuuguaggaauaaaauauuauuaugcagauagcguaaaaggaagauuuacaauaaguagagauaauaguaaaaauacauuauuucuacaaaugaauggauuaagaggagaagauacaggauuauauuauuguguaaaagauaugagagaauuagaaugugaagaaugggcaagugauuauuaugauuuuggaaaaccaaaucaaccauguuuagauagaagaggaguaaguggaauaagugcauuuuggggacaaggaacaaugguaacaguaaguagu

SEQ ID NO: 47564 - RNA, 438 nt, Artificial Sequence
  derived and/or modified sequence opt6 from anti-HIV_cap256-206-053139_VR-Chain
caaauguuauuaguagaaaguggaggagauguaguagaaccaggaagaaguuuaacauuaaguugugcaacaagucaauuuacauuuaguaauuauggaaugcauuggguaagacaagcaccagggagaggauuagaauggguagcaaguauaaguaaugaaggaaguaaaaaauaucauggagaaaguguauggggaagauuuauaauaaguagagauaauaguaaaaauacauuauuuuuacauaugacgacauuaagaccagaugauagugcauuauauuuuuguguaagagauaggcaagaagaugaaugugaagaaugguggagugauuauuaugcauuuggaagaggaggaccauguagaaaauaucauggacaaggauuagcaggaauauuugauauauggggaagaggaacaaugguaacaguaaguagu

SEQ ID NO: 47565 - RNA, 432 nt, Artificial Sequence
  derived and/or modified sequence opt6 from anti-HIV_cap256-206-050350_VR-Chain
caagaacaacuaguagaaaguggaggaggaguaguaccaccaggaaaaagcuuaaaacuaaguuguguagcaaguagauuuaguuuuggagcauuuggaaugcauuggguaagacaagcaccaggaaaaggauuagaauggguagcaggaauaaguuuuguaggaauaaaaaaauauuaugcagauagcguaaaagggagauuuuauauaagcagagauaauaguaaaaauacaguauuucuagaaaugaaugcauuaagaggagaagauacagcauuauaucauuguguaaaagauaugagagaauuagaaugugaagaaugggcaagugauuauuaugauuuuggaaaaccacaaccauguuuagauagaagaggaguaaguggaauaagugcaauguggggaccaggaacaaugguaauaguaaguuca

SEQ ID NO: 47566 - RNA, 432 nt, Artificial Sequence
  derived and/or modified sequence opt6 from anti-HIV_cap256-206-046207_VR-Chain
caagaacaauuaguagaaaguggaggaggaguaguaccaccaggaacaaguuuaagauuaaguuguguagcgaguagauuuacauuuagugcauuuggaaugcauuggguaagacaagcaccaggaaaaggauuagaauggguagcaggaauaaguuuugcaggaauaaaaaaauauuaugcagauaguguaaaaggaagauuuacaauaaguagagauaauaguaaaaauaguuuauuuuuagaaaugaauggauuaagaggagaugauacagcauuauauuauuguguaaaagauuuaagauauuuagaaugugaacuauggacaagugauuauuaugauuuuggaagaccacaaccauguauagauaguagaggaguaucaggaauaagugcaauguggggaccgggaacaaugguaacaguaagugca

SEQ ID NO: 47567 - RNA, 417 nt, Artificial Sequence
  derived and/or modified sequence opt6 from anti-HIV_cap256-206-043389_VR-Chain
caagaaaaauuaguagaaagcggaggaggagcaguacaaccaggaggaagcuuaagauuaagcuguguagcaaguggauucacauucucaggauuuggaaugcacugguucagacaagcaccaggaaaaggacuagaauggguagcaacaauaucauucucaggaauaaaaaaauacuauaacacaagcgcaaaaggaagauuuuucauaagcagagacaauacaaaagacacauuauaucuacaaauggauggauuacaagaaaaagauacagcacuauaucuaugugcaaaagacuuaagauaucuagaaugcggauacuggagcacauacuauccacaaccaugucuagauacaagaggaguaagcggaauaucaaacguauggggaccaggaacaaugguaacaguaucgagu

SEQ ID NO: 47568 - RNA, 432 nt, Artificial Sequence
  derived and/or modified sequence opt6 from anti-HIV_cap256-206-042555_VR-Chain
caagaacaauuaguagaaaguggaggaggaguaguaccaccaggaaaaaguuuaagauuaaguuguguaguaaguggauuuacauuuagugcauuuggaaugcauuggguaagacaagcaccaggaaaaggauuagaauggguagcaggaauaaguuuugcaggaacaaaaaguuauuaugcagaaaguguaaaaggaagauuuacaauaucaagagauaauaguaaaaauaguuuauuuuuacaaaugaauggauuaagaggagacgauacagcacuauauuauuguguaaaagauaugagagaauuagaaugugaauuauggacaucagauuauuaugauuuuggaagaccacaaccauguauagauagaagaggaguaaguggaauaagugcaauguggggacaaggaacaaugguaacaauaaguagu

SEQ ID NO: 47569 - RNA, 432 nt, Artificial Sequence
  derived and/or modified sequence opt6 from anti-HIV_cap256-206-029720_VR-Chain
caagaaaaauugguagaaaguggaggaggaguaguacaaccaggaagaaguuuaacauuaagcuguguagcaagucauuuuacauuuaguggaguaggaaugcauuggguaagacaagcaccaggaaaaggauuagaauggguagcaggaauaaguuuugcgggaacaagaaaauauuaugcagauagcguaaaaggaagauuuacaauaaguagagauaauaguaaaaauacaguauauuuacaaaugaauggauuaagaggagaagauacagcauuauaucauugugcaaaagauuuaagagaauuagaaugugaacuauggacaagugauuauuaugauuuuggaagaccacaaccauguauagauagaagaggaguaucagggauaugugauauguggggacaaggaacaaugguaauaguaaguagu

SEQ ID NO: 47570 - RNA, 432 nt, Artificial Sequence
  derived and/or modified sequence opt6 from anti-HIV_cap256-206-028848_VR-Chain
caagaacaauuaguagaaaguggaggaggaguaguaccaccaggaaaaaguuuaagauuaaguuguguagcaaguggauuuacauuuaguggauuuggaaugcauuggguaagacaagcaccaggaaaaggauuacaauggguagcaggaauaucguucgcaggaacaaaauauuauuaugaagauaguguaaaaggaagauuuacaauaaguagagauaauaguaaaaauacaguauuuuuacaaaugaauggauuaagaggagaugauacagcauuauauuauuguguaaaagauaugagagaauuagaaugugaagaauggacaagugauuauuaugauuuuggaaaaccacaaccauguauagauagaagaggaguaaguggaauaagugcaauguggggacaaggaacaaugguaacaauaaguuca

SEQ ID NO: 47571 - RNA, 432 nt, Artificial Sequence
  derived and/or modified sequence opt6 from anti-HIV_cap256-206-027652_VR-Chain
caagaacaauuaguaguaaguggaggagauguaguaccaccaggaaaaaguuugagauuaaguuguguagcaaguggauuuacauuuagugcauuuggaaugcauuggguaagacaagcaccaggaaaaggauuagaauggguagcaaguauaaguuuugcaggaacaaaauauuauuaugcagauaguguaaaaggaagauuugcaauaaguagagauaauaguaaaaauacauuauuuuuacaaaugaauggauuaagaagagaagauacaggauuauauuauuguguaaaagauaugagacaauuagaaugugaagaauggacaagugauuauuaugauuuuggaagaccacaaccauguauagauagaagaggaguaaguggaauaagugcaauguggggacaaggaacaaugguaacaauaaguuca

SEQ ID NO: 47572 - RNA, 417 nt, Artificial Sequence
  derived and/or modified sequence opt6 from anti-HIV_cap256-206-024075_VR-Chain
caagaaaaauuaguagaaaguggaggaggagcaguacaaccaggaggaaguuuaagauuaagcuguguagcaaguggauuuacauuuaguggauuuggaaugcauuggguaagacaagcaccaggaaaaggauuagaaugguuagcaacaauaaguuuuaguggaguaaaaaaauauuauggaacaagugcaaaaggaagauuuuauauaaguagagauaauacaaaaaauacaguauauuuacaaauggauggauuaagaggagacgauacagcaauauauuauugugcaaaagauuuaagauuuuuagaauguggacuauggaguacauauuauccacaaccauguuuagauacaagaggaguaaguggaauaaguaauguauggggaccaggaacaaugguaacaguaaguagu

SEQ ID NO: 47573 - RNA, 417 nt, Artificial Sequence
  derived and/or modified sequence opt6 from anti-HIV_cap256-206-008748_VR-Chain
caagaaaaauuaguagaaaguggaggaggagcaguacaaccaggaggaaguuuaagauuaagcuguguagcaaguggauuuacauuuaauggauuuggaaugcauuggguaagacaagcaccaggaaaaggauuagaauggguagcaacaauaaguuuuaguggagugaaaaaauauuauggaacaagugcaaaaggaagauuuuuuauaaguagagaaaauaguaaaaauacauuauauuuacaaaugaauggauuaagaggagaagacacagcauuauauuauugugcaaaagauuuaagauauuuagaauguggagaauggaguacauauuauccacaaccauguuuagauacaagaggaguaaguggaauaaguaauguauggggaccaggaacaagaguaacaguaaguagu

SEQ ID NO: 47574 - RNA, 432 nt, Artificial Sequence
  derived and/or modified sequence opt6 from anti-HIV_cap256-206-008530_VR-Chain
caagaacaauuaguagaaaguggaggaggaguaguaccaccaggaaaaaguuuaagauuaaguuguguagcaaguggauuuaguuuuggagcauuuggaaugcauuggguaagacaagcaccaggaaaaggauuagaauggguagcaggaauaaguuuugugggaauaaaauauuauuaugcagauaguguaaaaggaagauuuacaauaaguagagauaauaguaaaaaaacauuauuuuuacaaaugaauggauuaagaggagaugauacagcauuauauuauuguguaaaagauaugagagaauuagaaugugaagaauggacaagugauuauuaugauuuuggaaaaccacaaccauguauagauagaagaggaguaaguggaauaagcgcauuuuggggacaaggaacaaugguaacaauaaguagu

SEQ ID NO: 47575 - RNA, 432 nt, Artificial Sequence
  derived and/or modified sequence opt6 from anti-HIV_cap256-176-723043_VR-Chain
caagaacaauuaguagaaaguggaggaggaguaguaccaccaggaaaaaguuuaagauuaaguuguguagcaaguggguuuacauuuagugcauuuggaaugcauuggguaagacaagcaccaggaaaaggauuagaauggguagcaggaguaaguuuugcaggaauaaaauauuauuaugcagauaguguaaaaggaagauuuacaauaaguagagauaauaguaaaaauacauuauuuuuacaaaugaauggauuaagaggagaugauacagcauuauauuauuguguaaaagauuuaagggaauuagaaugugaagaauggacaagcgauuauuaugauuuuggaagaccacaaccauguauagauccaagaggaguaaguggaauaagugcaauguggggacaaggaacaguaguaacaauaaguuca

SEQ ID NO: 47576 - RNA, 432 nt, Artificial Sequence
  derived and/or modified sequence opt6 from anti-HIV_cap256-176-600049_VR-Chain
gaaguacaauuaguacaaaguggaggaggaguaguacaaccaggaagaagucuaagauuaaguugugcagcaccauauuuugaauuuggaagauauggauuucauuggguaagacaagcaccaggaaaaggauuagaauggguagcaaguauaaguuuugcaggaagaggauauuaucauucaccaagcguauggggaagauuuacaauaaguagagauaauaguaaaaauacauuauaucuacaaaugaauagucuaagaauagaagauacagcauuauauuuuugugcaagagauuuaagagaaagugaaugugaagaaugggaaagugauuauuaugauuuuggaaaaaaaggaccauguguaaaaccaagaggaguagcaggaggauuagauuuauggggacaaggaacaaugguaauaguaaguagu

SEQ ID NO: 47577 - RNA, 432 nt, Artificial Sequence
  derived and/or modified sequence opt6 from anti-HIV_cap256-176-531926_VR-Chain
caaguacaauuaguagaaagcggaggaggaguaguaccaccaggaaaaaguuuaacauuaaguuguguagcaaguagauuuacauuuagugcauuuggaaugcauuggguaagacaagcaccaggaaaaggauuggaauggguagcaggaauaaguuuuguaggaauaagaaaauauuaugcagauaguguaaaaggaagauuuaguauaaguagagauaauaguaaaaauacaguauuuuuagaaaugaauggauuaagaggagaagauacaggauuauauuauuguguaaaagauaugagagaauuagaaugugaagaaugggcaagugauuauuaugauuuuggaaaaccacaaccauguuuagauagaagaggaguaaguggaauaagugcaauguggggacaaggaacauuaguaauaauaaguagu

SEQ ID NO: 47578 - RNA, 432 nt, Artificial Sequence
  derived and/or modified sequence opt6 from anti-HIV_cap256-176-504134_VR-Chain
gaaguacaauuaguagaaaguggaggaggaguagugccaccaggaaaaaguuugagauuaaguuguguaacaaguagauuagcauuuggagcauuuggaaugcauuggguaagacaagcaccaggaaaaggauuagaauggguagcaaguauaaguuuugcaggaauaaaaaaauauuaugcagauaguguaaaaggaagauuuacaauaaguagggauaauaguaaagacacaguguuuuuagaaaugaauggauuaagaggagaugauacaggauuauauuauuguguaaaagauaugagauauuuagaaugugaagaaugggcaagugauuauuaugauuuuggaagaccacaaccauguuuagauccaagaggaguaaguggaauaagugcaauguggggacaaggaacauuaguaauaauaaguagu

SEQ ID NO: 47579 - RNA, 432 nt, Artificial Sequence
  derived and/or modified sequence opt6 from anti-HIV_cap256-119-186229_VR-Chain
caaaugcaauuaguagaaaguggaggaggaguaguacaaccaggaggaagcuuaagauuacuauguagugcaaguggauucacauucucaacauauggaaugcacuggguaagacaagcaccaggaaaaggacuagaauggguagcaucaauaucauacgauggaucagacaaauaccaugcaggacuaguauggggaagauuuauaauaagcagagacaauagcaaaaacacacuauaucuacaaaugaauagcuuaagagcagaagauacagcacuauauuacuguguaagagacgaaagagaaagcgaaugcgaauuaugggaaucagacuauuacaauuucggaaaaaaauuaccaugcguaaaaccaagaggaguagcaggaacauuagauauauggggacaaggaacaacaguaauaguaagcuca

SEQ ID NO: 47580 - RNA, 432 nt, Artificial Sequence
  derived and/or modified sequence opt6 from anti-HIV_cap256-119-183891_VR-Chain
caaguacaauuaguagaaaguggaggaggaguaguacaaccaggaggaaguuuaagauuaagcugugcagcaagcggauucacauucucaagcuauggaaugcacuggguaagacaagcaccaggaaaaggacuagaauggguagcauuuacaagauacgauggaucagacaaauacuaucuagauagcguaaaaggaagauuuacaauaagcagagacaauagcaaauacacauuauuuuuacaaaugguaagcuuaagaacagaagauacagcauuauauuucugugcaagagacuuaagagaaagugaaugcgaagaaugggaaucauacuauuacgauuucggaaaaaaaggaccaugcguaaaaccaagagggguaguaggaguacuagauauauggggacaaggaacgcuaguaacaguaagcuca

SEQ ID NO: 47581 - RNA, 435 nt, Artificial Sequence
  derived and/or modified sequence opt6 from anti-HIV_cap256-119-183631_VR-Chain
caaguacaauuaguacaaaguggaggaggaguaguacaaccaggaagaaguuuaagauuaagcugugcagcaaguaaauuuacauuuaguacauauacauuacauuggguaagacaagcaccaggaaaaggauuagaauggguagcaguaauaagucaugauggaggaaauagauuuuaugcagauaguguaaaaggaagauuuacaauaaguagagauaauagcaaaaauaauuuauuuuuacaaaugaauaguuuaagaguagaagauacagcauuauauuauugugcaagggauuuaagagaaauggaaugugaagaauggacauuauauaauuauuaugauuucggaaguagaggaccauguguagauccaagaggaguaguaggaaguuuugauguauggggacaaggaacaaugguaacaguaaguagu

SEQ ID NO: 47582 - RNA, 432 nt, Artificial Sequence
  derived and/or modified sequence opt6 from anti-HIV_cap256-119-182676_VR-Chain
caaguacaauuaguagaaagcggaggaggaguaguacaaccaggaaaaagcuuaagauuaagcuguguaguaaguggauucacauuuucaaauuauccaaugcacuggguaaggcaagcaccaggaaaaggauuagaauggguagcaaguauaucauuugcaggaauaaaaaaauauuauggagauaguguaaaaggaagauuuacaauaagcagagacaauaguaaaaauacacuauauuuacaaauggauggauuaagaggagaagauacagcacuauauuacugugcaaaagacuuaagagaacuagaaugugaagaaugggcaucagacuauuaugauuucggaagaccacaaccguguuuagacccaagaggaguaaguggaauaaguaauguauggggacaaggaacaaugguaacaguaaguuca

SEQ ID NO: 47583 - RNA, 432 nt, Artificial Sequence
  derived and/or modified sequence opt6 from anti-HIV_cap256-119-180772_VR-Chain
caaguacaauuaguagaaagcggaggaggaguaguacaaccaggaagaaguuuaagauuaagcugugcagcaagcgaauuuacauucucaaacuaugcaaugcacuggguaagacaagcaccaggaaaaggacuagaauggguagcaucaauaucauucgauggaagagacaaauaccauaguucauuaguauggggaagauuaacaauaaguagagacaauaguaaaagcacacuauuccuacaaaugaauagccuaagaccagaagauacagcacuauauuacugugcaagagacguaagagaaagcgaaugcgaagaauggcaaucagacuauuacgcauucuauagaaaauuaccaugugugaaaccaagaggaguagcaggaacacuagauauauggggacaaggaacaauggugacaguaagcuca

SEQ ID NO: 47584 - RNA, 435 nt, Artificial Sequence
  derived and/or modified sequence opt6 from anti-HIV_cap256-119-180508_VR-Chain
caaguacauuuaguagaaaguggaggaggaguaguacaaccaggaagaaguuugagauuaaguugugcagcaagucauuuuaguuuaaguaguuauggaaugcauuggguaagacaaacaccaggaaaaggauuagaauggguagcaggaauaaguuuugcaggaguaaaaacauauuauggaacaaguguaaaaggaagauuuacaauaaguagggauaauagcaaaaauaauuuauauuuacaaaugaauagcuuaagaccagaagauacagcauuauauuauugugcaagagauuuaagagaaauggaaugcgaagaauggaaauuauauaauuauuaugauuuuagaacaagaggaccauguguagauccaagaggaguaguaggaaguuuugauguaugggggcaaggaacaguaguaacaguaaguagu

SEQ ID NO: 47585 - RNA, 432 nt, Artificial Sequence
  derived and/or modified sequence opt6 from anti-HIV_cap256-119-180260_VR-Chain
gaaguacaauuaguagaaagcggaggaggaguaguaagaccaggaggaaguuuaagauuaaguugugcagcaagucaauucacauuuucgaauuuuggaaugcacuggguaagacaagcaccaggaaaaggauuagaauggguagcaucaauaucauuuguaggaauaaaaacacauuaugcaaauaguguaagagggagauuuacaauaaguagagaccaaaguaaaaauacauuauaucuacaaaugaauaguguaagaguagaagauacuggaagauauuacugugcaagagacaugagagaauaugaaugcgaauuaugggcaucagacuauuaugauuucggaaaaccacaaccaugugaagacccaagaggaguaguaggaacauuugauauguggggauuaggaacauuaguaacaguaaguucg

SEQ ID NO: 47586 - RNA, 432 nt, Artificial Sequence
  derived and/or modified sequence opt6 from anti-HIV_cap256-119-180173_VR-Chain
gaaguacaauuaguagaaagcggaggaggacuaguacaaccaggaggaagccuaagauuaagcugugcagcaagcggauucacaguaucaagcaauuacaugagcuggguaagacaagcaccaggaaaaggacuagaauggguagcaucaauaucauucgcaggaacaaaaaaacacuauggaaauagcguaaaaggaagauuuacaauaagcagagacaauagcaaaaacacauuauaucuacaaaugaauagcuuaagaggagaagauacagcacuauauuacugugcaaaagacuuaagagaauacgaaugcgaagaauggacaucggacuauuacgauuucggaagaccacaaccaugcauagacucaagaggaguaguaggaauacuagauauauggagccaaggaacaaugguaacaguaaguuca

SEQ ID NO: 47587 - RNA, 432 nt, Artificial Sequence
  derived and/or modified sequence opt6 from anti-HIV_cap256-119-179839_VR-Chain
caaguacaauuaguagaaaguggaggaggaguaguacaaccaggaagaagucuaagauuaaguugugcagcaaguggauuuucauuuggaacaagugauguacauuggguaagacaagcaccaggagaaggauuagaauggguagcauuaauaaguuuugauggaagacaaaaagauuuagcagauaguguaagaggaagauuuacaauaaguagagauaguaguaaaaauacauuauauuuagaaaugaauaguuuaagaccagaagauacagcauuauauuauugugcaaaagauaugcgaggauaugaaugugaagaauggacaucagauuauuacgauuuuggaagaccacaaccauguauagauaguagaggaguaguaggaacauuugauguauggggacaaggaacaaugguaacaguaaguagu

SEQ ID NO: 47588 - RNA, 423 nt, Artificial Sequence
  derived and/or modified sequence opt6 from anti-HIV_cap256-119-179262_VR-Chain
caaguacaauuaguagaaucaggaggaagaguaguacaaagcggaggaucacuaagacuaucaugcggagcaucaggauuuagcuuuacaacaagugcaaugcauuggguaagacaagcaccaggaaaaggacuagaauggguagcaauaaauggagcaaacaaacacuaugcagaaagcguaaaaggaagauuuacaauaagcagagacaauagcaaaaacacacuauuucuagaaaugaauaguuuaagaccagacgauacagcacuauauuucuguguaaaagaccaaagagaagacgaaugcgaagaaugguggucagacuauuacgauuucggaagagaacaaccaugcuuagacccaagaggaguaguaggaauauucgaucuauggggacaaggaacaaugguaacaguaagcuca

SEQ ID NO: 47589 - RNA, 432 nt, Artificial Sequence
  derived and/or modified sequence opt6 from anti-HIV_cap256-119-178995_VR-Chain
caagugcaauuaguagaaaguggaggaggaguaguacaaccaggaaaaaguuuaagauuaagcugugcagcaaguggauucacacuaacaagauuugcaaugcacuggguaagacaagcaccaggaaaaggacuagaauggguagcaguaauaugguacgauggaaguaacaaauacuaugcagauagcguaaaaggaagauuuacaguaaguagagacaauagcaaaaacacacuauaucuacaaaugaauagcuuaagaacagaagauacagcacuauauuacuguguaagagacagaagagaaagcgaaugcgaauuaugggaaucagacuauuacaauuucggaagaagacuaccaugcguaaaaccaagaggaguagcaggaauacuagauauauggggacaaggaacaacaguaacaguaagucca

SEQ ID NO: 47590 - RNA, 432 nt, Artificial Sequence
  derived and/or modified sequence opt6 from anti-HIV_cap256-119-178455_VR-Chain
gaaguacaauuaguagaaaguggaggaggauuaguacaaccaggaggaaguuuaagauuaagcuguguaguaagcggauucacauucucaaauuuuuggaugagcuggguaagacaagcaccaggaaaaggacuagaauggguagcaucaauaucauaugauggaagagacaaauaucauagcucacuaguauggggaagauuaacaauaagcagagacaauaguaaaagcacacuauuucuacaaaugaauagcuuaagagcagaagauacagcacuauauuacugugcaagggacuuaagagaaagugaaugugaagaauggcaaucggacuauuacgcauucuauaaaaaacuaccaugcguaaaaccaagaggaguagcaggaacacuagauauauggggacaaggaacaaugguaacaguaaguuca

SEQ ID NO: 47591 - RNA, 438 nt, Artificial Sequence
  derived and/or modified sequence opt6 from anti-HIV_cap256-119-177993_VR-Chain
caaguacauuuaguugaaaguggaggaggaguaguacaaccaggaaaaaguuuaagaauauauugugcaguaagugaauuuacauuuaguaauuaugcaaugcauuggguaagacuagcaccaggaagaggauuacaaugguuagcaguaauaaguuaugauggaaguaaaaaauauuaugcagauaguuuagaaggaagauuuacaauaaguaaagauaauaguaaaaauacauuauuuuuacaaaugaauagucuaagaguagaagauacagcauuauauuuuuguguaaaagaucaaagagaagaugaaugugaagaaugguggagugacuauuaugauuuuggagaaagagcaccauuaccaaaaguaccaggaccaggaccaggauggaauuuagauauguggggacauggaacaaugguaacaguaaguagu

SEQ ID NO: 47592 - RNA, 438 nt, Artificial Sequence
  derived and/or modified sequence opt6 from anti-HIV_cap256-119-177727_VR-Chain
caaguacaauuaguagaaagcggaggaggaguaguacaaccaggaagaagcuuaagauuaagcugugcagcaagcggauucacacuaucgagauaugacaugcacuggguaagacaagcaccaggaaaaggacuagaauggguagcaucaauaucaaaagauggaacaaaaaaauaucauggagauaguguauggggaagauuuauaauaagcagagacaauaguaaaaacacguuauuucuacaaaugucaaguuuaagagcagaagauacagcauuauauuucuguguaagagaucaaagagaagcagaaugugaagaaugguggucagacuauuacgauuucggaagagaauuaccaugcagaaaauuuagaggacuaggacuagcaggaauauuugauauauggggacauggaacaaugguaacaguaaguagu

SEQ ID NO: 47593 - RNA, 432 nt, Artificial Sequence
  derived and/or modified sequence opt6 from anti-HIV_cap256-119-176746_VR-Chain
gaaguacaauuaguagaaaguggaggaggauuaguacaaccaggaggaaguuuaagauuaagcugugcagcaagcgauuuuacauuugaugauuaugcaaugcauuggguaagacaagcaccaggaaaaggauuagaauggguaggaggaauaaguuaugauggaagugauaaauaucauacaaauaguguaugggggagauuuauaguaaguagagauaauaguaaaaauacauuauauuuacaaaugaauagcuuaagaccagaagauacagcauuauauuauuguguaagagauagaagagaaagugaaugugaagaaagauggagugauuauuaugauuuuggaaaacaacuaccauguguaaaaccaagaggaguagcaggaauauuugauauauggggacaaggaacaaugguaacaguaaguagu

SEQ ID NO: 47594 - RNA, 432 nt, Artificial Sequence
  derived and/or modified sequence opt6 from anti-HIV_cap256-119-176241_VR-Chain
caaguacaauugguagaaaguggaggaggaguaguacaaccaggaagaaguuuaagauuaaguugugcagcaaguggauuuacauuuaguaauuaugcaaugcauuggguaagacaagcaccaggaaaaggauuagaauggguagcaguaauaaguuaugauggaucaaauaaauauuaugcagauaguguaaaaggaagauuuacaauaaguagagauaauaguaaaaauacauuauauuuacaaauggauggauuaagaggagaagauacagcauuauauuauugugcaaaagauuuaagagaauuagaaugugaagaaugggcaagugauuauuaugauuuuggaagaccacaaccgugucuagauccaagaggaguaaguggaauaaguaauguauggggacaaggaacaauggugacaguaaguagu

SEQ ID NO: 47595 - RNA, 432 nt, Artificial Sequence
  derived and/or modified sequence opt6 from anti-HIV_cap256-119-175215_VR-Chain
caaguacaauuaguagaaagcggaggaggaguaguacaaccaggaaggagcuuaagauuaaguugugcaguaagucaauuuacauuuggaagauauggaauguauuggguaagacaagcaccaggaaaaggauuagaauggguagcaggaauaaguuaugauggaagugauaaauaucauacaaauaguguauggggaagauuuauaguaaguagagauaauagcaaaaauauguuauauuuacaaaugaauaauuuaagaccagaagauacagcauuauauuauuguguaagagauagaagagaaagugaaugugaagaaagauggagugauuauuaugauuuuggaaaacaauuaccauguguaaaaccaagaggaguagcaggaauauuugauauauggggacaaggaacaaugguaacaguaaguuca

SEQ ID NO: 47596 - RNA, 432 nt, Artificial Sequence
  derived and/or modified sequence opt6 from anti-HIV_cap256-119-173928_VR-Chain
ggaguagaauuauuagaaaguggaggaggauuaguagaaccaggaggaagucuaagauuaaguuguguaggaagucaauuuaguuuugauagauauggaaugcauuggguaagacaagcaccaggaaaaggauuagaauggguagcagcaguaaguuuugauggaacagauaaauaucaugcagaugauguauggggaagauuuacaauaaguagagauaauaguaaaaauacauuauauuuacaaaugaauaguuuaagagcagaagauacagcauuauauuauugugcaaaagauuugagagaagaugaaugugaagaaugguggagugauuauuaugauuuaggaaaacaauuaccguguaggaaaaguagaggaguagcaggaguauuagauaaauggggauuaggaacaaugguaacaguaaguagu

SEQ ID NO: 47597 - RNA, 432 nt, Artificial Sequence
  derived and/or modified sequence opt6 from anti-HIV_cap256-119-173495_VR-Chain
caaguacaauuaguagaaaguggaggaggaguaguacaaccaggaaaaaguuuaagauuaaguugugcagcaaguagauuuacauuuaauagauauggaaugcacuggguaagacaagcaccaggaaaaggauuagaauggguagcagcaauaucauuugauggaacagauaaauaucauagcgaugacguauggggaagauuuacaauaaguagagacaauaguaaaaauacauuauauuuacaaaugaauagcuuaagagcagaagauacagcaguauauuauugugcaaaagauuuaagagaagaugaaugugaagaaagauggucagacuauuaugauuucggaaaacaauuaccauguagaaaaucaagagggguagcaggaauauuugauaauuggggacaaggaacaaugguaacaguaagcuca

SEQ ID NO: 47598 - RNA, 432 nt, Artificial Sequence
  derived and/or modified sequence opt6 from anti-HIV_cap256-119-172882_VR-Chain
caaguacaauuaguagaaagcggaggaggaguaguacaaccaggaagaucauuaacauuaagcugugaagugagcggauucacauucaaaacauacggaaugcacuggguaagacaagcgccaggaaaaggacuagaauggguagcaagcauaucauacgauggaucagacaaauaccaugcagauagaguauggggaagauuuacaauaagcagagacaauagcaaaaacacauuauaucuacaaaugaauagcuuaagagcagaagauacagcauuauauuacuguguaagagacgcaagagaaagugaaugcgaacuaugggaaucagacuauuacaauuucggaagaaaacuaccaugcguaaaaccaagaggaguagcaggaacacuagauauauggggacaaggaacaaugguaacaguaagcucg

SEQ ID NO: 47599 - RNA, 432 nt, Artificial Sequence
  derived and/or modified sequence opt6 from anti-HIV_cap256-119-172429_VR-Chain
gaaguacaauuaguagaaacaggaggaggacuaauacaaccaggaggaaguuuaagauuaagcuguguagcaagccaauucacauucaguggauguggauuacacuggguaagacaagcaccaggaaaaggacuagaauggguagcaucaauaucauucgcaggaacaaaaaaacacuauggaaauaguguaaaaggaagauuuacaauaagcagagacaauagcaaaaacacauuauauuuagaaaugaauacauuaagagcagaagauacagcacuauauuauugugcaaaagacuuaagagaauaugaaugugaagaauggacaagugacuauuacgauuucggaagaccacaaccaugcauagacucaagaggaguaguaggaauauuagauauauggggacaaggaacaaugguaagcguaaguuca

SEQ ID NO: 47600 - RNA, 432 nt, Artificial Sequence
  derived and/or modified sequence opt6 from anti-HIV_cap256-119-172223_VR-Chain
caaguacaauuaguagaaaguggaggagggguaguacaaccaggaagaaguuuaagauuaaguugugcagcaaguggauuuacauuuaguaguuaugcaaugcauuggguaagacaagcaccaggaaaaggauuagaauggguagcaguaauaaguuaugauggaagagauuuuuaucaugcaagaaguguauggggaagauuuacaauaaguagagauaauaguaaaaauacacuacauuuacaaaugaauaguuuaagaccagaagauacagcauuauauuuuugugcaagagauuuaagggaaagugaaugugaagaaugggaaaguuauuauuaugauuuuggaaaaaaagauccauguguaaaaccaagaggaguaguaggaguauuagauauauggggacaaggaacauuaguaacaguaaguagu

SEQ ID NO: 47601 - RNA, 432 nt, Artificial Sequence
  derived and/or modified sequence opt6 from anti-HIV_cap256-119-171838_VR-Chain
caaguacaauuaggagaaaguggaggaggaguaguacaaccaggaagaaguuuaagauuaaguugugcagcaaguggauuuacauuuucaacauuugcaaugcauuggguaagacaagcaccaggaaaaggauuagaauggguagcaguaauaaguuaugauggaaguaauaaauauuaugcagauaguguaaaaggaagauuugcaauaaguagagauaaugcaaaaaauuuauuacauuuacaaaugaauaguuuaagaccagaagauacagcauuauauuauugugcaaaagauuuacaagaagaugaaugugaagaaugguggagugauuauuaugauuuuggaaaacaauuaccauguagaaaaaguagaggaguagcaggaauauuugaugauuggggacaaggaacaaugguaacaguaaguuca

SEQ ID NO: 47602 - RNA, 432 nt, Artificial Sequence
  derived and/or modified sequence opt6 from anti-HIV_cap256-119-171587_VR-Chain
gaaguacaauuaguagaaagcggaggaggccuaguacaaccaggaggaagucuaagauuaagcugugcagcaaguggauucacauucucagacuauuacaugaguuggauaagacaagcaccaggaaaaggacuagaauggguagcaucaauaucauucgcaggaacaaaacaacacuauggaaauagcguaaaaggaagauuuacaauaagcagagacaauaguaaaaacacaguauaucuacaaaugaauagcuuaagauuagaagauacagcacuauauuacugugcaaaagacuuaagagaauacgaaugcgaagaauggacaucagacuauuacgauuucggaagaccacaaccaugcauagacucaagaggaguaguaggaauacuagauauauggggacaaggaacaaugguaacaguaaguuca

SEQ ID NO: 47603 - RNA, 432 nt, Artificial Sequence
  derived and/or modified sequence opt6 from anti-HIV_cap256-119-169596_VR-Chain
cuaguacaauuaguagaaaguggaggaggaguaguacaaccaggaagaucauuaagauuaagcuguacagcaagcggauucacauucagcagcuuugcaaugcacagaguaagacaaacaccaggaaaaggacuagaauggguagcaucaauaucauacgauggaucagacaaauaccaugcagauagaguauggggaagauuuacaauaagcagagacaauagcaaaaacacacuauauuuacaaaugaauagcuuaagagcagaagauacagcacuauauuacuguguaagagacgcaagagaaagcgaaugcgaacuaugggaaucagacuauuauaauuucggaagaaaauuaccaugcguaaaaccaagaggaguagcaggaacacuagauauauggggacaaggaacaaugguaacaguaaguuca

SEQ ID NO: 47604 - RNA, 432 nt, Artificial Sequence
  derived and/or modified sequence opt6 from anti-HIV_cap256-119-169523_VR-Chain
caaguacaauuaguagaaaguggaggaggaguaguacaaccaggagaaaguuuaagauuaaguugugcagcaaguggauuuaguuuuggaacaagugauguacauuggguaagacaagcaccaggagaaggauuagaauggguagcaaguauaaguuuugcaggaauaaaaaaauauuauggagauaguguaaaaggaagauuuacaauaaguagagauaauaguaaaaauacauuauauuuacaaauggauggacuaagaggagaagauacagcauuauauuauugugcaaaagauuuaagagaauuagaaugugaagaaugggcaagugauuauuaugauuuuggaagaccacaaccauguuuagauccaagaggaguaagcggaauaaguaauguauggggacaaggaacaaugguaacaguaaguagu

SEQ ID NO: 47605 - RNA, 432 nt, Artificial Sequence
  derived and/or modified sequence opt6 from anti-HIV_cap256-119-169462_VR-Chain
gaaguacaauuaguagaaagcggaggaggauuaguacaaccaggaggaucauuaagauuaagcugugcagcaagcggauucacauucacaacauacagcuuacacuggguaagacaaagcccaggaaaaggauuagaauggguagcagcaauaucauucgcaggaacaaaagaaaacuaugcaaauagcguaagaggaagauuuacaauaaguagagacaauagcaaaaacacacuauaucuacaaaugaauaguuuaagagcagaagauacagcacuauauuacuguacaaaagacaugagagaauacgaaugcgaagaauggacaucagacuauuacgauuucggaagaccacaaccaugcauagacucaagaggaguaguaggaacauucgauguauggggacaaggaacaaugguaacaguaagcuca

SEQ ID NO: 47606 - RNA, 432 nt, Artificial Sequence
  derived and/or modified sequence opt6 from anti-HIV_cap256-119-169092_VR-Chain
gaaguacaauuaguagaaaguggaggaggauuaguacaaccaggaggaaguuugagauuaaguuguguaauaaguggauuuacauuuaguaguuaugaaaugaauuggguaagacaagcaccaggaaaaggauuagaauggguagcaggaauaucauaugauggaagagauaaauaucaugcacauuuuguauggggaagaauaacaauaaguagggauaauagcaaaaauacauuauauuuacaaaugaauaguuuaagagcagaagauacagcguuauaucauuguguaagagauuuaagagaaagugaaugugaauuaugggaaucagauuauuaugauuuuggaaaaaaauuaccauguguaaaaccaagaggaguagcaggaauauuugauuuauggggacaaggaacaaugguaacaguaaguuca

SEQ ID NO: 47607 - RNA, 432 nt, Artificial Sequence
  derived and/or modified sequence opt6 from anti-HIV_cap256-119-168680_VR-Chain
caaguacaauuaguagaaaguggaggaggaguaguacaaccaggaagaaguuuaagaguaaguugugcagcaagucauuuuacauuuaguagauauggaaugcauuggguaaggcaagcaccaggaaaaggauuagaauggguagcaaguauaaguuaugauggaagagauuuuuaucaugcaagaaguguauggggaagauuugcaauaaguagagauaauagcaaaaauacauuacauuuacaaaugaauaguuuaagaacagaagauacagcauuauaucauuguguaagagauuuaagagaaagugaaugcgaauuaugggaaagugauuauuaugauuuuggaaaaaaauuaccauguguaaaaccaagaggaguagcaggaacauuugauuuauggggacaaggaacaaugguaacaguaaguagu

SEQ ID NO: 47608 - RNA, 438 nt, Artificial Sequence
  derived and/or modified sequence opt6 from anti-HIV_cap256-119-166385_VR-Chain
caaguacaauuaguagaaaguggaggaggaguaguacauccaggaagaaguuuaagauuaaguugugcagcaaguggauuuaguuuuggaaauuuuggaaugcauuggguaagacaagcaccaggaaaaggauuagaauggguagcaaguauaaguaaugauggaacaaaaaaauaucaugcagaaaguguaugggauagauuuaguauaaguaaagauaauaguaaaaauacauuauuuuuacaaaugaauagcuuaagaguagaagauacagcauuauauuuuuguguaaaagaucaaagagaagacgaaugugaagaaugguggagugauuauuaugauuuuggaagagaauuaccauguagaaaaaguagaggauuaggacuagcaggaauauuugauauguggggacauggaacaaugguaacaguaaguagu

SEQ ID NO: 47609 - RNA, 432 nt, Artificial Sequence
  derived and/or modified sequence opt6 from anti-HIV_cap256-119-165943_VR-Chain
gaaguacaauuaguagaaaguggaggaggauuaguacaaccaggaaggaguuuaagauuaaguugugcagugaguggauuuacaguaaguaguaauuauaugagcuggguaagacaagcaccaggaaaaggauuagaauggguagcaaguauaaguuuugcaggaauaaaaaaauauuauggagauaguguaaaaggaagauuuacaauaaguagagauaauaguaaaaauacauuauauuuacaaauggauggauuaagaggagaagauacagcauuauauuauugugcaaaagauuugagagaacuagaaugugaagaaugggcgagugauuauuaugauuuuggaagaccacaaccauguuuagauccaagaggaguaaguggaauaaguaauguauggggacaaggaacaaugguaacaguaaguagu

SEQ ID NO: 47610 - RNA, 432 nt, Artificial Sequence
  derived and/or modified sequence opt6 from anti-HIV_cap256-119-165738_VR-Chain
gaaguacaauuaguagaaaguggaggaggauuaguacaaccaggaagaaguuuaagauuaaguugugcagcaagcggauuuacauuugaugacuaugcaaugaauuggguaagacaagcaccaggaaaaggauuagaauggguagcaacaauaaguuuugauggaacagauaaauaucaugcagaugauguauggggaagauuuacaauaagcagagauaauagcaaaaaaacauuauauuuacaaaugaauaguuuaagagcagaagauacagcauuauauuauugugcaaaagauuuaagagaagaugaaugugaagaaugguggagugauuauuaugauuuaggaaaacaauuaccauguagaaaaucaagaggaguagcaggaguauuagauaaauggggauuaggaacaaugguaacaguaaguagu

SEQ ID NO: 47611 - RNA, 432 nt, Artificial Sequence
  derived and/or modified sequence opt6 from anti-HIV_cap256-119-164913_VR-Chain
caagaucauuuaguagaaagcggaggagguggagugcaaccaggaaaaaguuuaagauuaagcugugcagcaaguggauuuacauuuagugcacaugcaaugcauuggguaagacaagcaccaggaaaaggaccagaauggguagcaguaauaagucaugauggaggacaacaauuuuauagagaaaguguaaaaggaagauuuacaauaagcagagauaauaguaaaaauacauuauauuuacaaauggauggauuaagaggagaagauacagcauuauauuauugugcaaaagauuuaagagaauuagaaugugaagaaugggcaagugauuauuaugauuuuggaagaccacaaccauguuuagauccaagaggaguaaguggaauaaguaauguauggggacaaggaacaaugguaacaguaaguagu

SEQ ID NO: 47612 - RNA, 432 nt, Artificial Sequence
  derived and/or modified sequence opt6 from anti-HIV_cap256-119-164167_VR-Chain
gaaguaagauuaguagaaaguggaggaggauuaauacaaccaggaggaaguuuaagauuaaguugugcagcaaguggauuaacaguaaguaguaaucauaugaguuggguaagacaagcaccaggaaaaggauuagaauggguagcaaguauaaguuaugauggaagagauuuuuaucaugcaagaaguguauggggaagauuuacaauaaguagagauaauaguaaaaauacauuacaucuacaaaugaauagucuaagaccagaagauacggcacuauauuuuugugcaagagauuuaagagaaagugaaugugaagaaugggaaaguuauuauuaugauuuuggaaaaaaaggaccauguguaaaaccaagaggaguaguaggaguauuagauauauggggacaaggaacacuaguaacaguaaguagu

SEQ ID NO: 47613 - RNA, 432 nt, Artificial Sequence
  derived and/or modified sequence opt6 from anti-HIV_cap256-119-163558_VR-Chain
caaaugcaauuaguagaaagcggaggaggaguaguacaaccaggaagaucauuaacauuaagcugugcagcaagccaauucaauuucgcaaacuauggaaugcacuggguaagacaagcaccaggaaaaggacuagaauggguagcaagcauaucauacgauggaucagacaaauaccaugcagauagaguauggggaagauuuacaauaagcagagacaauagcaaaaacacacuauaucuacaaaugaauagcuuaagagcagaagauacagcacuauauuacuguguaagagacgcaagagaaagcgaaugcgaauuaugggaaucagacuauuacaauuucggaagaaaauuaccaugcguaaaaccaagaggaguagcaggaacacuagauauauggggacaaggaacaaugguaacaguaaguuca

SEQ ID NO: 47614 - RNA, 432 nt, Artificial Sequence
  derived and/or modified sequence opt6 from anti-HIV_cap256-119-162043_VR-Chain
caaguacaauuaguagaaaguggaggaggaguaguacaaccaggaagaaguuuaagaguaaguugugcagcaagucauuuuacauuuaguagauauggaaugcauuggguaagacaagcaccaggaaaaggauuagaauggguaacaggaauaaguuuugcagcaacaaaaacauauuauggagauaguguaaggggaagauuuacaguaaguagagauauaaguaaaaauacauuauauuuacaaaugaauagcuuaagaccagaagauacagcaauguauuauugugcaagagaucaaagauauuaugaaugugaagaaugggcaagugauuauuaugauuuuggaagagaacaaccaugucaagauccaagaggaguaguagggauauuagauuuauggggacaaggaacaaugguaacaguaagcuca

SEQ ID NO: 47615 - RNA, 432 nt, Artificial Sequence
  derived and/or modified sequence opt6 from anti-HIV_cap256-119-161718_VR-Chain
caaguacaauuaguagaaagcggaggaggaguaguacaaccaggaaaaucauuaagauuaagcugugcagcaagccauuucagcuucaauagauauggaaugcacuggguaagacaagcaccaggaaaaggacuagaauggguagcagcaauaucauacgauggaacagacaaauaucaugcagaucaaguauggggaagauuuacaauaagcagagacaauagcaaaaacacauuauauuuacaaaugaauagcuuaagaccagaagauacagcauuauauuacugugcaaaagacuuaagagaagacgaaugugaagaaugguggucagacuauuacgaucuaggaaaacaacuaccaugcagaaaaucaagaggaguagcaggaauauucgauaaauggggacaaggaacaaugguaacaguaagcuca

SEQ ID NO: 47616 - RNA, 432 nt, Artificial Sequence
  derived and/or modified sequence opt6 from anti-HIV_cap256-119-161675_VR-Chain
caaguacaauuaguagaaaguggaggaggaguaguacaaccaggaagaaguuuaagauuaagcuguacagcaagcggauuuacauuuucaauauauaguaugaacuggguaagacaagcaccaggaaaaggacuagauuggguagcaggaauaucauuugcagcaacaaaaacauauuauggaggaaguguaaaaggaagauuuacaguaagcagagacauaaguaaaaauacauuauauuuacaaaugaauaguuuaagaccagaagauacagcaauguauuauugugcaagagaucaaagauauuaugaaugugaagaaugggcaucagauuauuaugauuucggaagagaacaaccaugucaagacccaagaggaguaguaggaguauuugauauguggggacaaggaacaaugguaacaguaaguuca

SEQ ID NO: 47617 - RNA, 432 nt, Artificial Sequence
  derived and/or modified sequence opt6 from anti-HIV_cap256-119-161053_VR-Chain
caaguacauuuaguagaaagcggaggaggaguaguacaaccaggaacaaguuuaagauuaaguuguguagcaaguggauuuacauuuucaaauuuugcaaugcacuggguaagacaagcaccaggaaaaggacuagaaugggcagcaauaauaucaacaagaggaaauaacagaaauuaugcagauagcguaagaggaagauuuacaguaagcagagauauaaguaaaaauacauuauauuuacaaaugaauaguuuaagaccagaagauacagcaauguauuacugugcaagagaucaaagauauuaugaaugugaagaaugggcaucagacuauuaugauuucggaagagaacaaccaugucaagacccaagaggaguaguaggaauauuagauuuauggggacaaggaacaaugguaacaguaagcuca

SEQ ID NO: 47618 - RNA, 432 nt, Artificial Sequence
  derived and/or modified sequence opt6 from anti-HIV_cap256-119-159499_VR-Chain
caaguacaauuaguagaaagugggggaggaguaguacaaccaggaagaaguuuaagauuaaguugugcagcaaguggauuugcauuuucacauuauggaauauuuuggguaagacaagcaccaggaaaaggacuagaauggguagcaaguauaaguuuugauggaagagauuauuaucauaguccacauguauggggaagauuaacaauaaguagagauaauaguaaaaauacacuauauuuacaaaugaauagcuuaagagcagaagauacagcauuauauuauugugcaagagauuuaagagaaagugaaagagaagaaugggaaagugauuauuaugauuuuggaaaaaaaggaccauguguaaaaccaagaggaguagcaggaaguuuagauauguggggacaagggacaaugguaauaguaagcagu

SEQ ID NO: 47619 - RNA, 432 nt, Artificial Sequence
  derived and/or modified sequence opt6 from anti-HIV_cap256-119-159114_VR-Chain
gaaguacaauuaguagaaaguggaggaggauuaguacaaccaggagggaguuuaagauuagcaugugcagcaaguggauuaacauuuagaaaacaugguaugcauuggguaagacaagcaccaggaaaaggauuagaauggguaagcuauauaaguagugauggaguaaauaauuauuuaauagauaguguaagaggaagauuuacaguaagcagagauaauaguaaaaauacauuauauuuacaaauggauggauuaagaggagaagauacagcauuauauuauugugcaaaagauuugagagaacuagaaugugaagaaugggcaagugauuauuaugauuuuggaagaccacaaccauguuuagauccaagaggaguaaguggaauaaguaauguauggggacaaggaacaauggugacaguaaguuca

SEQ ID NO: 47620 - RNA, 432 nt, Artificial Sequence
  derived and/or modified sequence opt6 from anti-HIV_cap256-119-156751_VR-Chain
gaaguacaauuauuagaaagcggaggaggauuaguacaaccaggaggaaguuuaagauuaaguugugcagcaagcggauuugcauuuaguaguuauggaaugcauuggguaagacaagcaccaggaaaaggacuagaauggguagcaaguauaucauaugauggaagagauuuuuaucaugcaagaaguguauggggaagauuuacaauaaguagagauaauaguaaaaauacauuacauuuacaaaugaauaguuuaagaccagaagauacagcauuauauuuuugugcaagagauuuaagagaaagugaaugugaagaaugggaaaguuauuauuaugauuuugggaaaaaaggaccauguguaaaaccaagaggaguaguaggaguauuagauauauggggacaaggaacacuaguaacaguaaguagu

SEQ ID NO: 47621 - RNA, 432 nt, Artificial Sequence
  derived and/or modified sequence opt6 from anti-HIV_cap256-119-155656_VR-Chain
gaaguacaauuaguagaaaguggaggaggauuaguacaaccaggaggaaguuuaagauuaaguugugcagcaaguggaauaacauuuaguaguuauggaaugcauuggguaagacaagcaccaggaaaaggauuagaauggguagcauuuauaagauaugauggaaguaguaaauauuaugcagauaguguaaaaggaagauuuacaauaaguagagauaauaguaaaaauacauuauauuuacaaauggauggauuaagaggagaagauacagcauuauauuauugugcaaaagauuuaagagaauuagaaugugaagaaugggcaagugauuauuaugauuuuggaagaccacaaccauguuuagauccaagaggaguaaguggaauaagcaauguauggggacaaggaacaaugguaacaguaaguagu

SEQ ID NO: 47622 - RNA, 432 nt, Artificial Sequence
  derived and/or modified sequence opt6 from anti-HIV_cap256-119-154420_VR-Chain
caaguaagauuaguagaaaguggaggaggaguaguacaaccaggaagaagcuuaagaauaaguugugcagcaagucaauuuauguuuaguagauauggaaugcauuggguaagacaagcaccaggaaaaggauuagaauggguagcaaguauaaguuaugauggaacagauaaauaucaugcagaucuaguauggggaagauuuacaauaaguagggauaauaguaaaaauacauuauauuuacaaaugaauaguuuaagagcagaagauacagcauuauauuauugugcaagggauuuaagagaaagugaaugugaagaaugggaaagugauuauuaugauuuuggaaaaaaaggaccauguguaaaaccaagaggaguagcgggaaguuuagauauguggggacaaggaacaaugguaauaguaaguagu

SEQ ID NO: 47623 - RNA, 432 nt, Artificial Sequence
  derived and/or modified sequence opt6 from anti-HIV_cap256-119-153954_VR-Chain
gaaguacaaguauuagaaagcgggggaggacuaguacaaccaggaggaaguuuaagauuaagcuguguagcaagccaauucacauucucaggauguggauuacacuggguaagacaagcaccaggaaaaggacuagaauggguagcaucaauaucauucgcaggaacaaaaaaacacuauggaaauaguguaaaaggaagauuuacaauaaguagagacaauagcaaaaacacaguauauuuagaaaugaauaguuuaagagcagaagauacagcacuauauuacugugcaaaagacuuaagagaauacgaaugugaagaauggacaagugacuauuacgauuucggaagaccacaaccaugcauagacucgagaggaguaguaggaauacuagauauauggggacaaggaacaaugguaacaguaagcuca

SEQ ID NO: 47624 - RNA, 432 nt, Artificial Sequence
  derived and/or modified sequence opt6 from anti-HIV_cap256-119-153864_VR-Chain
caaguacauuuaguagaaaguggaggaggaguaguacaaccaggaggaaguuuaagauuaagcugugcagcaaguggauuuacauuuucaggauguggacuacauuggguaagacaagcaccaggaaaaggauuagaauggguagcaucaauaucauuugcaggaacaaaaaaacauuauggaucaaguguaagaggaagauuuaguauaaguagagauaauaguaaaaauacauuauauuuacaaaugaauagcuuaagaacagaagauacagcauuauauuuuugugcaaaagauuuaagagaauaugaaugugaagaauggacaucagauuauuaugauuuuggaagaccacaaccaugcauagauucaagaggaguaguaggaauacuagauauauggggacaaggaacaaugguaacaguaaguuca

SEQ ID NO: 47625 - RNA, 432 nt, Artificial Sequence
  derived and/or modified sequence opt6 from anti-HIV_cap256-119-153793_VR-Chain
gaaguacaauuaguagaaaguggaggaggaguaguacaaccaggaggaaguuuaagauuaaguugugcaacaaguggauuuacauuuggaacauuuggaaugcauuggguaagacaagcaccaggaaaaggauuagauuggguagcauauauaagauaugauggaaaaacaaagaauuauggagaaagugugaaaggaagauuuacaauaagcagggauaauaguaaaaauacaaugaguuuacaaaugaauaguuuaagaccagaagauacagcauuauauuauugugcaaaagacuuaagagaagaugaaugugaagaaagauggagugauuauuaugauuuuggaaaacaauuaccauguagaaaaaguagaggaguagcaggaguauuugauaauuggggacaaggaacaaugguaacaguaagcagu

SEQ ID NO: 47626 - RNA, 432 nt, Artificial Sequence
  derived and/or modified sequence opt6 from anti-HIV_cap256-119-153462_VR-Chain
caaguacaauuaguagaaagcggaggaggaguaguacaaccaggaggaaguuuaagauuaagcugugcagcaaguggauucacauucucaaacuauggaaugcaauggguaagacaagcaccaggaaaaggacuagaauggguagcagcaauaucguacgauggaagaaacgaauacuaugcagaaagcguaaaaggaagauuuacaauaaguagagacaauuucaaaagcacacuauuucuacaaaugaauagcuugagagcagaagauacagcacuauauuacugugcaagagacuuaagagaaagugaaugugaagaaugggaaucagacuauuacgcauucuauagaaaacuaccaugcguaaaaccaagaggaguagcaggaacauuagauauauggggacaaggaacaaugguaacaguaaguuca

SEQ ID NO: 47627 - RNA, 438 nt, Artificial Sequence
  derived and/or modified sequence opt6 from anti-HIV_cap256-119-153124_VR-Chain
caaguacaauuaguagaaagcggaggaggaguaguacaaccaggaagaagcuuaacauuaagcuguauagcaagccaauucaauuuugcaagcuauggaaugcacuggguaagacaagcaccaggaaaaggacuagaauggguagcaucaauaucacacgauggaacaaaaaaauaccaugcagaaagcguauggggaagauuuacaauaagcaaagacaauagcaaaaacacauuauuucuacaaaugaauagcuuaagaguagaagauacagcacuauauuucuguguaaaagaccaaagagaagacgaaugcgaagaaugguggucagacuauuacgauuucggaagagaauuaccaugcagaaaaaguagaggacuaggauuagcaggaauauucgauauguggggacauggaacaaugguaacaguaagcuca

SEQ ID NO: 47628 - RNA, 438 nt, Artificial Sequence
  derived and/or modified sequence opt6 from anti-HIV_cap256-119-153025_VR-Chain
caaaugcaauuaguagaaagcggaggaggaguaguacaaccaggaaaaaguuuaacauuaagcugugcagcaagccaauucacauucucaaacuauggaaugcacuggguaagacaagcaccaggaaaaggauuagaauggguagcaucaauaucaaacgauggaaauaaaaaauaccauggagauaguguauggggaagauuaacaauaagcagagacaauagcaaaaacacucuauuucuacaaaugaauagcuuaagaccagaagauacagcacuauauuucuguguaaaagaccaaagagaagacgaaugcgaagaaugguggucagacuauuacgauuucggaagagaacuaccaugcagaaaauuuagaggacuaggacuagcaggaauauucgauauauggggacauggaacaaugguaacaguaagcuca

SEQ ID NO: 47629 - RNA, 432 nt, Artificial Sequence
  derived and/or modified sequence opt6 from anti-HIV_cap256-119-152713_VR-Chain
gaaguacaauugguagaaaguggaggaggauuaguaagaccaggaggaagccuaagauuaaguugugcaacaaguggauuuacauuuucaagucauuggaugaguuggguaagacaagcaccaggaaaaggauuagaauggguagcaggaauaaguuuugcaggaacaaaaacauauuauggagauaguguaaaaggaagauuuacaguaaguacagacauaaguaaaaacacauuauauuuacaaguaaauaguuuaagaccagaagauacagcaauguauuauugugcaagagaucaaagauauuaugaaugugaagaaugggcaucagacuauuaugauuucggaaaagaacaaccauguuuagacccaagaggaguaguaggaauauuugauauauggggacaaggaacaaugguaacaguaaguuca

SEQ ID NO: 47630 - RNA, 438 nt, Artificial Sequence
  derived and/or modified sequence opt6 from anti-HIV_cap256-119-151794_VR-Chain
cacguacaauuaguagaaaguggaggaggaguaguacaaccaggaacaaguuuaagauuaagcuguguagcaagcgaauucucauucaaaaacuauggcaugcacuggguaagacaagcaccaggaaaaggacuagaauggguagcaucaauaucaaacgauggaacaaaaaaauaccaugcagaaaguguaugggauagauuuagcauaaguaaagacaauagcaaaaacacacuauuuuuacaaaugaauagcuuaagaguagaagauacagcacuauauuucuguguaaaagaccaaagagaagacgaaugcgaagaaugguggucagacuauuacgauuucggaagagaauuaccauguagaaaaucaagaggauuaggacuagcaggaauauucgauauguggggacauggaacaaugguaacaguaagcuca

SEQ ID NO: 47631 - RNA, 438 nt, Artificial Sequence
  derived and/or modified sequence opt6 from anti-HIV_cap256-119-150980_VR-Chain
caagugcaauuaguagaaagugggggaggaguaguacaaccaggaaaaagcuuaagauuaaguugugcagcaaguggauucauacuaucaaacuaugcaaugcacuggguaagacaagcaccagggaaaggacuagaauggguagcaucaauaucaaacgauggaucaaaaaaauaccauggagauagcguaugggcaagauuuauaauaaguagagacaauagcaaaaacacacuauuucuacaaaugucaagcuuaagagcagaagauacagcacuauauuucuguguaagagaccauagagaagacgaaugcgaagaaugguggucagacuauuacgauuucggaagagaauuaccaugcagaaaauuuagaggguuaggauuagcaggaauauucgauauauggggacauggaacaauggugacaguaagcuca

SEQ ID NO: 47632 - RNA, 432 nt, Artificial Sequence
  derived and/or modified sequence opt6 from anti-HIV_cap256-119-148895_VR-Chain
caaguacaauuaguagaaaguggaggaggaguaguacaaccaggaagaaguuuaagauuaaguugugcagcaaguggauuuacauuuagaaguuauggaaugcauuggguaagacaagcaccaggaaaaggauuagaauggguagcaguaauaaguagugauggagauauagaauauuauacacaaaguguaaaaggaagauuuacaauaaguagagauaauagcaaaaauacauuauauuuacaaaugaaugcauuaagaccagaagauacagcaauguauuauugugcaagagaucaaagauauuaugaaugugaagaaugggcaagugauuauuaugauuuuggaagagaacaaccaugucaagauccaagagggguaguaggaguauuugauauguggggacaaggaacaaugguaacaguaaguagu

SEQ ID NO: 47633 - RNA, 438 nt, Artificial Sequence
  derived and/or modified sequence opt6 from anti-HIV_cap256-119-148848_VR-Chain
caaaugcaauuaguagaaagcggaggaggaguaguacaaccaggaagaagcuuaacauuaaguugugcagcaagccaauucucauucacaagcuauggaaugcacuggguaagacaagcaccaggaaaaggacuagaauggguggcaucaauaucaaacgauggaacaaaaaaauaccauggagaaagcguaugggauagauuuagcauaaguagagacaauagcaaaaacacacuauuucuacaaaugaauagcuuaagaguagaagauacagcauuauauuucuguguaaaagaccaaagagaagacgaaugcgaagaaugguggucagacuauuacgauuucggaaaagaacuaccaugcaggaaauggaaaacaagaggaguagcaggaauacuagauaacuggggacaaggaacaauguugacaguaagcagu

SEQ ID NO: 47634 - RNA, 432 nt, Artificial Sequence
  derived and/or modified sequence opt6 from anti-HIV_cap256-119-148743_VR-Chain
caaguacaauuaguagaaagcggaggaggaguaguacaaccaggaagaagcuuaacauuaaguugugcagcaagucaauucaauuucgcaaacuauggaaugcacuggguaagacaagcaccaggaaaaggauuagaauggguagcaucgauaucaaacgauggaacaaaaaaauaccaugcagaaagcguaugggauagauuuagcauaagcaaagacaauagcaaaaacacgcuauuucuacaaaugaauagcuuaagaguagaagauacagcacuauauuucuguguaaaagaccaaagagaagacgaaugcgaagaaugguggucagacuauuacgauuucggaaaaaaacuaccaugcagaaaaaguagaggacuagcaggaauauuccauguauggggacauggaacaaugguaacaguaagcuca

SEQ ID NO: 47635 - RNA, 432 nt, Artificial Sequence
  derived and/or modified sequence opt6 from anti-HIV_cap256-119-148595_VR-Chain
gaaguacaauuaguagaaagcggaggaggauuaguacaaccaggaggaaguuuaagauuaagcugugcagcaaguagauucacauucgauaauuauggaaugcacuggguaagacaagcaccaggaaaaggacuagaauggguagcauuauuaaauuaugaugguucaaaaaaauauuauguagauaguguaaaaggaagauuuauaauauucagagacaauaguaaaaauacacuauuuuuacaaaugaauaguuuaagaccagaagauacagcauuauauuucuguguaaaagaucaaagagaagacgcaugugaagaaugguggucagacuauuaugauuucggaaaaaaauuaccaugcagaaaaucaagaggacuagcaggaauauuucauguauggggacauggaacaaugguaacaguaaguagu

SEQ ID NO: 47636 - RNA, 432 nt, Artificial Sequence
  derived and/or modified sequence opt6 from anti-HIV_cap256-119-148490_VR-Chain
caaguacaauuaguagaaaguggaggaggaguaguacaaccaggaagaaguuuaagauuaaguuguguagcaaguggauuuacauuuagugauuaugcaaugcauuggguaagacaagcaccaggaaaaggauuagaauggguagcaacaauaucauuugauggagcagauaaauaucaugcagaugauguauggggaagguuuacaauaaguagagauaauaguaaaaauacauuauauuuacaaaugaauaguuuaagaccagaagauacagcauuauauuauugugcaaaagauuuaagagaagaugaaugugaagaaagauggagugauuauuacgauuuuggaaaacaauuaccauguagaaaaucaagaggaguagcaggaguauuugauaauuggggacaaggaacaaugguaacaguaaguagu

SEQ ID NO: 47637 - RNA, 438 nt, Artificial Sequence
  derived and/or modified sequence opt6 from anti-HIV_cap256-119-148470_VR-Chain
caaguacaauuaguagaaaguggaggaggagugguacaaccaggaagaaguuuaagauuaaguuguguagcaaguggauuuacauuuaguagcuauggaauacauuggguaagacaagcaccaggaaaaggauuagaauggguagcaguaauaucagaugauggaaguaaaaaauaucaugaagaaaguguauggggaagauuuacaauaaguaaagauaauaguaaaaauacauuauuucuacaaaugaauaguuuaagaauagaagauacagcauuauauuuuuguguaaaagaucaaagagaagaugaaugugaagaaugguggagugacuauuaugauuuuggaagagaauuaccauguagaaaaaguagaggguuaggauuagcaggaauauuugauauguggggacauggaacgaugguaacaguaaguagu

SEQ ID NO: 47638 - RNA, 432 nt, Artificial Sequence
  derived and/or modified sequence opt6 from anti-HIV_cap256-119-148107_VR-Chain
gaaguacaauuaguagaaagcggaggaggauuaguacaaccaggaggaaguuuaagauuaagcugugcagcaaguggauuuacaguaaguaguaauuauaugacauggguaagacaagcaccaagaaaaggauuagaauggguaggaagcauaaguuaugauggaagugauaaauaucauacaaauaguuuaugggggagauuuauaguaaguagagauaauaguaaaaacacacuauauuuacaaaugaauaauuuaagaccagaagauacagcauuauauuauuguguaagagauagaagagaaagugaaugugaagaaagguggucagauuauuaugauuuuggaaaacaauuaccauguguaaaaccaagaggaguggcaggaauauuugauauauggggacaaggaacaaugguaacaguaaguagu

SEQ ID NO: 47639 - RNA, 432 nt, Artificial Sequence
  derived and/or modified sequence opt6 from anti-HIV_cap256-119-147933_VR-Chain
gaauuacaauuaguagaaaguggaggaggauuaguacaaccaggauggaguuuaagauuaaguugugaagcaaguggauuuccauuuagugcauuuuggaugacauggguaaggcaagcaccaggaaaaggauuaggauggguagcauuuauaagauaugauggaaguaauaaauauuaugcagauaguguaaaaggaagauuuacaauaaguagagauaauaguaugacaacauuauauuuacaaaugaauaguuuaagagcagaagaugcagcaguguauuauugugcaaaagauuuaagagaagaugaaugugaagaaugguggagugauuauuaugauuuuggaaaaagauuaccauguagaaaaaguagaggaguagcaggaguauuugauaaauggggacaaggaacaaugguaacaguaagcagu

SEQ ID NO: 47640 - RNA, 432 nt, Artificial Sequence
  derived and/or modified sequence opt6 from anti-HIV_cap256-119-147434_VR-Chain
caaguacaauuaguagaaaguggaggaggaguaguacaagcaggaagaaguuuaagauuaaguugugcagcaagucaauuuacauuuggaagauauggaaugcauuggguaagacaagcaccaggaaaaggauuagaaugggugggaaguauaaguuaugauggaagugauaaauaucauacaaauaguguauggggaagauuuauaguaaguagagauaauaguaaaaauacauuauauuuacaaaugaauaguuuaagaccagaagauacagcaauguauuauugugcaagagaucaaagauauuaugaaugugaagaaugggcaagugauuauuaugauuuuggaagagaacaaccaugucaagauccaagaggaguaguaggaguauuugauauguggggacaaggaacaaugguaacaguaaguagu

SEQ ID NO: 47641 - RNA, 435 nt, Artificial Sequence
  derived and/or modified sequence opt6 from anti-HIV_cap256-119-146106_VR-Chain
caaguacaauuaguagaaaguggaggaggaguaguacaaccaggaagaaguuuaagauuaaguugugcagcaaguggauuuacauuuaguaguaguggaaugcauuggguaagacaagcaccaggaaaaggauuacaauggguagcaguaauaaguuaugauggaggaaauaaauauuaugcagauaguguaaaaggaagauuuacaauaaguagagauaauaguaaaaauaauuuauacuuacaaaugaauaguuuaagaccagaagauacagcauuauauuauugugcaagagauuuaagagaaauggaaugcgaagaauggaaauuauauaauuauuaugauuuuagaacaagaggaccauguguagauccaagaggaguaguaggaucauuugauguauggggacaaggaacaguaguaacaguaaguagu

SEQ ID NO: 47642 - RNA, 438 nt, Artificial Sequence
  derived and/or modified sequence opt6 from anti-HIV_cap256-119-145604_VR-Chain
gacguacaauuagcagaaagugggggaggauuaguacaaccaggaggaaguuuaagauuaaguuguguagcaagcggauuuacauuuucaaguuuugaaaugcacuggguaagacaagcaccaggaaaaggacuagaauggguagcaucaauaucaaaugauggaacaaaaagauaucaugcagaaagcguaugggauagauuuaguauaaguaaagauaauaguaaaaauacauuauuuuuacaaaugaauaguuuaagaguagaagauacagcauuauauuucuguguaaaagaucaaagagaagaugaaugugaagaaugguggucagauuauuacgauuucggaagagaauuaccauguagaaaaaguagaggacuaggauuagcaggaauauuugauauguggggacauggaacaaugguaacaguaaguucg

SEQ ID NO: 47643 - RNA, 438 nt, Artificial Sequence
  derived and/or modified sequence opt6 from anti-HIV_cap256-119-143998_VR-Chain
caaguacaacuaguagaaagcggaggaggaguaguacaaccaggaaggagcuuaagauuaaguugugcagcaaguggauuuacauuuagaaauuauggaaugcacuggguaagacaagcaccaggaaaaggacuagaauggguagcaucaauaucaaaugauggaucaaaaaaauaucauggagauaguguaugggcaagauuuauaauaaguagagauaauaguaaaaauacauuauuuuuacaaaugucaaguuuaagagcagaagauacagcauuauauuuuuguguaaaagaucaaagagaagaugaaugugaagaaugguggucagacuauuaugauuucggaagagaauuaccauguagaaaaucaagaggacuaggauuagcaggaauauuugauauguggggacauggaacaaugguaacaguaaguuca

SEQ ID NO: 47644 - RNA, 438 nt, Artificial Sequence
  derived and/or modified sequence opt6 from anti-HIV_cap256-119-143441_VR-Chain
gaaguacacuuaguagaaagcggaggaggacuagcacaaccaggaagaaguuuaagauuaagcugugcagcaagccaauucaauuucgcaaguuauggaaugcacuggguaagacaagcaccaggaaaaggauuagaauggguagccucaauaucgaacgauggaacgaaaagauaccaugcagaaagcguaugggauagauuuagcauaagcaaagacaauagcaaaaacacauuauuucuacaaaugaauaguuuaagaguagaagauacagcgcuauauuucuguguaaaagaccaaagagaagacgaaugcgaagaaugguggucagacuauuacgauuucggaagagaauuaccaugcagaaaaucaagaggacuaggacuagcaggaauauucgauauguggggacauggaacaaugguaacaguaaguuca

SEQ ID NO: 47645 - RNA, 432 nt, Artificial Sequence
  derived and/or modified sequence opt6 from anti-HIV_cap256-119-141307_VR-Chain
caaguacauuuaguagaaaguggaggaggaguaguacaaccaggaagaagucuaagauuaagcugugcagcaagccaauuuacauuuaauagauauggauuacauuggguaagacaagcaccaggaaaaggauuagaauggguagcaggaauaucguaugauggaagagauaaauaucaugcacauuuuguauggggaagauuuauaauaaguagagauaauaguaaaaauacacuauaucuacaaaugaauagcuuaagagcagaagauacagcauuauauuauuguguaagagaucuaagagaaagugaaugugaauuaugggaaucagauuauuaugauuucgggaaaagauuaccauguguaaaaccaagaggaguagcaggaacauuugauuuauggggacaaggaacaaugguaacaguaaguuca

SEQ ID NO: 47646 - RNA, 432 nt, Artificial Sequence
  derived and/or modified sequence opt6 from anti-HIV_cap256-119-140896_VR-Chain
gaaguaaaacuaguagaaaguggaggaggacuaguacaaccaggaggaaguuuaaaauuaagcugugcagcaagcggauucacauucucauacuaugcaaugcacuggguaagacaagcaccaggaaaaggacuagaauggguagcaguaauaucauacgauggaucagacaaauacuaugcagauagcguaaaaggaagauuuacaauaagcagagacaauagcaaaaauacacuacaucuacaaaugaauagcuuaagaccagaagauacagcauuauauuucugugcaagagacuuaagagaaagcgaaugcgaagaaugggaaucauacuauuacgauuucggaaaaaaaggaccaugcguaaaaccaagaggaguaguaggaguacuagauauauggggacaaggaacacuaguaacaguaagcagu

SEQ ID NO: 47647 - RNA, 432 nt, Artificial Sequence
  derived and/or modified sequence opt6 from anti-HIV_cap256-119-140090_VR-Chain
gaaguacaauuaguagaaaguggaggaggauuaguacaaccaggaggaaguuuaagauuaagcugugcagcaaguggauuugcauuuaguaguuauuggaugacauggguaagacaagcaccaggaaaaggauuagaauggguagcaguaauaaguuaugauggaaguaauaaauauuaugcagauaguguaagaggaagauuuacaauaaguagagauaguaguaaaaauacauuauauuuagaaaugaauaguuuaagaccagaagauacagcacuauauuauugugcaaaagauaugagaggauaugaaugugaagaauggacgucagauuauuaugauuuuggaagaccacaaccauguauagauaguagaggaguaguaggaacauuugauguauggggacaaggaacaaugguaacaguaaguagu

SEQ ID NO: 47648 - RNA, 438 nt, Artificial Sequence
  derived and/or modified sequence opt6 from anti-HIV_cap256-119-140037_VR-Chain
caaguacaauuaguagaaagcggaggaggauuaguacaaccaggaaggaguuuaagauuaagcugugcagcaagcggauucacauuugaugacuauguaaugcacuggguaagacaagcaccaggaaaaggacuagaauggguagcaucaauaaguaaugauggaacaaaaaaauaccaugaagaaagcguauggggaagauuuacaauaagcaaagacaauaguaaaagcacacuauuuuuacaaaugaauaguuuaagaauagaagauacagcacuauauuucuguguaaaagaccaaagagaagacgaaugugaagaaugguggucagacuauuacgauuucggaagagaauuaccaugcaggaaaucaagaggacuaggacuagcaggaauauucgauauguggggacauggaacaaugguaacaguaaguuca

SEQ ID NO: 47649 - RNA, 432 nt, Artificial Sequence
  derived and/or modified sequence opt6 from anti-HIV_cap256-119-139135_VR-Chain
gaaguacaauuaguagaaaguggaggaggaguaguaagaccaggaggaaguguaagauugaguuguguagcaaguggauuuaguuuuagaaguuauggaaugcauuggguaagacaagcaccaggaaaaggacuagaauggguagcaaguauaaguuaugauggaagagauuuuuaucaugcaagaaguguauggggaagauuuacaauaaguagagauaauaguaaaaauacauuacauuuacaaaugaauaguuuaaggccagaagauacagcauuauauuuuugugcaagagauuuaagagaaagugaaugugaagaaugggaaucauauuauuaugauuuuggaaaaaaaggaccauguguaaaaccaagaggaguaguaggaguauuagauauauggggacaaggaacauuaguaacaguaaguuca

SEQ ID NO: 47650 - RNA, 438 nt, Artificial Sequence
  derived and/or modified sequence opt6 from anti-HIV_cap256-119-137881_VR-Chain
caaguacaauugguagaaagcggaggaggauuaguaaaaccaggaagaaguuuaacauuaaguugugcagcaagucaauucacauuuucaaauuauggaaugcacuggguaagacaagcaccaggaaaaggacuagaauggguagcaucaauaucaaaugauggaaauaaaaaauaucauggagauagcguaugggcaagauuuacaauaagcagagacaauagcaaaaacacauuauuuuuacaaaugucaaguuuaagaacagaagauacagcauuauauuucuguguaagagacagaagagaagaugaaugugaagaaugguggagugacuauuacgauuucggaagagaacuaccaugcagaaaauuuagaggacuaggacuagcaggaauauuugauauauggggacauggaacaaugguaacaguaaguagu

SEQ ID NO: 47651 - RNA, 432 nt, Artificial Sequence
  derived and/or modified sequence opt6 from anti-HIV_cap256-119-137643_VR-Chain
gaaguacaauuaguagaaaguggaggagaucuaguacaaccaggaggaaguuuaagauuaagcugugcagcaagcggauucucauucucaagcuauggaaugcacuggguaagacaagcaccagauaaaggacuagaauggguaacaguaauaucauacgauggaucaaacaaacacuaugcagauagcguaaaaggaagauuuacaauaagcagagacaauagcaaaaacacacuauaucuagaaaugaauacauuaagagcagaagauacagcacuauauuacugugcaaaagacuuaagagaauacgaaugugaagaauggacaucagacuauuacgauuucggaagaccacaaccaugcauagacucaagaggaguaguaggaauacuagauauauggggacaaggaacaaugguaagcguaaguuca

SEQ ID NO: 47652 - RNA, 438 nt, Artificial Sequence
  derived and/or modified sequence opt6 from anti-HIV_cap256-119-137170_VR-Chain
caagugcaauuaguagaaaguggaggaggaguaguacaaccaggaagaaguuuaagauuaagcugugcagcaagcgaauuuacauucucaagauauagcaugcacuggguaagacaagcaccaggaaaaggacuagaauggguagcagugauaucaagugauggaucaaaccaauuccaugcagauagcguauggggaagauucacaauaagcaaagacaauagcaaaaacacacuauuuuuacaaaugaauagcuuaagaauagaagauacagcacuauauuucuguguaaaagaccaaagagaagacgaaugcgaagaaugguggucggacuauuacgauuucggaagagaacuaccaugcagaaaaucaagaggacuaggacuagcaggaauauucgauauguggggacauggaacaaugguaacaguaagcuca

SEQ ID NO: 47653 - RNA, 432 nt, Artificial Sequence
  derived and/or modified sequence opt6 from anti-HIV_cap256-119-136616_VR-Chain
caaguacaauuaguagaaagcggaggaggaguaguacaaccaggaagaucauuaagauuaagcugugcagcaagcggauucacauucagcagaaaugcaauaaacuggguaagacaagcgccagggagaggauuagaauggguagcaguaauaucagacgauggaucacuaaaauacuaugcagauagcguaaaaggaagauuuacaauaagcagagacaauagcaaaaacacacuauaucuacaaaugaauaacuuaagaccagaagauacagcauuauauuacuguguaagagacagaagagaaagcgaaugcgaagaaagauggucagacuauuacgauuucggaaaacaacuaccaugcguaaaaccaagaggaguagcaggaauauucgauauauggggacaaggaacaaugguaacaguaagcuca

SEQ ID NO: 47654 - RNA, 432 nt, Artificial Sequence
  derived and/or modified sequence opt6 from anti-HIV_cap256-119-136206_VR-Chain
caaguacaauuaguagaaagcggaggaggaguaguacaaccaggaagaaguuuaagauuaagcugugcagcaagucaauuuacauucggaagauauggaaugcauuggguaagacaagcaccaggaaaaggacuagaauggguagccgcaauaucauuugcaggaacaaaaaaauacuauggagauagugcaagaggaagauuuacaauaagcagagacaauagcaaaaacaugcuauuucuacaaaugaauaguuuaagagcagaagauacagcauuauauuacugugcaagagauuuaagagauuaugaaugugaagaaugggaagcauacuauuacgauuuuggaagaguaggaccauguacagacccaagaggaguaguaggaauauuagauguauggggacaaggaacacuaguaacaguaagcuca

SEQ ID NO: 47655 - RNA, 438 nt, Artificial Sequence
  derived and/or modified sequence opt6 from anti-HIV_cap256-119-135565_VR-Chain
caaguacauuuaguagaaaguggaggaggaguaguacaaccgggaaaaaguuuaagauuaaguugugcagcaagucaauuuacauuugauagauauggaaugcauuggguaagacaagcaccgggaaaaggauuagaauggguagcaaguauaaguaaugauggaacagauaaauaucaugcagauaauguauggggaagauuuacaauaaguagagauaauaguaaaaauacauuauauuuagaaaugaauaguuuaagaggagaagauacagcauuauauuuuuguguaaaagaucaaagagaagaugaaugugaagaaugguggagugauuauuaugauuuuggaagagaacuaccauguagaaaaaguagaggacuaggauuagcaggaauauuugauauguggggacauggaacaaugguaacaguaaguagu

SEQ ID NO: 47656 - RNA, 432 nt, Artificial Sequence
  derived and/or modified sequence opt6 from anti-HIV_cap256-119-135025_VR-Chain
gaaguacaauuaguagaaagcggaggaggauuaguacaaccaggaggaaguuuaagauuaagcugugaagcaagcggauuuacauuuaauacauaugaaaugaauuggguaagacaaccaccaggaagaggauuagaauggguagcaggaauaaguuuugcagcaacaaaaacauauuauggaggaaguguaaaaggaagauuuacaguaaguagagauauaaguaaaaauacauuauauuuacaaauggauggauuaagaggagaagauacagcauuauauuauugugcaaaagauuuaagagaauuagaaugugaagaaugggcaagugauuauuaugauuuuggaagaccacaaccauguuuagauccaaggggaguaagcggaauaaguaauguauggggacaaggaacaaugguaacaguaaguagu

SEQ ID NO: 47657 - RNA, 432 nt, Artificial Sequence
  derived and/or modified sequence opt6 from anti-HIV_cap256-119-133983_VR-Chain
caaaugcaauuaguagaaagcggaggaggaguaguacaaccaggaagaaguuuaacauuaaguugugcagcaagccaauucaauuucgcaaacuauggaaugcacuggguaagacaagcaccaggaaaaggacuagaauggguagcaucaauaucaaacgauggaacaaaaaaauaccaugaagaaagcguauggggaagauuuacaauaagcaaagacaauagcaaaaacacacuauuucuacaaaugaauagcuuaagaccagaagauacagcauuauauuacugugcaaaagacuuaagagaagacgaaugcgaagaaagauggucagacuauuacgauuucggaaaacaauuaccaugcagaaaaucaagaggaguagcaggaguauucgauaacuggggacaaggaacaaugguaacaguaagcuca

SEQ ID NO: 47658 - RNA, 438 nt, Artificial Sequence
  derived and/or modified sequence opt6 from anti-HIV_cap256-119-133917_VR-Chain
caaaugcaauuaguagaaagcggaggaggaguaguacaaccaggaagaaguuuaacauuaagcugugcagcaagccaauucacauucucaaauuauggaaugcacuggguaagacaagcaccaggaaaaggauuagaauggguagcaucaauaucaaacgauggaucaaaaaaauaccauggagauagcguaugggcaagauuuacaauaaguagagacaauaguaaaaacacacuauuucuacaaaugucaagcuuaagaguagaagauacagcauuauauuucuguguaagagaccaaagagaagaugaaugugaagaaugguggucagacuauuacgauuucggaagagaacuaccaugcagaaaauuuagaggauuaggacuagcaggaauauucgauauauggggacauggaacaaugguaacaguaaguagu

SEQ ID NO: 47659 - RNA, 432 nt, Artificial Sequence
  derived and/or modified sequence opt6 from anti-HIV_cap256-119-132663_VR-Chain
caagcacaauuaguagaaagcggaggaggaguaguacaaccaggaagaaguuuaagaauaagcugugcaguaagccaauucacauucucaagauauggaaugcacuggguaagacaagcaccaggaaaaggacuagaauggguagcaucaauaucauucgauggaagagacaaauaccauagcccacuaguauggggaagacuaacaauaagcagagacaauagcaaaaauacacuauuucuagaaaugaauaguuuaagagcagaagauacagcaguauauuacugugccagggaccuaagagaaagugaaugcgaagaauggcaaucagacuauuacgcauucuauaaaaaacuaccaugcguaaaaccaagaggaguagcaggaucacuagauaucuggggacaaggaacaguaguaacaguaagcuca

SEQ ID NO: 47660 - RNA, 438 nt, Artificial Sequence
  derived and/or modified sequence opt6 from anti-HIV_cap256-119-132113_VR-Chain
caaguacaauuaguagaaagcggaggaggacuaguaaaaccgggaggaagcuuaagauuaagcugugcagcaagccaauucaauuucgcaaacuauggaaugcacuggguaagacaagcaccagggaaaggacuagaauggguagcaucaauaucaaacgauggaacaaaaaaauaccaugaagaaagcguauggggaagauuuacaauaagcaaagacaauaguaaaagcacacuauuucuacaaaugaauagcuugagaauagaagauacagcauuauauuucuguguaaaagaccaaagagaagacgaaugcgaagaaugguggucagacuauuacgauuucggaagagaacuaccaugcagaaaaucaagaggauuaggauuagcaggaauauucgauauguggggacauggaacaaugguaacaguaagcuca

SEQ ID NO: 47661 - RNA, 432 nt, Artificial Sequence
  derived and/or modified sequence opt6 from anti-HIV_cap256-119-131839_VR-Chain
caaguacaauuaguagaaaguggaggaggaguaguacaaccaggaagaaguuuaagacuaagcugugcagcaagcggauuuacauuuaguaguuaugcaaugcauuggguaagacaagcaccaggaaaaggauuagaauggguagcaguaauaaguuaugauggaaguaauaaauauuaugcagauaguguaaaaggaagauuuacaauaaguagagauaauaguaaaaauacauuauauuuacaaaugaauagucuaagagcagaagauacagcaguauauuauugugcaagagaucaaagauauuaugaaugugaagaaugggcaagugauuauuaugauuuuggaagagaacaaccaugucaagauccaagaggaguaguaggaguauuugauauguggggacaaggaacaaugguaacaguaaguagu

SEQ ID NO: 47662 - RNA, 435 nt, Artificial Sequence
  derived and/or modified sequence opt6 from anti-HIV_cap256-119-130626_VR-Chain
gaaguacaauuaguagaaagcggaggaggauuaauacauccaggaggauguuuaagacuaaguugugcaguaaguggauuuacauuuagugauuauccaaugcauuggguaagacaaaguccaggaaaaggauuagaauggguagcaguaauaaguuaugauggaauaaauuauuauuaugcagauagcguaaaaggaagauuuacaauaagcagagauaauaguaaaaauaauuuauuuuuacaaaugaauaguuuaagauuagaagauacagcacuauauuauugugcaagagauuuaagagaauuagauugugaagaauggacauuauauaauuauuaugauuuuggaaguagaggaccauguguagauccaagaggaguaggaggaaguuuugauguaugggggcaaggaacaaugguaacaguaaguagu

SEQ ID NO: 47663 - RNA, 438 nt, Artificial Sequence
  derived and/or modified sequence opt6 from anti-HIV_cap256-119-130191_VR-Chain
gaaguacaauuaguagaaaguggaggaggacuaauacaaccaggaagaaguuuaagauuaagcugugcagcaaguggauuuacaguaaguaguaauuuuaugacauggguaagacaagcaccaggaaaaggauuagaauggguagcaaguauaaguaaugauggaacaaaaaaauaucaugcagaaaguguaugggauagauuuaguauaaguaaagauaauaguaaaaauacacuauuuuuacaaaugaauaguuugagaguagaagauacagcauuauauuuuuguguaaaagaucaaagagaagaugaaugugaagaaugguggagugauuauuaugauuuuggaagagaauuaccauguagaaaaaguagaggauuaggauuagcaggaauauuugauauguggggacauggaacaaugguaacaguaaguagu

SEQ ID NO: 47664 - RNA, 438 nt, Artificial Sequence
  derived and/or modified sequence opt6 from anti-HIV_cap256-119-129798_VR-Chain
caaguacaauuaguagaaagcggaggagggguaguacaaccaggaaaaaguuuaagauuaaguugugcagcaaguggauuuauauuuaguaguuauuuuaugcauuggguaagacaagcaccaggaaaaggauuagaauggguagcaguaguaacagaugauggaaguaaaaaauauuaugcagauaguguaaaaggaagauuuacaauaaguagagauuauaguaaaaauacauuauuuuuacaaaugaauagauuaagaguagaagauacagcauuauauuucuguguaaaagaucaaagagaagaugaaugugaagaaugguggagugauuauuaugauuuuggaagagaauuaccauguagaaaauuuagaggauuaggauuagcaggaauauuugauauguggggacauggaacaaugguaacaguaaguagu

SEQ ID NO: 47665 - RNA, 432 nt, Artificial Sequence
  derived and/or modified sequence opt6 from anti-HIV_cap256-119-128745_VR-Chain
caaguacaauuaguagaaagcggaggaggaguaguacaaccaggaagaaguuuaagauuaagcugugcagcaagcggauucacauuuucaaacuaugcaaugcacuggguaagacaagcaccaggaaaaggacuagaauggguagcaucaauaucauucgcaggaacaaaaacacacuauggaaauagcguaaaaggaagauuuagcauaaguagagacaauagcauaaacacaguauaucuacaaaugaauagcuuaagagcagaagauacagcacuauauuacugugccaaagacuuaagagaauaugaaugcgaagaauggacaucagacuauuacgauuucggaagaccacaaccgugcauagacucaagaggaguaguaggaauauuagauauauggagccaaggaacaaugguaacaguaagcuca

SEQ ID NO: 47666 - RNA, 438 nt, Artificial Sequence
  derived and/or modified sequence opt6 from anti-HIV_cap256-119-128593_VR-Chain
caaguacaauuaguagaaaguggaggaggagugguacaaccaggaagaagucuaagauuaagcugugcagcaaguggauuuacauuuaguaguuaugcaaugcauuggguaagacaagcaccagguaaaggauuagaauggguggcaaguauaaguuaugauggaagagauuuuuaucaugcaagaaguguauggggaagguuuacaauaaguagagauaauaguaaaaauacauuacauuuacaaaugaauagcuuaagaguagaagauacagcauuauauuuuuguguaaaagaucaaagagaagaugaaugugaagaaugguggagugauuauuaugauuuuggaagagaauuaccauguagaaaaucaagaggauuaggauuagcaggaauauuugauauauggggacauggaacaaugguaacaguaaguagu

SEQ ID NO: 47667 - RNA, 438 nt, Artificial Sequence
  derived and/or modified sequence opt6 from anti-HIV_cap256-119-128152_VR-Chain
caaguacaauuaguagaaagcggaggaggaguaguacaaccaggaagaaguuuaagauuaagcugugcaguaaguggauuuacauuuacaaguuauccaaugcacuggguaagacaagcaccaggaaaaggauuagaauggguagcaucaguaucaaaugauggaacaaaaaaauaucauggagauagcguaugggauagauuuacaauaagcagagacaauagcaaaaacacacuauuucuacaaaugucaaguuugagagcagaagauacagcaguauauuucuguguaagagaugaaagagaagaugaaugugaagaaugguggucagacuauuacgauuucggaagagaacuaccaugcagaaaauuuagaggauuaggauuagcaggaauauuugauauauggggacauggaacacuaguaacaguaaguuca

SEQ ID NO: 47668 - RNA, 438 nt, Artificial Sequence
  derived and/or modified sequence opt6 from anti-HIV_cap256-119-127693_VR-Chain
gaaguacaauuacuagaaaguggaggaggacuaguacaaccaggaggaaguuuaagauugagcugugcagcaaguggauuuacauuuaguaguuaugcaauggcauggguaagacaagcaccaggaaaaggauuagaauggguagcaaguauaaguaaugauggaaguaaaaaauaucauggagauaguguaugggcaagauuuauaauaaguagagauaauaguaaaaauacauuauuuuuacaaaugaguagcuuaagaguagaagauacagcauuauauuuuuguguaagagaucauagagaagaugaaugugaagaaugguggagugauuauuaugauuuuggaagagaauuaccauguagaaaauuuagaggauuaggauuagcaggaauauuugauauauggggacauggaacaaugguaacaguaaguagu

SEQ ID NO: 47669 - RNA, 432 nt, Artificial Sequence
  derived and/or modified sequence opt6 from anti-HIV_cap256-119-126684_VR-Chain
caaguacaauuaguagaaaguggaggaggagcaguaagaccaggaagaaguuuaagauuaaguugugcaacaaguggauuuacauuuaguaauuaugcaaugcauuggguaagacaagcaccaggaaaaggauuagaauggguaacaggaauaucauuugcaggaacaaaaacauauuauggagauaguguaagaggaagauuuacaguaaguagagauauaaguaaaaauacauuauuuuuacaaaugaauaguuuaagaccagaugauacagcaauguauuauugugcaagagaucaaagauauuaugaaugugaagaaugggcaagugauuauuaugauuuuggaagagaacaaccauguuuagauccaagaggaguaguaggaauauuugauuuauggggacaaggaacaaugguaacaguaaguagu

SEQ ID NO: 47670 - RNA, 438 nt, Artificial Sequence
  derived and/or modified sequence opt6 from anti-HIV_cap256-119-126056_VR-Chain
gaaguacaauuaguagaaagcggaggaggacuaguacaaccaggaggaaguuuaagauuaaguugugcagauaguggauucacauucaguagcuauuggaugagcuggguaagacaagcaccaggaaaaggacuagaauggguagcaucaauaucaaacgauggaacaaaaaaauaccaugcagaaagcguaugggauagauuuagcauaagcaaagacaauagcaaaaacacacuauuucuacaaaugaauagcuuaagaguagaagauacagcacuauauuucuguguaaaagaccaaagagaagacgaaugcgaagaaugguggucagacuauuacgauuucggaagagaacuaccaugcagaaaaucaagaggacuaggauuagcaggaauauucgauauguggggacauggaacaaugguaacaguaaguuca

SEQ ID NO: 47671 - RNA, 432 nt, Artificial Sequence
  derived and/or modified sequence opt6 from anti-HIV_cap256-119-125765_VR-Chain
caaguacaauuaguacaaagcggaggaggaguaguacaaccaggaagaagucuaagauuaagcugugcagcaaguggauucacauucucaaguuauguaaugcacuggguaagacaagcaccaggaaaaggacucgaaggaguagcaguaauaucauucgauggaaauaacgaauacuaugcagauagcguaaaaggaagauuuacaauaagcagagacaauagcaaaaacacaguauaucuacaaaugaauagccuaagaguagaagauacagcauuauauuacugugcaaaagacaugagagaauacgaaugcgaagaauggacaucagacuauuacgauuucggaagaccacaaccaugcauagacucaagaggaguaguaggaauacuagauauauggggacaaggaauaaugguaacaguaagcuca

SEQ ID NO: 47672 - RNA, 438 nt, Artificial Sequence
  derived and/or modified sequence opt6 from anti-HIV_cap256-119-125106_VR-Chain
caaguacaauuaguagaaaguggaggaggaguaguacaaccaggaaggaguuuaagauuaaguugugcagcaaguggauuuauauuuagaaguuauggaaugcauuggguaagacaagcaccaggaaaaggauuagaauggguggcaaguauaaguaaugauggaacaaaaagauaucaugcagaaaguguaugggauagauuuaguauaaguaaagauaauaguaaaaauacauuauuuuuacaaaugaauaguuugagaguagaagauacagcauuauauuuuuguguaaaagaucaaagagaagaugaaugugaagaaugguggagugauuauuaugauuuuggaagagaauuaccauguagaaaaaguagaggauuaggauuagcaggaauauuugauauguggggacauggaacaaugguaacaguaaguagc

SEQ ID NO: 47673 - RNA, 435 nt, Artificial Sequence
  derived and/or modified sequence opt6 from anti-HIV_cap256-119-124026_VR-Chain
caaguacaauuaguagaaaguggaggaggaguaguacaaaguggaagaaguuuaagauuaacauguaguggaagugcauuuagauuuaguaguuauacaguacauuggguaagacaagcaccaggaaaaggauuagaaugguuagcauuaauaaguuaugauggacaaaaaaaacauuuugcagauaguguaaaaggaagauuuacaauaaguagagauaauagcaaaaauaauuuauuuuuacaaaugaauaguuuaagauuagaagauacagcauuauauuauugugcaagagauuuaagagaauuagauugugaagaauggacauuauauaauuauuaugauuuuggaaguagaggaccauguguagacccaagaggaguaggaggaaguuuugauguauggggacaaggaacaaugguaacaguaaguagc

SEQ ID NO: 47674 - RNA, 432 nt, Artificial Sequence
  derived and/or modified sequence opt6 from anti-HIV_cap256-119-121783_VR-Chain
cuaggaagauuaguagcaagcggaggaggaguaguaccaccaggaggaaguuuaacauuaagcuguguaacaagucaauucacauucaguggauguggauuacacuggguaagacaagcaccaggaaaaggacuagaauggguagcaucaauaucauuugcaggaacaaaaaaacauuauggaucaaguguaagaggaagauuuagcauaaguagagacaauaguaaaaauacacuauaucuacaaaugaauaguuuaagaacagaagauacagcguuauauuucugugcaaaagacuuaagagaauaugaaugugaagaauggacaucagacuauuaugauuucggaagaccacaaccaugcauagacucaagaggaguaguaggaauacuagauauauggggacaaggaacaaugguaacaguaaguuca

SEQ ID NO: 47675 - RNA, 432 nt, Artificial Sequence
  derived and/or modified sequence opt6 from anti-HIV_cap256-119-121208_VR-Chain
uuaggaagauuaguagcaagcggaggaggaguaguaccaccaggaaaaaguuuaacauuaagcuguguagcaagccaauucacauuuucaggauguggauuacacuggguaagacaagcaccaggaaaaggacuagaauggguagcaucaauaucauuugcaggaacaaaaaaacacuauggaaauuucguacgaggaagauuuacaauaagcagagacaauaguaaaaacacacuauauuuacaaaugaauagcuuaagagcagaagauacagcacuauauuacugugcaaaagaccuaagagaauaugaaugugaagaauggacaagugacuauuacgauuucggaagaccacaaccauguauagacucaagaggaguaguaggaauauuagauauauggggacaaggaacaaugguaacagugaguuca

SEQ ID NO: 47676 - RNA, 432 nt, Artificial Sequence
  derived and/or modified sequence opt6 from anti-HIV_cap256-119-120945_VR-Chain
caaguacaauuaguagaaagcggaggaggaguaguacaaccaggaggaagucuaagauuaagcuguguagcaagcggauuuacauucucaaauuauggaaugcacuggguaagacaagcaccaggaaaagggcuagcguggguagcauuuauaagauaugauggaucaaacaaauacuauguagauagcguauggggaagauuuacaauaagcagagacaauagcaaaaacacacuacauuuacaaaugaauaguuuaagaccagaagauacagcauuauauuucugugcaagagacuuaagagaaagugaaugugaagaaugggaaucauacuauuacgauuucggaaacaaaggaccaugcguaaaaccaagaggaguaguaggaguauuagauauauggggacaaggaacauuaguaacaguaaguuca

SEQ ID NO: 47677 - RNA, 432 nt, Artificial Sequence
  derived and/or modified sequence opt6 from anti-HIV_cap256-119-118229_VR-Chain
caaguacaaguaguagaaagcggaggaggaguaguacaaccaggaagaagccuaagauuaagcugugcagcaagcggauucacauucucaaacuaugcaauacacuggguaagacaagcaccaggaaaaggacuagaauggguagcauuaauaucauacgauggauauaacaaauacuaugcagauagcguaagaggaagauuuacaauaagcagagacaauagcaauaacacaguauauuuacaaaugaauagcuuaaaaccagaagauacagcagucuauuacugugcaagagacuuaagagaaagcgaaugcgaagaaugggaaucauacuauuacgacuucggaaaaaaaggaccaugcguaaaaccaagaggaguaguaggaguacuagauauauggggacaaggaacacuaguaacaguaagcuca

SEQ ID NO: 47678 - RNA, 432 nt, Artificial Sequence
  derived and/or modified sequence opt6 from anti-HIV_cap256-119-118025_VR-Chain
gaaguacaauuaguagaaagcggaggaggaguaguacaaccaggaaaaagccuaagauuaaguuguacagcaagccaauucacauucucaaacuuuggaaugcacuggguaagacaagcaccaggaaaaggauuagaauggguagcaucaauaucauucguaggaauaaaaacacacuaugcaaauagcguaagaggaagauuuacaauaagcagagaccaaagcaaaaacacacuauaucuacaaaugaauagcguaagaauagaagauacagcaagauauuucugugcaagagacaugagagaauacgaaugcgaacuaugggcaucggacuauuacgauuucggaaaaccacaaccaugcgaagacccaagaggaguaguaggaacauucgauauguggggauuaggaacauuaguaacaguaaguuca

SEQ ID NO: 47679 - RNA, 432 nt, Artificial Sequence
  derived and/or modified sequence opt6 from anti-HIV_cap256-119-117418_VR-Chain
caaguacaauuaguagaaaguggaggaggaguaguacaaccaggaagaaguuuaagauuaaguugugcagcaaguggauuuaauuuuagaaauuaugauauaaauuggguaagacaaguaccaggaaaaggacuagaauggguagcagcaauaucauuugauggagcagauaaauaucaugcagauaauguauggggaagauuaaguauaagcagagauaauaguaaaaguacauuauauuuacaaaugaauagucuaagaccagaagauacagcaguauauuucugugcaaaagauuuaagagaagaugaaugugaagaaagauggagugauuauuaugauuuuggaaaacaauuaccauguagaaaaaguagaggaguagcaggaauauuugauaauuggggucaaggaacaaugguaacaguaagugca

SEQ ID NO: 47680 - RNA, 432 nt, Artificial Sequence
  derived and/or modified sequence opt6 from anti-HIV_cap256-119-117250_VR-Chain
caaguaagauuaguagaaaguggaggaggaguaguacaaccaggaggaaguuuaagauuaaguugugcagcaagucaauuuacauuuagugcauauggaaugcauuggguaagacaagcaccaggaaaaggauuagaauggguagcaaguauaaguuuugauggaacagauaaauuucaugcagauaaaguauggggaagauuaguaauaaguagagauaauaguaaaaauacauuauauuuacaaaugaauaguuuaagaccagaagauacagcaguauauuauugugcaaaagauuuaagagaagaugaaugugaagaaagauggagugauuauuaugauuuuggaaaacaauuaccauguagaaaaaguagaggaguagcaggaguauuugauaauuggggacaaggaacaaugguaacaguaaguagu

SEQ ID NO: 47681 - RNA, 432 nt, Artificial Sequence
  derived and/or modified sequence opt6 from anti-HIV_cap256-119-117230_VR-Chain
caaguacaauuaguagaaaguggaggaggaggaguacaaccaggaagaagcuuaagauuaaguugugcagcaaguggauuuacauuaaguaguuauggaaugcauuggguaagacaagcaccaggaaaaggacuagaauggguagcaaguauaaguuuugauggaagagauuauuaucauaguccacauguauggggaagauuaacaauaaguagggauaauaguaaaaauacauuauauuuacaaaugaauaguuuaagagcagaagauacagcauuauauuauugugcaagagauuuaagagaaagugaaugugaagaaugggaaagugauuauuaugauuuuggaaaaaaaggaccauguguaaaaccaagaggaguagcaggaaguuuagauauguggggacaaggaacaaugguaauaguaaguagu

SEQ ID NO: 47682 - RNA, 432 nt, Artificial Sequence
  derived and/or modified sequence opt6 from anti-HIV_cap256-119-116999_VR-Chain
caaguacaauuaguagaaagcggaggaggaguaguacaaccaggaacaaguuuaagaauaagcugugcagcaagccaauucacauucucaagauauggaaugcacuggguaagacaagcaccaggaaaagggcuagaauggguagcaucaauaaguuaugauggaagagacuauuaccaugcaggaagaguauggggaagauuuacaauaagcagagacaauaguaaaaacacauuauauuuacaaaugaauaguuuaagaccagaagauacagcauuauauuucuguguaagagauucaagagaaagugaaugugaagaaugggaaucagacuauuacgauuucggaaaaaaacuaccauguguaaaaccaagaggaguaguaggaguacuagaucuauggggacaaggaacacuaguaacaguaagcuca

SEQ ID NO: 47683 - RNA, 432 nt, Artificial Sequence
  derived and/or modified sequence opt6 from anti-HIV_cap256-119-116558_VR-Chain
caaguacaauuaguagaaagcggaggcggaguaguacaaccaggaagaagccuaagauuaagcugugcagcaagcggauucacauucaauagauauagcuuacacuggguaagacaagcaccaggaaaaggauuagaauggguagcauuuacaucauacgauggaucaaacaaauacuauccagauagcguaaaaggaagauuuacaauaagcagagauucaagcaaaaacacauuauaucuagaaaugaauaguuuaagaccagaagauacagcacuauauuacugugcaaaagacaugagaggauacgaaugcgaagaauggacaucagacuauuacgauuucggaagaccacaaccgugcauagacucaagaggaguaguaggaacauucgauguauggggacaaggaacaaugguaacaguaaguuca

SEQ ID NO: 47684 - RNA, 432 nt, Artificial Sequence
  derived and/or modified sequence opt6 from anti-HIV_cap256-119-116484_VR-Chain
gacguacaacuacuagaaaguggaggagaucuaguacaaccaggaggaagucuacgauuaagcugugcagcaagcggauucacauucacaaaauaugaaaugacauggguaagacaagcaccaggaaaaggacuagaauggguagcaucaauaucauacgauggaucagacaaauaccauacaagcucauuauggggaagauuuauaguaagcagagacaauaguaaaaacacacuauaucuacaaaugaauagccuaagaccagaagauacagcacuauauuacuguguaagagacagaagagaaagcgaaugcgaagaaagauggucagacuauuacgauuucgguaaacaacuaccaugcguaaaaccaagaggaguagcaggaauauucgauauauggggacaaggaacaaugguaacaguaagcuca

SEQ ID NO: 47685 - RNA, 438 nt, Artificial Sequence
  derived and/or modified sequence opt6 from anti-HIV_cap256-119-114844_VR-Chain
gaaguacaauuaguagaaagcggaggagauuuaguacaaccaggaagaagcuuaagauuaaguugugcagcaagcggauucacauucucaaguuauuggaugagcuggguaagacaagcaccaggaaaaggacuagaauggguagcaucaauaucaaacgauggaacaaaaaaauaccaugaagaaagcguauggggaagauuuacaauaagcaaagacaauagcaaaagcacacuauuucuacaaaugaauaguuuaagaguagaagauacagcauuauauuucuguguaaaagaccaaagagaagacgaaugugaagaaugguggucagacuauuacgauuucggaagagaacuaccaugcagaaaaucaagaggacuaggacuagcaggaauauucgauauguggggacauggaacaaugguaacaguaagcuca

SEQ ID NO: 47686 - RNA, 438 nt, Artificial Sequence
  derived and/or modified sequence opt6 from anti-HIV_cap256-119-114141_VR-Chain
ggaggaagaaguggaggaggaggaguaggaacaacaccaagaagaggaccauuaagauuaaguugugcagcaaguggauuuacauuagaugauuaugcaaugcauuggguaagacaagcaccaggaaaaggauuagaauggguagcaaguauaaguaaugauggaacaaaaaaauaucaugcagaaaguguaugggauagauuuaguauaaguaaagauaauaguaaaaauacauuauuuuuacaaaugaauaguuuaagaguagaagauacagcauuauauuuuuguguaaaagaucaaagagaagaugaaugugaagaaugguggagugauuauuauguauuuugggaaagggcaccauguagaacaguaccaggaagaggaccaggaugguauuuugauaugguaggaagaagaacaaugguaacaguaaguagu

SEQ ID NO: 47687 - RNA, 432 nt, Artificial Sequence
  derived and/or modified sequence opt6 from anti-HIV_cap256-119-111917_VR-Chain
gaaguacauuuaguagaaagcggaggaggauuaguacaaccaggaggaaguuuaagauuaaguugugcagcaaguggauuuacauuuaguaguuauggaaugcauuggguaagacaagcaccaggaaaaggauuagaauggguagcaacaauaaguuuugauggagcagauaaauaucaugcagaugauguauggggaagauuuaguauaaguagagauaauaguaaaaauacauuauauuuacaaaugaauaaucuaagaccagaagauacagcauuauauuauugugcaaaagauuuaagagaagaugaaugugaagaaagauggagugauuauuaugauuuuggaaaacaauuaccauguagaaaaaguagaggaguagcaggaguauuugauaauuggggacaaggaacaaugguaacaguaaguagu

SEQ ID NO: 47688 - RNA, 432 nt, Artificial Sequence
  derived and/or modified sequence opt6 from anti-HIV_cap256-119-111862_VR-Chain
caaguacaauuaguagaaagcggaggaggaguaguacaaccaggaggaaguuugagauuaagcugugcagcaaguggauucacauauucagacuauggaaugcacuggguaagacaagcaccaggaaaaggacuagaauggguagcaaguauaucauuugcaggaacaaaacaacacuauggaaauagcguaaaagggagauuuacaauaagcagagacaauaguaaaaacacaguauaucuacaaaugaauaguuuaagaguagaagauacagcacuauauuacugugcaaaagacaugagagaauaugaaugugaagaauggacaucagacuauuacgauuucggaagaccacaaccauguauagacucaagaggaguaguaggaauauuagauauauggggacaaggaauaaugguaacaguaaguuca

SEQ ID NO: 47689 - RNA, 432 nt, Artificial Sequence
  derived and/or modified sequence opt6 from anti-HIV_cap256-119-110064_VR-Chain
cucggaagauuaguagcaagcggaggaggaguaguaccaccaggaagaaguuuaagauuaagcuguguagcaagucaauucacauuuucaggauguggauuacacuggguaagacaagcaccaggaaaaggauuagaauggguagcaucaauaucauuugcaggaacaaaacaacauuauggaaauaguguaaaaggaagauuuacaauaaguagagacaauagcaaaaauacaguauaucuacaaaugaauaguuuaagaguagaagauacagcauuauauuacugugcaaaagauaugagagaauaugaaugugaagaauggacaucagacuauuacgauuucggaagaccacaaccaugcauagacucaagaggaguaguaggaauacuagauauauggggacaaggaacaaugguaacaguaaguuuu

SEQ ID NO: 47690 - RNA, 432 nt, Artificial Sequence
  derived and/or modified sequence opt6 from anti-HIV_cap256-119-109192_VR-Chain
caaguacaauuagucgaaagcggaggaggaguaguacaaccaggaagaucauuaagauuaagcugugcagcaagcggauucacauucagcaacuaugcaaugcacuggguaagacaagcaccaggaaaaggacuagaauggguagcagugauagcauacgauggagauaacaaauacuaugcagauagcguaaaaggaagauuuacaauaagcagagacaauaguaaaaacacacuauaucuacaaaugaauagcuuaagagcagaagauacagcguuauauuacugugcaaaagacuuaagagaagacgaaugugaagaaugguggucagacuauuacgaucuaggaaaacaauuaccaugcagaaaaucaagaggaguagcaggaguauuagauaaauggggauuaggaacaaugguaacaguaagcuca

SEQ ID NO: 47691 - RNA, 435 nt, Artificial Sequence
  derived and/or modified sequence opt6 from anti-HIV_cap256-119-108793_VR-Chain
caauuccaauuaguagaaucaggaggaggaguaguacaaccaggaagaucacuaagacuaucaugcgcagcaucaggauuuacauuuagcucauacccaaugcauuggguaagacaagcaccaggaaaaggacuagaauggguagcacuaauaagcuaugacggaacagauaaauauuacgcagacucaguaaaaggaagauucacaauaucaagagauaacucgaaaaauacauuauacuuacaaaugaacucacuaagaguagaagacacagcaguauaccauugcgcaaaagaucuaggaggaucaaaaucugacgaaugggcaacagauuacuauuacgauuggucaaaagcauacccaguacaugacccaagagcaguaguaggaguauucgauauauggggacaaggaacauuaguaacaguaagcuca

SEQ ID NO: 47692 - RNA, 432 nt, Artificial Sequence
  derived and/or modified sequence opt6 from anti-HIV_cap256-119-108127_VR-Chain
caaguacaauuaguagaaaguggaggaggaguaguacaaccaggaagaaguuuaagaauaagcugugcagcaagucaauuuacauuuaauagauauggaaugcauuggguaagacaagcaccgggaaaaggauuagaauggguagcaaguauaaguuaugauggaagugauaaauaucaugcaggauuaguauggggaagauuuauaauaaguagagauaauaguaaaaauacauuauauuuacaaaugaauaguuugagagcagaagauacagcauuauauuauuguguaagagauagaagagaaagugaaugugaagaaagauggagugauuauuaugauuuuggaaaacaauuaccauguguaaaaccaagaggaguagcaggaauauuugauauauggggacaaggaacaaugguaacaguaaguagu

SEQ ID NO: 47693 - RNA, 438 nt, Artificial Sequence
  derived and/or modified sequence opt6 from anti-HIV_cap256-119-107758_VR-Chain
gaaguacaauuaguagaaaguggaggaggauuaguaaaaccaggaggaaguuuaagauuaaguugugcagcaaguggauuuacauuuaguaaugcauggaugaguuggguaagacaagcaccaggaaaaggauuagaauggguagcaaguauaaguaaugauggaacaaaaaaauaucaugaagaaaguguauggggaagauuuacaauaaguaaagauaauaguaaaaauacauuauuuuuacaaaugaauaguuuaagaauagaagauacagcauuauauuuuuguguaaaagaucaaagagaagaugaaugugaagaaugguggagugauuauuaugauuuuggaagagaauuaccauguaggaaaaguagaggauuaggauuagcaggaauauuugauauguggggacauggaacaaugguaacaguaaguagu

SEQ ID NO: 47694 - RNA, 432 nt, Artificial Sequence
  derived and/or modified sequence opt6 from anti-HIV_cap256-119-107209_VR-Chain
gaaguacaauuaguagaaagcggaggaggauuaguacaaccaggaagaaguuuaagauuaagcuguacagcaaguggauuuacauuuggagauuauggaaugcauuggguaagacaagcaccaggaaaaggauuagaauggguagcagcaauaaguuuugauggagcagauaaauaucaugcagauaauguauggggaagauuaaguauaaguagagauaauaguaaaaguacauuauauuuacaaaugaauagcuuaagaccagaagauacagcaguauauuuuugugcaaaagauuuaagagaagaugaaugugaagaaagauggagugauuauuaugauuuuggaaaacaauuaccauguagaaaaaguagaggaguagcaggaauauuugauaauuggggacaaggaacaaugguaacaguaagugca

SEQ ID NO: 47695 - RNA, 432 nt, Artificial Sequence
  derived and/or modified sequence opt6 from anti-HIV_cap256-119-107184_VR-Chain
caagcacaauuaguagaaaguggaggaggaguaguacaaccaggaagaaguuuaggauuaaguugugcagcaagcaaauuuaguuuaucaaguuauggaaugcauuggguaagacaagcaccaggaagaggauuagaauggguagcaggaauaaguuuugcaggaacaaaaaaauauuaugcagauaguguaagaggaagauuuaguguaaguacagauauaaguaaaaauacauuauauuuacaaaugaauaguuuaagaccagcagauacagcauuauauuuuugugcaagagauuuaagauauuaugaaugugaagaaugggcaagugacuauuaugauuuuggaaaagaacaaccauguuuagauccaagaggaguaguaggaauauuugauuuauggggacaaggaacaaugguaacaguaaguagu

SEQ ID NO: 47696 - RNA, 438 nt, Artificial Sequence
  derived and/or modified sequence opt6 from anti-HIV_cap256-119-106827_VR-Chain
gcaguacaauuaguagaaaguggaggaggauuaguacaaccaggaggaaguuuaagauuaagcuguaguguaagccaauuuacguuuggaagauauggaauguauuggguaagacaagcaccaggaaaaggauuagaauggguagcaguaauaaguuaugauggagggaauagauauuaugcagauagugugaaaaauagauuuaguauaaguagagauaauaguaaaaauacauuauuuuuacaaaugucaaguuuaagagcagaagauacagcauuauauuuuuguguaagagaucauagagaagaugaaugugaagaaugguggagugauuauuaugauuuuggaagagaauuaccauguagaaaauuuagagggcuaggauuagcaggaauauuugauauauggggacauggaacaaugguaacaguaaguagu

SEQ ID NO: 47697 - RNA, 432 nt, Artificial Sequence
  derived and/or modified sequence opt6 from anti-HIV_cap256-119-106511_VR-Chain
caaguacaauugguagaaaguggaggaggaguaguacaaccaggaagaaguuuaagauuaaguuguguagcaagucaauuuaguuuugauagauauggaaugcauuggguaagacaagcaccaggaaaaggauuagaauggguagcaaguauaucauuugauggaacagauaaauaucaugcagauaaaguauggggaagauuuacaauaagcagagauaauagcaaaaauacauuauauuuacaaaugaauaguuuaagaccagaagauacggcauuauauuauugugcaaaagauaugagagaagaugaaugugaagcaugguggagugauuauuaugauuuaggaaaacaauuaccauguagagaaaguagaggaguagcaggaauauuugaugaauggggacaaggaacaaugguaacaguaaguagc

SEQ ID NO: 47698 - RNA, 432 nt, Artificial Sequence
  derived and/or modified sequence opt6 from anti-HIV_cap256-119-106327_VR-Chain
caaguacaauuaguagaaaguggaggaggaguaguacaaccaggaagaaguuuaagauuaaguugugcagcaagcggauuuacauuuaguaguuaugcaaugcauuggguaagacaagcaccaggaaaaggacuagaauggguagcagcaauaagcggaggaggaggaaauacauauguagcagauagcguaaaaggaagauuuacaauaaguagagacaauaguaaaaauacaguauaccuacaaaugaauaguuuaagauuagaagauacagcguuauacuauugugcaaaagauuuaagagaauaugaaugugaagaauggacaagugauuauuaugauuuuggaagaccacaaccauguauagauaguagaggaguaguaggaauauuagauauauggggacaaggaacaaugguaacaguaaguagu

SEQ ID NO: 47699 - RNA, 438 nt, Artificial Sequence
  derived and/or modified sequence opt6 from anti-HIV_cap256-119-105486_VR-Chain
caaguacaauuaguagaaaguggaggaggaguaguacaaccaggaggaaguuuaagauuaaguugugcagcaaguggauuuacaguaaguggauauggaaugcauuggguaagacaagcaccagcaaaaggauuagauuggguagcauuuauaagucaugauggaaguaauaaauauuaugcagauaguguaagaggaagauuuauaauaaguagagauaauaguaauaauacauuauauguacaaaugaguaguuuaagagcagaagauacagcauuauauuuuuguguaagggaucauagagaagaugaaugugaagaaugguggagugauuauuaugauuuuggaagagaauuaccauguagaaaauuuagaggauuaggauuagcaggaauauuugauauauggggacauggaacaaugguaacaguaaguagu

SEQ ID NO: 47700 - RNA, 432 nt, Artificial Sequence
  derived and/or modified sequence opt6 from anti-HIV_cap256-119-105197_VR-Chain
caaguacaauuaguagaaagcggaggaggaguaguacaaccaggaaggagcuuaagauuaagcugugcaguaagccaauucacauucggaagauauggaaugcacuggguaagacaagcaccagggaaaggacuagaauggguaggaaguauaucauacgauggaucagacaaauaccauacaaauagcuuauggggaagauuuauaguaagcagagacaauaguaaaaacacauuauaucuacaaaugaauaacuuaagaccagaagauacagcauuauauuacuguguaagagacagaagagaaagugaaugcgaagaaagauggucagacuauuacgauuucggaaaacaacuaccaugcguaaaaccaagaggaguaguaggaguacuagauauauggggacagggaacauuaguaacaguaagcuca

SEQ ID NO: 47701 - RNA, 432 nt, Artificial Sequence
  derived and/or modified sequence opt6 from anti-HIV_cap256-119-104946_VR-Chain
caagaacaauuaguagaaagcggaggaggaguagugcaaccaggaagaaguuuaagauuaaguuguguagcaaguagauuuacauuuagugcauuuggaaugcauuggguaaggcaagcaccaggaaaaggauuagaauggguagcaaguauaaguuuugcaggaauaaaaaaauauuauggagauaguguaaaagggagauuuacaauaaguagagauaauaguaaaaauacauuauauuuacaaauggauggauuaagaggagaagauacagcauuauauuauugugcaaaagauuuaagagaauuagaaugugaagaaugggcaagugauuauuaugauuuuggaagaccacaaccauguauagauaguagaggaguaguaggaauauuagauauauggggacaaggaauaaugguaacaguaaguagu

SEQ ID NO: 47702 - RNA, 432 nt, Artificial Sequence
  derived and/or modified sequence opt6 from anti-HIV_cap256-119-103667_VR-Chain
caaguacauuuaguagaaaguggagguggaguaguacaaccaggaaaaaguuuaagauuaagcugugcagcaagucaauuuacauuuaauagauuuggaaugcacuggguaagacaagcgccaggaaaaggacuagaauggguagcaggaauaucauaugauggaucagauaaauaucaugcagauaaaguauggggaagauuuacaauaagcagagacaauaguaaaaauacacuauauuuacaaaugaauaguuuaagagcagaagauacagcacuauauuacugugcaaaagaccuaagagaagaugaaugugaagaaugggcaucagacuauuaugauuucggaaaagaacaaccauguuuagacccaagaggaguaguaggaauauuugauauauggggacaaggaacaaugguaacaguaaguuca

SEQ ID NO: 47703 - RNA, 438 nt, Artificial Sequence
  derived and/or modified sequence opt6 from anti-HIV_cap256-119-103385_VR-Chain
gaaguacaauuaguagaaaguggaggaggauuaguacaaacaggaggaaguuuaagauuaagcugugcagcaaguggauuuacauuuaguagauaugauaugaauuggguaagacaagcaccaggaaaaggauuagaauggguagcaaguauaaguaaugauggaaguaaaaaguaucauggagauagcguaugggcaagauuuacaauaaguagagauaauaguaaaaauacauuauuuuuacaaaugaguaguuuaagaguagaagauacagcacuauauuuuuguguaagagaucaaagagaagaugaaugugaagaaugguggagugauuauuaugauuuuggaagagaauuaccauguagaaaauuuagaggauuaggauuagcaggaauauuugauauauggggacaugggacaaugguaacaguaaguagu

SEQ ID NO: 47704 - RNA, 438 nt, Artificial Sequence
  derived and/or modified sequence opt6 from anti-HIV_cap256-119-103267_VR-Chain
gaaguaccaucaguagaaagcggaggaggauuagugcaaacaggaggaaguuuaacauuaaguugugcagcaagucaauucacauucucaaauuauggaaugcacuggguaagacaagcaccaggaaaaggacuagaauggguagcaucaauaucaaacgauggaucaaaaaaauaccauggagauaguguaugggcaagauuuauaauaagcagagacaauaguaaaaacacacuauuucuacaaaugucaagcuuaagagcagaagauacagcacuauauuuuuguguaagagaccauagagaagacgaaugcgaagaaugguggucagacuauuacgauuucggaagagaacuaccaugcagaaaauuuagaggacuaggacuagcaggaauauucgauauauggggacauggaacaaugguaacaguaagcuca

SEQ ID NO: 47705 - RNA, 432 nt, Artificial Sequence
  derived and/or modified sequence opt6 from anti-HIV_cap256-119-103011_VR-Chain
caaguacaauuaguagaaaguggaggaggaguaguacaaccaggaggaaguuuaagauuaaguugugcaacaagcggauuuacauuuggaacauuuggaaugcauuggguaagacaagcaccaggaaaaggauuagauuggguagcagcaauaaguuuugcaggaacaaaaaaaaauuaugcagauaguguaagaggaagauuuacaauaaguagagauaguaguaaaaauacauuauauuuacaaaugaauaguuuaagaccagaagauacagcacuauauuauuguguaaaagauaugagaggauaugaaugugaagaauggacaucagauuauuaugauuuuggaagaccacaaccauguauagauaguagaggaguaguaggaacauuugauguauggggacaaggaacaaugguaacaguaaguagu

SEQ ID NO: 47706 - RNA, 438 nt, Artificial Sequence
  derived and/or modified sequence opt6 from anti-HIV_cap256-119-102072_VR-Chain
gaaguacaauuaguagaaaguggaggaggauuaguacaaccgggaggaaguuuaagaguaagcugugcaguaagcggauuuacauuuaguaauuaugaaaugaacuggguaagacaagcgccaggaaaaggacuagaauggguagcaaguauaaguaaugauggaacaaaaaaauaucaugcagaaaguguaugggauagauuuaguauaaguaaagacaauaguaaaaauacauuauuuuuacaaaugaauaguuuaagaguagaagauacagcauuauauuucuguguaaaagaucaaagagaagaugaaugugaagaaugguggagugacuauuaugauuucggaagagaauuaccauguaggaaaucaagaggacuaggacuagcaggaauauuugauauauggggacauggaacaaugguaacaguaaguagu

SEQ ID NO: 47707 - RNA, 438 nt, Artificial Sequence
  derived and/or modified sequence opt6 from anti-HIV_cap256-119-101945_VR-Chain
gaaguacaauuaguagaaagcggaggaggauuaguacaaccaggaggaaguuuaagauuaagcugugcagcaaguggauucacauuuucaaguuauguaaugcacuggguaagacaagcaccaggaaaaggacuagaauggguagcaucaauaucaaacgauggaacaaaaaaauaccaugaagaaagcguauggggaagauuuacaauaaguaaagacaauaguaaaaacacacuauuucuacagaugaauaguuuaagaauagaagauacagcauuauauuucuguguaaaagaccaaagagaagacgaaugugaagaaugguggucagacuauuacgauuucggaagagaacuaccaugcagaaaaucaagaggacuaggauuagcgggcauauucgauauguggggacauggaacgaugguaacaguaaguuca

SEQ ID NO: 47708 - RNA, 432 nt, Artificial Sequence
  derived and/or modified sequence opt6 from anti-HIV_cap256-119-101319_VR-Chain
caaguacaauuaguagaaaguggaggaggaguaguacaaccaggaaaaaguuuaagauuaaguuguguaggaagcggauuuacauuugaugauuauggaaugcauuggguaagacaagcaccagggaaaggauuagaauggguagcaaguauaaguuaugauggaagagauuuuuaucaugcaagaaguguauggggaagauuuacaauaagcagagauaauagcaaaaauacacuacauuuacaaaugaauaguuuaagaccagaagauacagcauuauauuuuugugcaagggauuugagagaaagugaaugugaagaaugggaaaguuauuauuaugauuuuggaaaaaaaggaccauguguaaaaccaagaggaguaguaggaguauuagauauauggggacaaggaacauuaguaacaguaaguagu

SEQ ID NO: 47709 - RNA, 432 nt, Artificial Sequence
  derived and/or modified sequence opt6 from anti-HIV_cap256-119-100871_VR-Chain
caaguacaauuaguagaaaguggaggaggaguaguacaaccaggagaaaguuuaagaauaaguugugcagcaagucaauuuacauuuucaagauauggaaugcauuggguuagacaagcaccaggaaaaggacuugaauggguagcaucaauaucauuugauggaagagauaaauaucauaguucauuaguauggggaagauuaacaauaaguagagauaauaguaaaagcacauuauuuuuacaaaugaauaguuuaagagcagaagauacagcauuauauuauugugcaagagauuuaagagaaagugaaugugaagaaugggaaucagauuauuaugauuuuggaaaaccacaaccaugugaagauccaagaggaguaguaggaacauuugauauguggggauuaggaacguuaguaacaguaaguuca

SEQ ID NO: 47710 - RNA, 432 nt, Artificial Sequence
  derived and/or modified sequence opt6 from anti-HIV_cap256-119-100838_VR-Chain
gaaguacaauuaguagaaagcggaggaggaguaguacaaccaggaggaucauuaagauuaagcugugcagcaagcggauucacauucagcagcuauggaaugcacuggguaagacaagcaccaggaaaaggacuagaauggguagcauuuauaagauacgauggaucaaacaaauacuaugcagauagcguaaaaggaagauuuacaauaaguagggauaauagcaaucacacacuauauaugcaacuagauaguuuaagagcagaagauacagcacuauauuacugugcaaaagacuuaagagaauacgaaugcgaagaauggacaucagacuauuacgauuucggaagaccacaaccaugcauagacucaagaggaguaguaggaauauuagauauauggagccaaggaacaaugguaacaguaaguuca

SEQ ID NO: 47711 - RNA, 438 nt, Artificial Sequence
  derived and/or modified sequence opt6 from anti-HIV_cap256-119-100025_VR-Chain
caaguacaauuaguagaaagcggaggaggaguagugcaaccaggaagaaguuuaagauuaagcugugcagcaaguguauucacauucucauauuauggaaugcacuggguaagacaagcaccaggaaaaggacuagaauggguggcauuuauaucacacgauggaucaaacaaauacuaugcagauagcguaagaggaagauuuauaauaagcagagacaauagcaauaacacacuauauguacaaaugaauaguuuaagagcagaagauacagcacuauauuucuguguaaaagaccaaagagaagacgaaugcgaagaaugguggucagacuauuacgauuucggaagagaacuaccaugcagaaaauuuagaggauuaggacuagcaggaacauucgauauauggggacauggaacgauguugauaguaagcuca

SEQ ID NO: 47712 - RNA, 432 nt, Artificial Sequence
  derived and/or modified sequence opt6 from anti-HIV_cap256-119-100000_VR-Chain
caaaugcaauuaguagaaagcggaggaggaguaguacaaccaggaagaucauuaacauuaaguugugcagcaagucaauucacauucucaaauuauggaaugcacuggguaagacaagcaccaggaaaaggauuagaauggguagcaucaauaucaaacgauggaaauaaaaaauaccauggagauagcguaugggcaagauuuacaauaagcagagacaauagcaaaaacacacuauuucuacaaaugucaaguuuaagaacagaagauacagcacuauauuucuguguaagagacagaagagaaagcgaaugcgaagaaagauggucagacuauuacgauuucggaaaacaacuaccaugcguaaaaccaagaggaguagcgggaauauucgauauauggggacaaggaacaaugguaacaguaaguuca

SEQ ID NO: 47713 - RNA, 432 nt, Artificial Sequence
  derived and/or modified sequence opt6 from anti-HIV_cap256-119-098890_VR-Chain
caaguacaauuaguagaaagcggaggaggaguaguacaaccaggagaaaguuugagaauaagcuguguagcaagucaauucacauucggaagauauggaaugcacuggguaaggcaagcaccaggaaaaggacuagaauggguagcaucaauaucauuugauggaagagacaaauaucauagcccauuaguauggggaagauuaacaauaagcagagacaauaguaaaaauacauuauuucuacaaaugaauagcuuaagaacagaagauacagcauuauauuacugugcaagagacuuaagagaaagugaaugugaagaaugggaaucagacuauuacgcauucuggagaaaauuaccauguguaaaaccaagaggaguagcaggaacacuagauauauggggacaaggaacaaugguaaguguaaguagu

SEQ ID NO: 47714 - RNA, 435 nt, Artificial Sequence
  derived and/or modified sequence opt6 from anti-HIV_cap256-119-098715_VR-Chain
caaguacaauuaguagaaaguggaggaggaguaguacaaccaggaagaaguuuaagauuaaguugugcagcaaguggauuuaguuuuaauaaucauggaaugcauuggguaagacaagcaccaggaaaaggauuagaauggguagcagggauaaguuuugcaggaauaaaaaaauauuauggaacaaguguaaaaggaagauuuacaauaaguagagauaauaguaaaaauaauuuauuucuacaaaugaauaguuuaagaguagaagauacagcauuauauuauugugcaagagauuuaagagaaauggaaugugaagaauggacauuauauaauuauuaugauuuuggaaguagaggaccauguguagauccaagaggaguaguaggaaguuuugauguauggggacaaggaacaaugguaacaguaagcagu

SEQ ID NO: 47715 - RNA, 438 nt, Artificial Sequence
  derived and/or modified sequence opt6 from anti-HIV_cap256-119-098632_VR-Chain
caaaugcaauuaguagaaagcggaggaggaguaguacaaccaggaagaaguuuaacauuaagcugugcagcaagccaauucaauuucgcaaacuaugacaugcacuggguaagacaagcaccaggaaaaggacuagaauggguagcauuuauaagauacgauggaaauaauaaauacuaugcagauagcguaaaaggaagauuuacaauaagcagagacaauagcaaaagcacacuauuucuacaaaugaauagcuuaagaauagaagauacagcacuauauuucuguguaaaagaccaaagagaagacgaaugcgaagaaugguggucagacuauuacgauuucggaagagaacuaccaugcagaaaaucaagaggacuaggacuagcaggaauauucgauauguggggacauggaacaaugguaacaguaagcuca

SEQ ID NO: 47716 - RNA, 432 nt, Artificial Sequence
  derived and/or modified sequence opt6 from anti-HIV_cap256-119-097199_VR-Chain
caaguacaauuaguagaaaguggaggaggaguaguacaaccaggaagaaguuuaagauuaaguugugcagcaaguggauuugcauuuaguaguuaugcauuucauuggguaagacaagcaccaggaaaaggauuagaauggguagcauauauaccauuucauggaaaucaacaauauuauggagauagcguaaaaggaagauuuacaauaaguagagauaauaguagagauacauuauuuuuagaaaugaauaguuuaagaccagaagauacagcauuauauuuuugugcaagagaucaaagauauuaugaaugugaagaaugggcaagugauuauuaugauuuuggaagagaacaaccauguuuagauccaagaggaguaguaggaauauuugauuuauggggacaaggaacaaugguaacaguaaguagu

SEQ ID NO: 47717 - RNA, 432 nt, Artificial Sequence
  derived and/or modified sequence opt6 from anti-HIV_cap256-119-096189_VR-Chain
caaguacaauuaguagaaaguggaggaggaguaguacaaccaggaagaaguuuaagauuaaguugugcagcaaguggauuuaaauuuggaaguuuuggaaugcauuggguaaggcaagcaccaggaaaaggauuagaauggguagcaguaauaaguuaugauggaagugauaaauauuauggaucaaguguaagaggaagauuuaguauaaguagagauaauaguaaaaauacauuauauuuacaaaugaauaguuuaagaacagaagauacagcauuauauuuuugugcaaaagauuuaagagaauaugaaugugaagaauggacaagugauuauuaugauuuuggaagaccacaaccauguauagauaguagaggaguaguaggaauacuagauauauggggacaaggaacaaugguaacaguaaguagu

SEQ ID NO: 47718 - RNA, 432 nt, Artificial Sequence
  derived and/or modified sequence opt6 from anti-HIV_cap256-119-094581_VR-Chain
caaguacauuuaguagaaaguggaggaggaguaguacaaccaggaagaagucuaagauuaaguugugcagcaaguggauuuaauuucaguaauuaugcaauacauuggguaagacaaacaccaggaaaaggauuagaauggguaacauuaauaaguaaugauggaaguaauaaauauuaugcagauaguuuaaaaggaagauuuacaauaaguagagauaauaguaaaaauacauuauauuuacaaaugaauaguuuaagagcagaagauacagcauuauauuauugugcaaaagauuuaagagaagaugaaugugaagaaugguggagugauuauuaugauuuuggaaaacaauuaccauguagaaaaaguagaggaguagcaggaauauuugauggauggggacaaggaacaaugguaacaguaaguagu

SEQ ID NO: 47719 - RNA, 432 nt, Artificial Sequence
  derived and/or modified sequence opt6 from anti-HIV_cap256-119-094200_VR-Chain
gaagugcaauugguagaaagcggaggaggacuaguacaaccaggaggaaguuuaagauuaagcugugcagcaaguggauucauauucucaagcuaugcauuacacuggguaagacaagcgccaggaaaaggacuagaauggguagcaucaauaucauucgcaggaacaaaaaaucacuauggaaauagcguaaaaggaagauuuacaauaagcagagacaauagcaaaaacacaguauaucuacaaaugaauagcuuaagagcagaagauacagcacuauauuacugugcaaaagacuuaagagaauacgaaugcgaagaauggacaucagacuauuacgauuucggaagaccacaaccaugcauagacucgagaggaguaguaggaauacuagauauauggagccaaggaacaaugguaacaguaagcuca

SEQ ID NO: 47720 - RNA, 432 nt, Artificial Sequence
  derived and/or modified sequence opt6 from anti-HIV_cap256-119-094158_VR-Chain
caaaugcaauuaguagaaagcggaggaggaguaguacaaccaggaucaagcuuaacauuaucaugugcagcaagucaauucacauucucaaacuauggaaugcacuggguaagacaagcaccaggaaaaggacuagaauggguagcaucaauaucaaaugauggaacaaaaaaauaccauggagauagcguaugggauagauuuacaauaaguagagacaauaguaaaaacacacuauuucuacaaaugaauagcuuaagagcagaagauacagcauuauauuucuguguaaaagaccaaagagaagacgaaugcgaagaaugguggucagacuauuacgauuucggaaaacaauuaccaugcagaaaaucaagaggaguagcaggaauauucgauagcuggggacaaggaacgaugguaacaguaagcuca

SEQ ID NO: 47721 - RNA, 432 nt, Artificial Sequence
  derived and/or modified sequence opt6 from anti-HIV_cap256-119-092814_VR-Chain
caaguacaauuaguagaauuuggaggaggaguaguacaaccaggaggaaguuuaagauuaaguugugcagcaaguggauucuauuuuacagauuauggaaugcacuggguaagacaagcaccaggagaaggauuacaauggguagcauucauaagcuaugauggaaauacaaaaacaacagcagauaguguaagaggaagauuuacauuaagcagagacaauaguaaaaauacacuauauuuacaaaugaauagcguaagaguagaagauacagcaagauauuucugugcaagagacaugagagaauaugaaugugaauuaugggcaucagauuauuaugauuucggaaaaccacaaccaugugaagacccaagaggaguaguaggaacauuugauauguggggauuaggaacauuaguaacaguaaguuca

SEQ ID NO: 47722 - RNA, 432 nt, Artificial Sequence
  derived and/or modified sequence opt6 from anti-HIV_cap256-119-092808_VR-Chain
caaguacaauugguagaaagcggaggaggaguaguacaaccaggaagaaguuuaagauuaagcugugcagcaagccaauucucauucggaaauuauggaaugcacuggguaagacaagcaccaggaaaaggacuagaauggguagcagcaauaucauucgcaggaacaaaaacaaacuaugcagauaguguaaaaggaagauuuacaauaagcagagacaauagcaaaaacacaguauaucuacaaaugaauaguuuaagagcagaagauacagcauuauauuucugugcaaaagacauaagagaauacgaaugcgaauacuggacaucagacuauuacgauuucggaagaccacaaccaugcauagacucaagaggaguaguaggaacauucgaugucuggggacaaggaacaaugguaacaguaagcuca

SEQ ID NO: 47723 - RNA, 432 nt, Artificial Sequence
  derived and/or modified sequence opt6 from anti-HIV_cap256-119-092573_VR-Chain
caagaacaauuaguagaaaguggaggaggaguaguacaaccaggaacaaguuuaagauuaaguuguagugcaagcggauucacauucucaaauuuugcaaugaacuggguaagacaagcaccaggaaaaggauuagaauggguaagcuuuauaucaagugauggaaaaaauaaaaacuauguagauaguguaaaaggaagauuuacaauaagcagagacaauuacaaaaacacgcuauauuuacaaaugaauagcuuaagaacagaagauacagcaguauauuacugugcaaaagacuuaggaggaacaaaagacgaugaaugggcaacagauuauuacgauuggucaacagcauacccaguacaagacccaagagcaguagcaggaggauucgaucuauggggauuaggaacaaugguaacaguaaguuca

SEQ ID NO: 47724 - RNA, 432 nt, Artificial Sequence
  derived and/or modified sequence opt6 from anti-HIV_cap256-119-090815_VR-Chain
caaguacaauuaguagaaaguggaggaggaguaguagaaccaggaagaaguuuaagauuaaguugugcagcaagucaauuuaguuuuaguaguuauggaaugcauuggguaagacaagcaccaggaaaaggauuagaauggguagcagcaauaaguuuugauggagcagauaaauaucaugcagauaauguauggggaagauugaguauaaguagagauaauagcaaaaguacacuguaucuacaaaugaauaguuuaagaccagaagauacagcaguauauuuuugugcaaaagauuuaagagaagaugaaugugaagaaagauggagugauuauuacgauuuuggaaaacaauuaccauguagaaaaucaagaggaguagcaggaauauuugauaauuggggacaaggaacaaugguaacaguaagugca

SEQ ID NO: 47725 - RNA, 438 nt, Artificial Sequence
  derived and/or modified sequence opt6 from anti-HIV_cap256-119-090368_VR-Chain
caaguacaauuaguagaaagcggaggaggaguaguacaaccaggaagaucguuaagauuaagcugugcagcaagcggauucgcauucagccacuauggaauauucuggguaagacaagcaccaggaaaaggacuagaauggguagcaucaauaucaaacgauggaacaaagaaauaccaugcagaaagcguaugggauagauuuagcauaagcaaagacaauagcaaaaacacacuauuucuacaaaugaauaguuuaagaguggaagauacagcacuauauuucuguguaaaagaccaaagagaagacgagugcgaagaaugguggucagacuauuacgauuucggaagagaacuaccaugcagaaaaucaagaggacuaggacuagcaggaauauucgauauguggggacauggaacaaugguaacaguaagcuca

SEQ ID NO: 47726 - RNA, 432 nt, Artificial Sequence
  derived and/or modified sequence opt6 from anti-HIV_cap256-119-089710_VR-Chain
caaguacaauuaguagaaaguggaggaggaguaguacaaccaggaagaaguuuaagauuaaguuguacagcaaguggauuuggauuuaguaauuaugcaaugcauuggguaagauuagcgccaggaaaaggauuagaauggguagcaucaauaaguuaugauggaagagauuaucaucaugcaggagcaguauggggaagauuuauaauaaguagagauaauaguaaaaauaguuuacauuuacaaaugaauaguuuaagaccagaagauacagcauuauauuuuugugcaagagauuugagagaaagugaaugugaagaaugggaaagcgauuauuauaauuuuuggaaaaaauuaccauguguaaaaccaagaggaguaguaggaauauuagauauauggggacaaggaacaguaguaacaguaaguagu

SEQ ID NO: 47727 - RNA, 432 nt, Artificial Sequence
  derived and/or modified sequence opt6 from anti-HIV_cap256-119-088555_VR-Chain
caaguacaauuaguagaaagcggaggaggaguaguacaagcaggaagaagucuaagauuaaguugugcagcaagucaauuuacauuuaguagauauggaaugcauuggguaagacaagcaccaggaaaaggacuagaauggguagcaggaauaaguuaugauggaagagauaaauaucaugcacauuuuguauggggaagauuuauaauaaguagagauaauaguaaaaauacauuauauuuacaaaugaauagucuaagagcagaagauacagcauuauauuauuguguaagagauuuaagagaaagugaaugugaauuaugggaaucagauuauuaugauuuuggaaaaagauuaccauguguaaaaccaagaggaguagcaggaacauuugaucuauggggacaaggaacaaugguaacaguaaguuca

SEQ ID NO: 47728 - RNA, 432 nt, Artificial Sequence
  derived and/or modified sequence opt6 from anti-HIV_cap256-119-087962_VR-Chain
gaaaugcaauuaguagaaaguggaggaggauuaguaaaaccaggaagaaguuuaagauuaaguugugcagcaaguggauuuacauuuaguaguuaugcaauacauuggguaagacaagcaccaggaaaaggauuagaauggguagcaguaauaaguuaugauggaaguaauaaauauuaugcagauaguguaaaaggaagauuuacaauaaguagagauaauaguaaaaauacaguauauuuacaaaugaauaguuuaagaguagaagauacagcauuauauuauugugcaaaagauuuaagagaauaugaaugugaagaauggacaagugauuauuaugauuuuggaaaaccacaaccauguauagauaguagaggaguaguaggaauauuagauauauggggacaaggaauaaugguaacaguaaguagu

SEQ ID NO: 47729 - RNA, 432 nt, Artificial Sequence
  derived and/or modified sequence opt6 from anti-HIV_cap256-119-086903_VR-Chain
caaguacauuuaguagaaaguggaggaggaguaguacaaccaggaaaaaguuuaagauuaagcugugcagcaagucaauuuacauuugauagauauggaaugcauuggguaagacaagcaccaggaaaaggauuagaauggguagcaaguauaaguaaugauggaacagauaaauaucaugcagauaauguauggggaagauuuacaauaaguagagauaauaguaaaaauacauuauauuuagaaaugaauaguuuaagaggagaagauacagcauuauauuauugugcaaaagauaugagagaagaugaaugugaagaaugguggagugauuauuaugauuuuggaagaccacaaccauguauagauaguagaggaguaguaggaacauuucauguauggggacaaggaacaaugguaacaguaaguagu

SEQ ID NO: 47730 - RNA, 432 nt, Artificial Sequence
  derived and/or modified sequence opt6 from anti-HIV_cap256-119-086804_VR-Chain
gaaguacaauuaguagaaaguggaggaggaguagugcaaccaggaagaagucuaagauuauuuugugcagggaguggauuuacauuuaguaguuauggauuacauuggguaagacaagcaccaggaaaaggauuagaauggguaaguuuuauaaguuaugauggaaguacaacaaaauaugcagauagcuuaaaaggaagguuuacaguaaguagagauaauaguaaaaauacaguauauuuagaaaugaauaguuuaagagcagaagauacagcguuauauuauugugcaaaagauuuaagagaauaugaaugugaagaauggacaagugauuauuaugauuuuggaagaccacaaccauguauagauaguagaggaguaguaggaauauuagauauauggggacaaggaacaaugguaacaguaaguagu

SEQ ID NO: 47731 - RNA, 432 nt, Artificial Sequence
  derived and/or modified sequence opt6 from anti-HIV_cap256-119-085910_VR-Chain
gaaguacaauuauuagaaaguggaggaggauuaguacaaccaggaggaaguuuaagauuaaguugugcagcaagcggauuuacauuuaguaguuauggaaugcauuggguaagacaagcagcaggaaaaggauuagaauggguagcaaguauaaguuaugauggaagagauuaucaucaugcaggagcaguauggggaagauuuauaauaaguagagauaauaguaaaaauaguuuacauuuacaaaugaauaguuuaagaccagaagauacagcauuauauuuuugugcaagagauuuaagagaaagugaaugugaagaaugggaaagugauuauuauaauuuuuggaaaaaauuaccauguguaaaaccaagaggaguaguaggaauauuagauauauggggacaaggaacaguaguaacaguaagcagc

SEQ ID NO: 47732 - RNA, 432 nt, Artificial Sequence
  derived and/or modified sequence opt6 from anti-HIV_cap256-119-085772_VR-Chain
gaaguaagauuaguagaaagcggaggaggauuaauacaaccaggaggaaguuuaagauuaagcugugcagcgaguggacuaacaguaucaaguaaucacaugagcuggguaagacaagcaccaggaaaaggacuagaauggguagcaguaauaucauaugauggaucaaauacguuuuauggagauaguguaaaaggaagauuuacaguaagcagggacauaaguaaaaauacacuauauuuacaaaugaauaguuuaagaccagaagauacagcgauguauuacugugcaagagaucaaagauauuaugaaugugaagaaugggcaucagacuauuacgauuucggaagagaacaaccaugucaagacccaagaggaguaguaggaguauuugauauguggggacaaggaacaaugguaacaguaaguuca

SEQ ID NO: 47733 - RNA, 432 nt, Artificial Sequence
  derived and/or modified sequence opt6 from anti-HIV_cap256-119-084603_VR-Chain
caaguacaauuaguagaaaguggaggaggaguuguacaaaguggaaggaguuuaagauuaaguugugcagcaaguggauuuccauuuagugauuuugcaaugcauuggguaagacaagcaccaggaaaaggauuagaauggguagcaaguauaaguuuuguaggaauaaaaacacauuaugcaaauaguguaagaggaagauuuacaauaaguagagaucaaaguaaaaauacauuauauuuacaaaugaauaguguaagaguagaagauacaggaagauauuauugugcaagagauaugagagaauaugaaugugaauuaugggcaagugauuauuaugauuuuggaaaaccacaaccaugugaagauccaagaggaguaguaggaacauuugauauguggggauuaggaacauuaguaacaguaaguuca

SEQ ID NO: 47734 - RNA, 432 nt, Artificial Sequence
  derived and/or modified sequence opt6 from anti-HIV_cap256-119-084276_VR-Chain
caaguacaauuaguagaaaguggaggaggaguaguacaaccaggaagaaguuuaagauuaagcugugcagcaaguagauuuacauuuucaaguuaugcaaugcacuggguaaggcaagcaccaggaaaaggauuagaauggguagcaguaauaugguaugauggaucaaauaaauauuaugcagauaguguaagaggaagauuuaguguaaguacagacauaaguaaaaauacauuauauuuacaaaugaauagucuaagaccagcagauacagcauuauauuuuugugcaagagauuuaagauauuaugaaugugaagaaugggcaucagacuauuaugauuucggaaaagaacaaccauguuuagauccaagaggaguaguaggaauauuugauuuauggggacaaggaacaaugguaacaguaaguuca

SEQ ID NO: 47735 - RNA, 432 nt, Artificial Sequence
  derived and/or modified sequence opt6 from anti-HIV_cap256-119-082288_VR-Chain
caaguauacuuaguagaaagcggaggaggaguaguacaaccaggaagaucauuaagacuaagcagcgcagcaagucauuucucacuaucaaguuauggaaugcacuggguaagacaagcaccaggaaaaggacuagaauggguagcaggaauaucauuugcaggaacaaaaacauacuauggagauagcguaaaaggaagauuuacaguaaguacagacauaaguaaaaacacauuauaucuacaaguaaauagcuuaagaccagaagauacagcaauguauuacugugcaagagaucaaagauauuaugaaugcgaagaaugggcaucagacuauuacgauuucggaaaagaacaaccaugcuuagacccaagaggaguaguaggaauauucgauauauggggacaaggaacaaugguaacaguaaguuca

SEQ ID NO: 47736 - RNA, 432 nt, Artificial Sequence
  derived and/or modified sequence opt6 from anti-HIV_cap256-119-080383_VR-Chain
caaguacaauuaguagaaagcggaggaggaguaguacaaccaggaagaagcuuaagaauaagcugugcagcaagccaauucacauucucaagauauggaaugcacuggguaagacaagcaccaggaaaaggacuagaauggguagcaucaauaucauacgauggaacagacaaauaccaugcaagauuaguauggggaagauuuacaauaagcagagacaauaguaaaaacacacuauaucuacaaaugaauagccuaagagcagaagauacagcacuauauuacuguguaagagacgaaagagaaagugaaugcgaauuaugggaaucagacuauuacgauuucggaaaaaaacuaccaugcguaaaaccaagaggaguaacaggaucacuagauauguggggacaaggaacacaaguaacaguaagcuca

SEQ ID NO: 47737 - RNA, 438 nt, Artificial Sequence
  derived and/or modified sequence opt6 from anti-HIV_cap256-119-079333_VR-Chain
gaaguacaauuaguagaaagcggaggaagacuaguacaaccaggaucaccauuaagauuaaguugugcagcaagucaauucaauuucgcaaguuauggaaugcacuggguuagacaagcaccaggaaaaggacuagaauggguagcaucaauaucaaacgauggaacaaaaaaauaccaugcagaaagcguaugggauagauuuagcauaagcaaagacaauagcaaaaacacacuauuucuacaaaugaauaguuuaagaguagaagauacagcauuauauuucuguguaaaagaccaaagagaagacgaaugcgaagaaugguggucagacuauuacgauuucggaagagaacuaccaugcagaaaaucaagaggacuaggacuagcaggaauauucgauauguggggacauggaacaaugguaacaguaagcagu

SEQ ID NO: 47738 - RNA, 441 nt, Artificial Sequence
  derived and/or modified sequence opt6 from anti-HIV_cap256-119-078618_VR-Chain
caaaugcaauuaguagaaagcggaggaggaguaguacaaccaggaagaaguuuaacauuaagcugugcagcaagccaauucaauuucgcaagcuauggaaugcacuggguaagacaagcaccaggaaaaggacuagaauggguagcaucaauaucaaacgauggaacaaaaaaauaucaugccgaaaguguaugggauagauuuagcauaaguaaagacaauaguaaaaacacacuauuucuacaaaugaauagcuuaagaguagaagauacaacacuauauuucuguguaaaagaccaaagagaagacgaaugcgaagaaugguggucagacuauuacgauuucggaagagaacuaccaugcagaaaaucaagaggacuaggauuagcaggaaauuucuguauauguggagcagacggaacaaugguaacaguaucaagu

SEQ ID NO: 47739 - RNA, 432 nt, Artificial Sequence
  derived and/or modified sequence opt6 from anti-HIV_cap256-119-077466_VR-Chain
caaguacaauuaguagaaagcgggggaggaguaguacaaccaggaucaccacuaagaauaagcugugcaguaagccaauucacauucucaagauauggaaugcacuggguaagacaagcaccaggaaaaggacuagaauggguagcaucaauaucauucgauggaagagacaaauaccauagcagccuaguaugggggagauuaacaauaucaagagacaauagcaaaaguacauuauuucuacaaaugaauagcuuaagagcagaagauacagcacuauauuacugugcaagagacuuaagagaaagugaaugcgaagaaugggaaucagacuauuacgcauucuauagaaaauuaccaugcguaaaaccaagaggaguagcaggaacauuagauauauggggacaaggaacaaugguaacaguaaguuca

SEQ ID NO: 47740 - RNA, 423 nt, Artificial Sequence
  derived and/or modified sequence opt6 from anti-HIV_cap256-119-076284_VR-Chain
caaguacaauuaguagaaucaggaggaggaguaguacaaccaggaagaucacuaagacuaucaugcgcagcaucaaacacauacgcaaugcauuggguaagacaagcaccaggaaaaggacuagaauggauggcacuaauaagcuaugaaggaagcgauaaauauuacguagacucaguaaaaggaagauucacaauaucaagagauaacucaaaaucaacauuauacuuacaaaugaacucacuaucagcagaagacacagcaguauacuuuugcgcaaaagaucuaggaggaaauaaagaugacgaauggacaacagauuacuauuacgauuggucaaaagcaagaccaguacaagacccaagaguaguagcaggaacauucgauauauggggacaaggaacaaugguaacaguaagcuca

SEQ ID NO: 47741 - RNA, 432 nt, Artificial Sequence
  derived and/or modified sequence opt6 from anti-HIV_cap256-119-074680_VR-Chain
gaaguacaauuaguagaaaguggaggaggauuaguacaaccaggaagaagucuaagauuaaguugugcaggaaguggauuuacauuuguagauuaugcaaugcacuggguaagacaaguaccaggaaaaggauuagaauggguaggaaguauaaguuaugauggaagugauaaauaucauacaaauaguguauggggaagauuuauaguaaguagagauaauagcaaaaauacauuauauuuacaaaugaauaguuuaagaccagaagauacagcauuauauuauuguguaagagauagaagagaaagugaaugugaagaaagauggagugauuauuaugauuuuggaaaacaauuaccauguguaaaaccaagaggaguagcaggaauauuugauauauggggacaaggaacaaugguaacaguaaguagu

SEQ ID NO: 47742 - RNA, 432 nt, Artificial Sequence
  derived and/or modified sequence opt6 from anti-HIV_cap256-119-074081_VR-Chain
gaaguacaauuaguagaaaguggaggaggauuaguacaaccaggaggaagucuaagauugaguuguguaguaagcggaguaacaguaucaagcaauuacaugagcuggguaagacaagcaccaggaaaaggauuagaauggguagcaucaauaucauaugauggaagugacaaauaccaugcagauagaguauggggaagauuuacaauaagcagagacaauagcaaaaacacacuauaucuacaaaugaauagcuuaagagcagaagauacagcacuauauuacuguguaagagacgcaagagaaagugaaugugaacuaugggaaucagacuauuacaauuucggaagaaaauuaccaugcguaaaaccaagaggaguagcgggaacacuagauauauggggacaaggaacaaugguaacaguaaguuca

SEQ ID NO: 47743 - RNA, 432 nt, Artificial Sequence
  derived and/or modified sequence opt6 from anti-HIV_cap256-119-071704_VR-Chain
caaaugcaauuaguagaaagcggaggaggaguaguacaaccaggaggaaguuuaagauuaagcugugcaguaagccaauucacauucacaaguuauggaaugcacuggguaagacaagcaccaggaaaaggauuagaauggguagcaacaauaucaagugauggaucaaaaaaauaccauggagauaguguauggggaagauuaacaauaagcagggacaauaguaaaaacacauuauuuuuacaaaugaauaacuuaagagcagaagauacagcacuauauuucuguguaaaagaccagagagaagacgaaugcgaagaaugguggucagacuauuacgauuucggaaaaaaauuaccaugcagaaaaucaccaggauuagcaggaauauucgauguauggggacauggaacaaugguaacaguaagucca

SEQ ID NO: 47744 - RNA, 432 nt, Artificial Sequence
  derived and/or modified sequence opt6 from anti-HIV_cap256-119-071266_VR-Chain
caaguacaauuaguagaaaguggagggggaguaguacaaccaggagaaagucuaagauuaaguugugcagcaaguggauucacauuuaguaguuuuggaaugcauuggguaagacaagcaccaggaaaaggauuagaauggguaggaaguauaaguuaugauggaagugauaaauaucauacaaauaguguauggggaagauuuauaguaaguagagauaauaguaaaaauacauuauaucuacaaaugaauaguuuaagaccagaagauacagcauuauauuauuguguaagagauagaagagaaagugaaugugaagaaagauggagugacuauuaugauuuuggaaaacaauuaccauguguaaaaccaagaggaguagcaggaauauuugauauauggggacaaggaacaaugguaacaguaaguagu

SEQ ID NO: 47745 - RNA, 432 nt, Artificial Sequence
  derived and/or modified sequence opt6 from anti-HIV_cap256-119-069667_VR-Chain
gaaguacaauuaguagaaaguggaggaggauuaguacaaccaggaagaagucuaagauuaaguugugcagcaaguggauuuaguuuuaauacauauggaaugcauuggguaagacaagcaccaggaaaaggauuagaauggguagcauuuauaagauaugaugggaguaauaaauauuaugcagauaguguaaaaggaagauuuacaauaaguagagauaauaguaaaaauacacuauaucuacaaauggauggauuaagaggagaagauacagcauuauauuauugugcaaaagauuuaagagaauuagaaugugaagaaugggcaagugauuauuaugauuuuggaagaccacaaccauguuuagauccaagagggguaaguggaauaaguaauguauggggacaaggaacaaugguaacaguaaguagu

SEQ ID NO: 47746 - RNA, 432 nt, Artificial Sequence
  derived and/or modified sequence opt6 from anti-HIV_cap256-119-069591_VR-Chain
caaguacaauuaguagaaaguggaggaggaguaguacaaccaggaagaaguuuaagauuaaguugugcagcaaguggauuuacguuuaguagcuaugcaaugcauuggguaagacaagcaccaggaaaaggauuagaauggguagcaggaauaaguuaugauggaagugauaaauaucaugcagauaaaguauggggaagauuuacaauaaguagagauaauaguaaaaauacauuauauuuacaaaugaacaguuuaagagcagaagauacagcauuauauuauugugcaaaagauuuaagagaagaugaaugugaagaaugguggagugauuauuaugauuuuggaaaaagauuaccauguagaaaaagcagaggaguagcaggaguauuugauaaauggggacaaggaacaaugguaacaguaaguagu

SEQ ID NO: 47747 - RNA, 432 nt, Artificial Sequence
  derived and/or modified sequence opt6 from anti-HIV_cap256-119-068691_VR-Chain
caaggacaucuaguagcaaguggaggaggaguaguaccaccaggaagaagcuuaacauuaaguugucuagcaagucaauuuacauuuucaggauauggauuucauuggguaagacaagcaccaggaaaaggauuagaauggguagccucaauaucauuugcaggaacaaaaaaacauuauggaaauaguguaaaaggaagauuuacaauaaguagagauaauaguaaaaauacauuauauuuagaaaugaauaguuuaagaccagaagauacagcauuauauuauugugcaaaagauagaagagaauaugaaugugaagaauggacaucagacuauuaugauuuuggaagaccacaaccauguauagauucaagaggaguaguaggaauauuagauauauggggaagaggaacaaugguaacaguaaguagu

SEQ ID NO: 47748 - RNA, 432 nt, Artificial Sequence
  derived and/or modified sequence opt6 from anti-HIV_cap256-119-068488_VR-Chain
caaaugcaauuaguagaaagcggaggaggaguaguacaaccaggaaugagcuuaacauuaaguugugcagcaagccaauucacauucucaaacuauggaaugcacuggguaagacaagcaccaggaaaaggacuagaauggguagcaucaauaucaaacgauggaucaaaaaaauaccauggagauaguguaaaaggaagauuuacaauaaguagagacaauagcaaaaacacacuauaucuacaaauggauggauuaagaggagaagauacagcacuauauuacugugcaaaagacuuaagagaacuagaaugcgaagaaugggcaucagacuauuacgauuucggaagaccacaaccgugcuuagacccaagaggaguaucaggaauaagcaauguauggggacaaggaacaaugguaacaguaagcuca

SEQ ID NO: 47749 - RNA, 432 nt, Artificial Sequence
  derived and/or modified sequence opt6 from anti-HIV_cap256-119-067536_VR-Chain
caaguacaauuaguagaaaguggaggaggaguaguacaaccaggaagaaguuuaagaauaaguugugcaaguagucaauuuacauuuucaagauauggaaugcauugggugagacaagcaccaggaaaaggauuagaauggguagcaaguauaaguuaugauggaagagauuaucaucaugcaggagcaguauggggaagauuuauaauaaguagagauaauagcaaaaauaguuuacauuuacaaaugaauagcuuaagaccagaagauacagcauuauauuuuugugcuagagauuuaagagaaagugaaugugaagaaugggaaagugauuauuaugcauuuuauagaaaauuaccaugugugaaaccaagaggaguagcaggaacacuagauauauggggacaaggaacaaugguaacaguaaguagu

SEQ ID NO: 47750 - RNA, 432 nt, Artificial Sequence
  derived and/or modified sequence opt6 from anti-HIV_cap256-119-065852_VR-Chain
caaguacauuuaguagaaaguggaggaggagcaguaccaucaggaagaaguuuaagauuaaguuguguagcaaguggauucacauuuggaguauaugauauacauuggguaagacaagcaccaggaaaaggauuagaauggguagcaaguauaucauaugauggaagagauaaauaucauaguucauuaguauggggaagauuaacaauaaguagagauaauaguaaaaguacauuauuuuuacaaaugaauagcuuaagagcagaagauacagcauuauauuauugugcaagagauuugagagaaagugaaugugaagaauggcaaucagauuauuaugcauuuuauaaaaaauuaccauguguaaaaccaagaggaguagcaggaacauuagauauauggggacaaggaacaaugguaacaguaaguuca

SEQ ID NO: 47751 - RNA, 432 nt, Artificial Sequence
  derived and/or modified sequence opt6 from anti-HIV_cap256-119-065457_VR-Chain
cuaggaagauuaguagcaaguggaggaggaguaguaccaccaggaagaaguccaagauuaaguuguguagcaagucaauuuacauuuucaggauguggauuacauuggguaagacaagcaccaggaaaaggauuagaauggguagcagcaauaaguuuugauggaacagauaaauaucauagugaugauguauggggaagguuuacaauaagcagagauaauagcaaaaauacauuauauuuacaaaugaauaguuuaagaccagaagauacagcauuauauuauugugcaaaagaucuacaagaagaugaaugugaagaaugguggagugauuauuaugauuuuggaaaacaauuaccauguagaaaaaguagaggaguagcaggaauauuugaugauuggggacaaggaacaaugguaacaguaaguagu

SEQ ID NO: 47752 - RNA, 432 nt, Artificial Sequence
  derived and/or modified sequence opt6 from anti-HIV_cap256-119-064501_VR-Chain
caaguacaauuaguagaaagcggaggaggaguaguacaaccaggaagaaguuuaagauuaaguugugcagcaagcggauuuacauuuaguaguuaugcaaugcauuggguaagacaagcaccaggaaaaggauuagaauggguagcaggaauaucauaugauggaagagauaaauaucaugcacauaguguauggggaagauuaaguauaagcagagauaauaguaaaaauacauuauauuuacaaaugaauaguuuaagaacagaagauacagcauuauaucauuguguaagagauuuaagagaaagugaaugugaauuaugggaaucagauuauuaugauuuuggaaaaaaacuaccaugugugaaaccaagaggaguugcaggaacauuugaucuauggggacaaggaacaaugguaacagugaguagu

SEQ ID NO: 47753 - RNA, 432 nt, Artificial Sequence
  derived and/or modified sequence opt6 from anti-HIV_cap256-119-063568_VR-Chain
caaguacaaccaguagaaaguggaggaggaguaguauggccaggaagaaguuuaagauuaaguuguacaacaaguggauuuacauuuaguaauuaugcaauacauuggguaagacaagcaccaggaaaaggauuacaauggguagcaguaauaucauaugauggaucaaauaaauuuuaugcagauaguguaaaaggaagauuuacaauaaguagagauaauaguaaaaauacauuauauuuacaaaugaauaguuuaagaccagaagauacagcauuauauuauugugcaaaagauuuaagagaagaugaaugugaagaaagauggagugauuauuaugauuuuggaaaacaauuaccaugcagaaaaaguagaggaguagcaggaguauuugauaauuggggacaaggaacaaugguaacaguaaguuca

SEQ ID NO: 47754 - RNA, 435 nt, Artificial Sequence
  derived and/or modified sequence opt6 from anti-HIV_cap256-119-063103_VR-Chain
caaguacaauuaguagaaaguggaggaggauuaguacaaccaggaaaaucauuaagacuaagcugugcagcaagcggauucacauucagcacauauggaaugcacuggguaagacaagcaccaggaaaaggacuagaauggguagcauuaauaucauacgauggaucauacacauacuaugcagauagcguaaaaggaagauuuacaauaagcagagacaauagcaaaagcacacuagaucuacaacuaaauacauuaagaccagaagauacagcacuauauuacugugcaagagaccuaagagaaauggaaugcgaagaauggaaauuauacaauuauuaugacuuuagaacaagaggaccauguguagauccaagaggaguaguaggaaguuuugacguauggggacaaggaacaguaguaacaguaucaagu

SEQ ID NO: 47755 - RNA, 432 nt, Artificial Sequence
  derived and/or modified sequence opt6 from anti-HIV_cap256-119-061027_VR-Chain
caagugcaauuaguagaaagcggaggaggaguaguacaaccaggaaggaguuuaagauuaaguuguagugcaaguggauuuacauuaucaaguuauggaauacacuggguaagacaagcaccaggaaaaggacuagaauggguagcaguaaugucaaaugauggaucaaaucaauuuuauggagauaguguaaaaggaagauuuacaauaagcagagacauaaguaaaaauacauuauauuuacaaaugaauagcuuaagaccagaagauacagcaauguauuauugugcaagagaucaaagauauuaugaaugugaagaaugggcaucagacuauuaugauuucggaagagaacaaccaugucaagacccaagaggaguaguaggaguauuugauauguggggacaaggaacaaugguaacaguaaguuca

SEQ ID NO: 47756 - RNA, 432 nt, Artificial Sequence
  derived and/or modified sequence opt6 from anti-HIV_cap256-119-058232_VR-Chain
caaguacaauuaguagaaagcggaggaggaguaguacaaccaggaaaaaguuuaagauuaagcuguaaagcaagucaauuuacauuuaauagauauggaaugcacuggguaagacaagcaccaggaaaaggacuagaauggguagcagcaauaaguuuugauggaacagauaaauaucaugccgauaaaguauggggaagauuuacaauaaguagggacgauaguaaaaguacauuauauuuacaaaugaauaguuuaagagcagaagauacagcauuauauuauugugcaaaagauuuaagagaagaugaaugugaagaaugguggagugacuauuaugauuucggaaaacaacuaccauguagaaaaucaagaggaguagcaggaauauuugauggauggggacaaggaacaaugguaacaguaaguagu

SEQ ID NO: 47757 - RNA, 432 nt, Artificial Sequence
  derived and/or modified sequence opt6 from anti-HIV_cap256-119-057341_VR-Chain
caaguacaauuaguugaaaguggaggaggaguaguacaaccaggaagaaguuuaagauuaagcugugcagcaagucauuuuucacuaucaaguuauggaaugcacuggguaagacaagcaccaggaaaaggacuagaauggguagcaggagaaucauuugcagcaacaaauaaauauuaugcagauaguguaaaaggaagauuuauaguaaguagagacauaaguaaaaauacauuauaucuagaaguaaauaguuuaagagcagaagauacagcacuauauuauugugcaagagaucaaagauauuaugaaugugaagaaugggcaucagacuauuaugauuucggaagagaacaaccaugucaagacccaagaggaguagcaggaauauuugauauauggggacaaggaacaaugguaacaguaaguuca

SEQ ID NO: 47758 - RNA, 438 nt, Artificial Sequence
  derived and/or modified sequence opt6 from anti-HIV_cap256-119-056895_VR-Chain
caaaugcaauuaguagaaaguggaggaggaguaguacaaccaggaagaagucuaagauuaagcugugcagcaagccaauucacauucggaaguuauggaaugcacuggguaagacaaauaccaggaaaaggacuagaauggguagcaacaauaucauacgauggaacaaaaaaauaccaugcagauagcguaugggauagauuuauaauaagcagagacaauagcaaaaacacacuauuuuuacaaaugaauagcuuaagaccagaagauacagcacuauauuucuguguaaaagaccaaagacaagacgaaugugaagaaugguggucagacuauuacgauuucggaagagaacuaccaugcagaaaaucaagaggacuaggacuagcaggaauauucgauauguggggacauggaacaaugguaacaguaagcuca

SEQ ID NO: 47759 - RNA, 432 nt, Artificial Sequence
  derived and/or modified sequence opt6 from anti-HIV_cap256-119-056402_VR-Chain
caaguaaaauuaguagaaagcggaggaggaguaguacaaccaggaaaaagcuuaagauuaagcuguacagcaagccaauucacauucucaaacuuuggaaugcacuggguaagacaagcaccaggaaaaggacuagaauggguagcaucaauaucauucguaggaauaaaaaaacacuaugcaaauagcguaagaggaagauuuacaauaagcagagaccaaagcaaaaacacacuauauuuacaaaugaauagcguaagaguagaagauacagcaagauauuucugugcaagagacaugagagaauacgaaugcgaacuaugggcaucagacuauuacgauuucggaaaaccacaaccaugcgaagacccaagaggaguaguaggaacauucgauauguggggauuaggcacacuaguaacaguaagcuca

SEQ ID NO: 47760 - RNA, 432 nt, Artificial Sequence
  derived and/or modified sequence opt6 from anti-HIV_cap256-119-056034_VR-Chain
caaguacaauuaguagaaagcggaggaggaguaguacaaccaggaagaaguuuaagauuaagcugugcagcaagcggauucacauucucaaguuaugcaaugcacuggguaagacaagcgccaggaaaagggcuagaguggguagcagcaauaucauucgcaggaacaaaaacacacuaugcagauagcguaaaaggaagauuuacaauaagcagagacaauagcaaaaacgcacuauaucuacaaaugaauaacuuaagagcagaagauacagcacuauauuacugugcaaaagacuuaagagaagacgaaugugaagaaagauggucagacuauuacgauuucggaaaacaacuaccaugcagaaaaucaagaggaguagcaggaguauucgauaacuggggacaaggaacaaugguaacaguaaguuca

SEQ ID NO: 47761 - RNA, 432 nt, Artificial Sequence
  derived and/or modified sequence opt6 from anti-HIV_cap256-119-055042_VR-Chain
caaguacaauuaguagaaaguggaggaggaguagcacaaccaggaagaaguuuaagauuaaguugugcagcaaguggauuuacauuuagaaguuauggaaugcauuggguaagacaagcaccaggaaaaggauuagaauggguagcaguaauaaguuuagauggaaguaauaaauauuaugcagauaguguaaaaggaagauuuaguauaaguagagauaauaguaaaaauacauuauaucuacaaaugaauagcuuaagaccagaagauacagcaguauauuauugugcaaaagauuuaagagaagaugaaugugaagaaagauggagugauuauuaugauuuuggaaaacaauuaccguguagaaaaaguagaggaguagcaggaguauuugauaauuggggacaaggaacaaugguaacaguaaguagu

SEQ ID NO: 47762 - RNA, 438 nt, Artificial Sequence
  derived and/or modified sequence opt6 from anti-HIV_cap256-119-054776_VR-Chain
caaguacaauuaauggaaagcggaggaggaguaguacaaccgggaagaucauuaagauuaagcuguacagcaagcggauucacauucagcaguuauaguaugcacuggguaagacaagcaccaggaaaaggacuagaauggguagcaauaauaucauaugaugaaucaaauaaauacuaugcagauagcguacaaggaagauuuacaauaagcagagacaauagcaaaaauacacuauuuuuacaaaugucaaguuuaagagcagaagauacagcacucuauuucuguguaagagaucauagagaagacgaaugugaagaaugguggucagauuauuacgauuucggaagagaacuaccaugcagaaaauuuagaggacuaggacuagcaggaauauucgauauauggggucauggaacaaugguaacaguaagcuca

SEQ ID NO: 47763 - RNA, 432 nt, Artificial Sequence
  derived and/or modified sequence opt6 from anti-HIV_cap256-119-054539_VR-Chain
caaaugcaauuaguagaaaguggaggaggaguaguacaaccaggaggaaguuuaagauuaaguugugcagcaagucaauuuacguuuggaaguuaugcaaugcauuggguaagacaaccaccaggagaaagaccagaauggguagcaacaauaucauuugauggaacaaaaaaauaucaugcagauaguguauggggaagauuuacaauaaguagagauaauaguaaaaauacauuauuuuuacaaaugaauagucuaagaccagaagauacagcauuauauuuuuguguaaaagaucaaagagaagaugcaugugaagaaugguggagugauuauuaugauuuuggaaaaaauuguuuagcagaaaguccaggagcaugguuagaauuuuuuuauguauggggacauggaacaaugguaacaguaaguagu

SEQ ID NO: 47764 - RNA, 432 nt, Artificial Sequence
  derived and/or modified sequence opt6 from anti-HIV_cap256-119-054112_VR-Chain
caaguacaauuaguagaaaguggaggaggaguaguacaagcaggaagaaguuuaagauuaagcugugcagcaagcggauucacauucucaacauaugcaaugcacuggguaagacaagcaccaggaaaaggacuagaauggguagcaguaauaucauacgauggaucaaauaaauacuaugcagauagcguacgaggaagauuuacaauaagcagagacaauagcaaaaacacacuauaucuacaaaugaauagcuuaagagcagaagauacagcacuauauuacugugcaaaagacaugagagaauaugaaugcgaagaauggacaucagauuauuaugauuucggaagaccacaaccaugcauagacucaagaggaguaguaggaacauuucauguauggggacaaggaacaaugguaacaguaagcuca

SEQ ID NO: 47765 - RNA, 432 nt, Artificial Sequence
  derived and/or modified sequence opt6 from anti-HIV_cap256-119-053339_VR-Chain
caaguacauuuaguagaaagcggaggaggaguaguacaaccaggaagaaguuuaagauuaaguugugcagcaagucauuucagucuaucaaguuauggaaugcacuggguaagacaagcaccaggaaaaggacuagaauggguaacaggaauaucauuugcaggaacaaaaacauacuauggagauagcguaagaggaagauuuacaguaagcagagacauaaguaaaaacacacuauuacuacaaaugaauagcuuaagaccagacgauacagcaauauauuacugugcaagagaccaaagauauuaugaaugugaagaaugggcaucagacuauuacgauuuuggaaaagaacaaccauguuuagacccaagaggaguaguaggaauauucgauuuauggggacaaggaacaaugguaacaguaaguuca

SEQ ID NO: 47766 - RNA, 432 nt, Artificial Sequence
  derived and/or modified sequence opt6 from anti-HIV_cap256-119-052404_VR-Chain
caaaugcaauugguagaaaguggaggagggguaguacaaccaggaagaagcuuaacauugagcuguauagcaagccaauucaauuucgcgagcuauggaaugcacuggguaagacaagcaccaggaaaaggacuagaauggguagcaucaauaucacacgauggaacaaaaaaauaccaugcagaaaguguauggggaagauuuacaauaagcaaagacaauagcaaaaacacacuauuucuacaaaugaauagcuuaagaguagaagauacagcacuauauuucuguguaaaagaccaaagagaagacgaaugcgaagaaugguggucagacuauuacgauuucggaaaacaacuaccaugcagaaaaucaagaggaguagcaggaguauucgauaacuggggacaaggaacaaugguaacaguaagcuca

SEQ ID NO: 47767 - RNA, 432 nt, Artificial Sequence
  derived and/or modified sequence opt6 from anti-HIV_cap256-119-051123_VR-Chain
caaguacaauuaguagaaaguggaggaggaguaguacaaccaggaggaaguuuaagauuaaguuguguaggaagucaauuuauauuauauagauauggaaugcauuggguaagacaagcaccaggaaaaggauuagaauggguagcagcaguaaguuuugauggaacagauaaauaucaugcagaugauguauggggaagauuuacaauaaguagagauaauaguaaaaauauacuauauuuacaaaugaauaguuuaagagcagaagauacagcauuauauuauugugcaaaagauuuaagagaagaugaaugugaagaaugguggagugauuauuaugauuuaggaaaacaacuaccauguagaaaaagcagaggaguagcaggaguauuugauaaauggggauuaggaacaaugguaacaguaaguagu

SEQ ID NO: 47768 - RNA, 438 nt, Artificial Sequence
  derived and/or modified sequence opt6 from anti-HIV_cap256-119-051077_VR-Chain
gaaguacaauuaguagaaagcggaggaggaguaguacaaagugggaggagucuaagauuaaguugugcagcaagccauuuuacauuuaguagauauggaaugcauuggguaagacaagcaccaggaaaaggauuagaauggguagcaaguauaagcuaugauggaagagauuuuuaucaugcaagaaguguauggggaagauuuacaauaaguagagauaauagcaaaaauacauuauuuuuacaaaugaauaguuuaagaauagaagauacagcauuauauuuuuguguaaaagaucaaagagaagaugaaugugaagaaugguggagugauuauuaugauuuuggaagagaauuaccauguaggaaaaguagaggauuaggauuagcaggaauauuugauauguggggacauggaacaaugguaacaguaaguagu

SEQ ID NO: 47769 - RNA, 432 nt, Artificial Sequence
  derived and/or modified sequence opt6 from anti-HIV_cap256-119-050442_VR-Chain
caagcacaaaugguagaaaguggaggaggaguaguacaaccaggaagaaguuuaagauuaaguugugcagcaaguggauuuaguuuuaguuauuuugcaaugcauuggguaagacaagcaccaggaaaaggauuagaauggguagcaggaauaaguuuugcagcaacaaaaacauauuauggaggaaguguaaaaggaagauuuacagugaguagagauauaagcaaaaauacauuauauuuacaaaugaauaguuuaagaccagaagauacagcaauguauuauugugcaagagaucaaagauauuaugaaugugaagaaugggcaagugauuauuaugauuuuggaagagaacaaccaugucaagauccaagaggaguaguaggaguauuugauauguggggacaaggaacaaugguaacaguaaguagu

SEQ ID NO: 47770 - RNA, 432 nt, Artificial Sequence
  derived and/or modified sequence opt6 from anti-HIV_cap256-119-049433_VR-Chain
caaguacaauuaguagaaagugggggaggaguaguacaaccaggaagaaguuuaagaguaagcuguagagcaaguggauuugcauuuaguaguuaugcaaugcauuggguaagacaagcaccaguaaaaggauuagaauggguagcauuaacaaguagugauggagcagauaaauaucaugcagaugauguauggggaagauuuacaauaaguagagauaauaguaaaaauacauuauauuuacaaaugaauaguuuaagaccagaagauacagcauuauauuauugugcaaaagauuuaagagaagaugaaugugaagaaagauggagugauuauuaugauuuuggaaaacaauuaccauguagaaaaaguagaggaguagcaggaguauuugauaauuggggacaaggaacaaugguaacaguaaguagu

SEQ ID NO: 47771 - RNA, 432 nt, Artificial Sequence
  derived and/or modified sequence opt6 from anti-HIV_cap256-119-047532_VR-Chain
uuaggaagauuaguagcaaguggaggaggaguaguaccaccaggaagaaguuuaacauuaaguuguguagcaagucaauuuacauuuaguggauguggauuacauuggguaagacaagcaccaggaaaaggauuagaauggguagcaaguauaaguuuugcaggaacaaaaaaacauuauacaaauagcguaagaggaagauuuacaauaaguagagauaauaguaaaaauacaguauauuuacaaaugaauaguuuaagagcagaagauacagcauuauauuauugugcaaaagauaugggagaauaugaaugugaagaauggacaagugauuauuaugauuuuggaagaccacaaccauguauagauaguagaggaguaguaggaauauuagauauauggggacaaggaacaaugguaacaguaaguagu

SEQ ID NO: 47772 - RNA, 432 nt, Artificial Sequence
  derived and/or modified sequence opt6 from anti-HIV_cap256-119-047489_VR-Chain
caaguacauuuaguagaaaguggaggaggaguaguacaaccaggaaaaaguuuaagauuaaguugugcagcaagucaauuuacauuuaauagauuuggaaugcauuggguaagacaagcaccaggaaaaggauuagaauggguagcaggaauaaguuaugauggaagugauaaauaucaugcagauaaaguauggggaagauuuacaauaaguagagauaauaguaaaaauacauuauaucuacaaaugaauaguuugagagcagaagauacagcauuauauuauugugcaaaagauuuaagagaagaugaaugugaagaaugguggagugauuauuaugauuuuggaaaaagauuaccguguagaaaaucaagaggaguagcgggaguauuugauaaauggggacaaggaacaaugguaacaguaaguagu

SEQ ID NO: 47773 - RNA, 438 nt, Artificial Sequence
  derived and/or modified sequence opt6 from anti-HIV_cap256-119-046020_VR-Chain
gaaguacaauuacuacaaagcggaggaggacuaguacaaccaggaggaagcuuaagauuaagcugugcagcaagcggauucucauucucaagcuaugcaaugagcuggauaagacaagcaccaggaaaaggacuagaauggguagcaucaauaucacacgauggaacaaaaaaauaccaugcagaaagcguauggggaagauuuacaauaagcaaagacaauagcaaaaacacacuauuucuacaaaugaauagcuuaagaguagaagauacagcacuauauuucuguguaaaagaccaaagagaagacgaaugcgaagaaugguggucagacuauuacgauuucggaagagaacuaccaugcagaaaaucaagaggacuaggacuagcaggaauauucgauauguggggacauggaacaaugguaacaguaagcuca

SEQ ID NO: 47774 - RNA, 432 nt, Artificial Sequence
  derived and/or modified sequence opt6 from anti-HIV_cap256-119-044746_VR-Chain
caaguacaauuaguagaaagcggaggaggaguaguacaaccaggaagaaguuuaagauuaaguugugcagcaaguggauuuacauuuaguaguuaugcaaugcauuggguaagacaagcaccaggaaaaggauuagaauggguagcaguaauaaguuaugauggaaguaauaaauauuaugcagauaguguaaaaggaagauuuacaauaaguagggauaauaguaaaaauacaguauauuuagaaaugaauaguuuaagagcagaagauacagcauuauauuauugugcaaaagauuuaagagaauaugaaugugaagaauggacaagugauuauuaugauuuuggaagaccacaaccauguauagauaguagaggaguaguaggaauauuagauauauggggacaaggaacaaugguaacaguaaguagu

SEQ ID NO: 47775 - RNA, 432 nt, Artificial Sequence
  derived and/or modified sequence opt6 from anti-HIV_cap256-119-044740_VR-Chain
caaaugcauuuaguagaaagcggaggaggaguaguacaaccaggaaugagcuuaagauuaagcugugcagcaagucaauucaauuucggaaguuuuggaaugcacuggguaagacaagcaccaggaaaaggacuagaauggguagcaacaauaaguuaugauggaacaaaaaaauaccauagugauagcguauggggaagauuaagcauaagcagagacaauagcaaaaacacacuauuucuacaaaugaauagcuuaagaacagaagauacagcacuauauuucuguguaagagaccaaagagaagacgauugugaagaaugguggucagacuauuacgauuucggaaaaaaacuaccaugcagaaaaucaagaggacuagcaggaauauuugauauauggggacauggaacaaugguaacaguaaguuca

SEQ ID NO: 47776 - RNA, 432 nt, Artificial Sequence
  derived and/or modified sequence opt6 from anti-HIV_cap256-119-043790_VR-Chain
cuacuacaauuaguagaaagcggaggaggaguaguacaaccaggaaauaguuuaagauuaaguugugcagcagcaggauucacauucagugauuauaguuuacacuggguaagacaagcaccaggaaaaggacuagaauggguagcaaugauaucagacgauggaaaucuagauuucuaugcagcaaguguaaaaggaagauuuacaauaaguagagacaauagcauaaacacaguauauuuacaaaugaauaguuuaagagcagaagauacagcacuauauuacugugcaaaagaucuaagagaauaugaaugugaagaauggacaucagacuauuacgauuucggaagaccacaaccauguauagacucaagaggaguaguaggaauacuagauauauggagucaaggaacaaugguaacaguaagcagu

SEQ ID NO: 47777 - RNA, 432 nt, Artificial Sequence
  derived and/or modified sequence opt6 from anti-HIV_cap256-119-042880_VR-Chain
gaaguaagauuaguagaaagcggaggaggacuaguacaaccaggaggaagcuugagauuaagcugugcagcaagcggguucacauuaucggacuauuacaugagcuggauaagacaagcaccaggaaaaggacuagaauggguagcagcaauaucauucgcaggaacaaaaaaacacuauggaaauaguguaaaaggaagauuuacaauaagcagagacaauagcaaaaacacacuauauuuagaaaugaauagcuuaagaguagaagauacagcauuauauuacugugcaaaagacuuaagagaauacgaaugcgaagaauggacaucagacuauuacgauuucggaagaccacaaccaugcauagacucaagaggaguaguaggaauauuagauauauggggacaaggaacaauggugacaguaagcuca

SEQ ID NO: 47778 - RNA, 432 nt, Artificial Sequence
  derived and/or modified sequence opt6 from anti-HIV_cap256-119-042606_VR-Chain
caaaugcaauuaguagaaaguggaggaggaguaguacaaccaggaagaaguuuaagauuaagcugugcagcaagucaauuuacauucggaaguuauggaaugcacuggguaagacaaauaccaggaaaaggacuagaauggguaacaggaauaucauuugcagcaacaaaaacauacuauggagauagcguaagaggaagauuuacaguaagcagagacauaaguaaaaacacauuauaucuacaaaugaauagcuuaagaccagaagauacagcaauguauuacugugcaagagaccaaagauauuaugaaugcgaagaaugggcaucagacuauuacgauuucggaagagaacaaccaugucaagacccaagaggaguuguaggaauauuagaucuauggggacaaggaacaaugguaacaguaaguuca

SEQ ID NO: 47779 - RNA, 432 nt, Artificial Sequence
  derived and/or modified sequence opt6 from anti-HIV_cap256-119-042444_VR-Chain
caaguacaauuaguagaaagcggaggagauguaguacauccaggaggaaguuuaagauuaagcugugcagcaaguggauucacauuuucaaguuauggaauacacuggguaagacaagcaccaggaaaaggacuagaauggguagcagcaauaucauaugauggaucagauaaauaucauacaaauaguguauggggaagauuuacaguaagcagagacaauaguaaaaauacgguauauuuacaaaugaauaguuuaagagcagaagauacagcauuauauuucuguguaagagacagaagagaaagugaaugugaauuaugggaaucagacuauuaugauuucggaaaaagauuaccauguguaaaaccaagaggaguagcaggaguauuugauauauggggacaaggaacgaugguaacaguaagcuca

SEQ ID NO: 47780 - RNA, 432 nt, Artificial Sequence
  derived and/or modified sequence opt6 from anti-HIV_cap256-119-040328_VR-Chain
caaguacaauuaguagaaaguggaggaggaguaguacaaccaggaggaucauuaagauuaagcugugcagcaagcggauucacauucagcaguuauaguaugaacuggguaagacaagcacccggaaaaggauuagaauggguagcaaguauaucauucgcaggaacaaaacaacacuauggaaauagcguaaaaggaagauuuacaauaagcagggacaauagcaaaaacacaguauaucuacaaaugaauagcuuaagauuagaagauacagcacuauauuacugugcaaaagacuuaagagaauacgaaugcgaagaauggacaucagacuauuacgauuucggaagaccacaaccaugcauagacucaagaggaguaguaggaauacuagauauauggggacaaggaacaaugguaacaguaaguuca

SEQ ID NO: 47781 - RNA, 432 nt, Artificial Sequence
  derived and/or modified sequence opt6 from anti-HIV_cap256-119-040164_VR-Chain
caaaugcacuuaguagaaagcggaggaggaguaguacaaccaggaaugagcuuaagauuaagcugugcagcaagucaauucaauuucggaagcuuuggaaugcacuggguaagacaagcaccaggaaaaggacuagaauggguagcaacaauaucauacgauggaacgaaaaaauaccauagcgauagcguauggggaagauuuagcauaagcagagacaauagcaaaaacacacuauaucuacaaaugaauagcuuaagaacagaagauacagcacuauauuucugugcaaaagacuuaagagaauacgaaugcgaagaauggacaucagacuauuacgauuucggaagaccacaaccaugcauagacucaagagggguaguaggaauacuagauauauggggacaaggaacaaugguaacaguaagcuca

SEQ ID NO: 47782 - RNA, 432 nt, Artificial Sequence
  derived and/or modified sequence opt6 from anti-HIV_cap256-119-039130_VR-Chain
gaagaacaauuaguagaaagcggaggaggauuaguacaaccaggaagaagcuuaagauuaaguuguacaggaagcggauucagauucggagacuaugcaaugaacuggguaagacaagcaccaggaaaaggauuagaauggguaacauuuauaucauacgauggaucaaacaaacacuaugcagauagcguaaaaggaagauuuacaguaagcagagacaauagcaaaaacacacuacaucuacaaaugaauagcuuaagaccagaagauacagcauuauauuucugugcaagagacuuaagagaaagcgaaugcgaagaaugggaaucauacuauuacgauuucggaaaaaaaggaccaugcguaaaaccaagaggaguaguaggaguacuagauauauggggacaaggaacacuaguaacaguaaguuca

SEQ ID NO: 47783 - RNA, 432 nt, Artificial Sequence
  derived and/or modified sequence opt6 from anti-HIV_cap256-119-038138_VR-Chain
caaguacaauuaguagaaagcggaggaggaguaguacaaacaggaagaaguuuaagauuaaguuguacaggaagucaauucacauuuggaagauauggaauguauuggguaagacaagcaccaggaaaaggauuagaauggguagcaaguauaaguuaugauggaagagauuuuuaucaugcaagaaguguauggggaagauuuacaauaaguagagauaauaguaaaaauacauuacauuuacaaaugaauaguuuaagaccagaagauacagcauuauauuuuugugcaagagauuuaagagaaagugaaugugaagaaugggaaaguuauuauuaugauuuuggaaaaaaaggaccauguguaaaaccaagaggaguaguaggaguauuagauauauggggacaaggaacauuaguaacaguaaguagu

SEQ ID NO: 47784 - RNA, 432 nt, Artificial Sequence
  derived and/or modified sequence opt6 from anti-HIV_cap256-119-037868_VR-Chain
caaguacaauuaguagaaagcggaggaggaguaguacaaccaggaagaaguuuaagauuaaguugugcagcaagucaauuuacauuuaguaaauauggaaugcauuggguaagacaagcaccaggaaaaggauuacaauggguagcaggaauaaguuaugauggaagugauaaauaucaugcacauuuuguauggggaagauuuaguauaaguagagauaacaguaaaaaugcauuauauuuacaaaugaauagcuuaagaacagaagauacagcauuauauuuuuguguaagagauuuaagagaaagcgaaugugaagaauggaaaagugauuauuaugauuuuggaagaaaaggaccaugucuaaaaccaagaggaguagcaggaaguuuugauauauggggacaaggaacaguaguaacaguaaguagu

SEQ ID NO: 47785 - RNA, 432 nt, Artificial Sequence
  derived and/or modified sequence opt6 from anti-HIV_cap256-119-037102_VR-Chain
caaguaaaauuaguagaaagcggaggaggaguaguacaaccaggaaaaagcuuaagauuaagcuguacagcaagucaauucacauucucaaacuuuggaaugcacuggguaagacaagcaccaggaaaaggauuagaauggguagcaucaauaucauucguaggaauaaaaaaacacuaugcaaauuucguaagagggagauuuacaauaagcagagaccaaagcaaaaacacacuauaucuacaaaugaauagcguaagaguagaagauacagcaagauauuacugugcaagagacaugagagaauacgaaugcgaacuaugggcaucagacuauuacgauuucggaaaaccacaaccaugcgaagacccaagaggaguaguaggaacauucgauauguggggauuaggaacacuaguaacaguaagcuca

SEQ ID NO: 47786 - RNA, 438 nt, Artificial Sequence
  derived and/or modified sequence opt6 from anti-HIV_cap256-119-036683_VR-Chain
ggaguacaauuaguagaaagcggaggagcaguaguaagaccaggaggaagcuuaacauuaagcugugcagcaagccaauucauacuaucaaguuauggaaugcacuggguaagacaagcaccaggaaaaggacuagaauggguagcaucaauaucaaacgauggaacaaaaaaauaccaugcagaaaguguaugggauagauuuagcauaagcaaagacaauagcaaaaacacacuauuucuacaaaugaauagcuuaagaguagaagauacagcauuauauuucuguguaaaagaccaaagagaagacgaaugcgaagaaugguggucagacuauuacgauuucggaagagaauuaccaugcagaaaaucaagaggacuaggacuagcgggaauauucgauauguggggacauggaacaaugguaacaguaagcuca

SEQ ID NO: 47787 - RNA, 432 nt, Artificial Sequence
  derived and/or modified sequence opt6 from anti-HIV_cap256-119-036495_VR-Chain
caaguacaauuaguagaaaguggaggaggaguaguacaaccaggaagaaguuuaagauuaaguugugcagcaaguggauuuucauuuaguaguuauggaaugcauuggguaagacaagcaccaggaaaaggauuagaauggguagcaucaauaaguuuuguaggaauaaaaacacauuaugcaaauaguguaagaggaagauuuacaauaaguagagaucaaaguaaaaauacauuauauuuacaaaugaauaguguaagaauagaagauacagcaagauauuuuugugcaagagauaugagagaauaugaaugugaauuaugggcaagugauuauuaugauuuuggaaaaccacaaccaugugaagauccaagaggaguaguaggaacauuugauauguggggauuaggaacauuaguaacaguaaguagu

SEQ ID NO: 47788 - RNA, 438 nt, Artificial Sequence
  derived and/or modified sequence opt6 from anti-HIV_cap256-119-035375_VR-Chain
gaaguacaauuaguagaaagcggaggaggauuaguacaaccgggaagaaguuuaagauuaaguugugcagcaagcggauucacacuagaagacuauggaaugcacuggguaagacaagcacccggaaaaggacuagaauggguagcaucaauaucaaaugauggaacaaaaaaauaucaugcagaaaguguaugggauagauuuaguauaagcaaagacaauagcaaaaacacacuauuucuacaaaugaauaguuuaagaguagaagauacagcauuauauuucuguguaaaagaucaaagagaagaugaaugugaagaaugguggucagacuauuacgauuucggaagagaacuaccaugcagaaaaaguagaggacuaggacuagcaggaauauucgauauguggggacauggaacaaugguaacaguaaguuca

SEQ ID NO: 47789 - RNA, 438 nt, Artificial Sequence
  derived and/or modified sequence opt6 from anti-HIV_cap256-119-035165_VR-Chain
caaguacauuuaguagaaaguggagggggaguaggacaaccagcaagaagucuaagauuaaguugugcagcaaguggauuuauauuaaguaguuauggauuacauuggguaagacaagcaccaggaaaaggauuagaauggguggcauuaauaucauaugauggaaauaaugaauauuaugcagaaaguguauggggaagauuuacaauaaguaaagauaauaguaaaaauacauuauuucuacaaaugaauagcuuaagaguagaagauacagcauuauauuuuuguguaaaagaucaaagagaagaugaaugugaagaaugguggagugauuauuaugauuuuggaagagaauuaccauguagaaaaucaagaggauuaggacuagcaggaauauuugauauguggggacauggaacaaugguaacaguaaguagu

SEQ ID NO: 47790 - RNA, 432 nt, Artificial Sequence
  derived and/or modified sequence opt6 from anti-HIV_cap256-119-035109_VR-Chain
caaguacaauuaguagaaaguggaggaggaguaguacaaccaggaagaaguuuaagauuaaguugugcaacagcaggauuuacauuuaguaguuaugcaaugcauuggguaagacaagcaccaggaaaaggauuagaauggguagcaaguauuaguuaugauggaucagauaaauaucaugcagauuuaguauggggaagauuuacaauaaguagagauaauaguaaaaauacauuauauuuacaaaugaauaguuuaagagcagaagauacagcauuauauuauuguguaagagaugcaagagaaagugaaugugaauuaugggaaucagauuauuauaauuuuggaagaaaauuaccauguguaaaaccaagaggaguagcaggaacauuagauauauggggacaaggaacaaugguaacaguaaguuca

SEQ ID NO: 47791 - RNA, 339 nt, Artificial Sequence
  derived and/or modified sequence opt6 from anti-HIV_cap256-119-033789_VR-Chain
caaguauauuuaguagaaaguggaggaggaguaguacaaccaggaagaaguuuaagauuaaguugugcagcaagucauuuuucauuaucaaguuauggaaugcauuggguaagacaagcaccagauauaaguaaaaauacauuauauuuacaaguaaauucauuaagaccagaagauacagcaauguauuauugugcaagagaucaaagauauuaugaaugugaagaaugggcaucagauuauuaugauuuuggaaaagaacaaccauguuuagauccaagaggaguaguaggaauauuugauauauggggacaaggaacaaugguaacaguaucaagu

SEQ ID NO: 47792 - RNA, 432 nt, Artificial Sequence
  derived and/or modified sequence opt6 from anti-HIV_cap256-119-033641_VR-Chain
caaguacaauuaguagaaagcggaggaggaguaguacaaacaggaagaaguuuaagauuaagcuguacaggaagccaauuuacauuuggaagauauggaauguacuggguaagacaagcaccaggaaaaggacuagaauggguagcagcaauaaguuaugauggaucagauaaauaucauacaaauaguguauggggaagauuuacaguaagcagggacaauagcaaaaauacaguauauuuacaaaugaauaguuugagagcagaagauacagcauuauauuuuuguguaagagacagaagagaaagugaaugugaauuaugggaaucagacuauuaugauuuuggaaaaaggcuaccauguguaaaaccaagaggaguagcaggaguauuugauauauggggacaaggaacaaugguaacaguaaguuca

SEQ ID NO: 47793 - RNA, 432 nt, Artificial Sequence
  derived and/or modified sequence opt6 from anti-HIV_cap256-119-032113_VR-Chain
caaguacaauuaguagaaaguggaggaggaguaguacaaccaggaagaccacuaagauuaaguuguguaggaagcggauuuaguuuuauaacaagugcgaugcauuggguaagacaagcaccagauaaaggauuagaauggguagcaauaauaagugauggaggaaauaauagacauuaugcagauaguguaaaaggaagauuuacaauaaguagagauaauaguaaaaauacaguauuuuuagaaguaaauaauuuaagaccagaagauacagcaauguauuauugugcaagagaucaaagauauuaugaaugugaagaaugggcaagugauuauuaugauuuuggaagagaacaaccaugucaagauccaagaggaguaguaggaguauuugauauguggggacaaggaacaaugguaacaguaaguagu

SEQ ID NO: 47794 - RNA, 432 nt, Artificial Sequence
  derived and/or modified sequence opt6 from anti-HIV_cap256-119-031739_VR-Chain
caaguacaauuaguagaaagcggaggaggaguaguacaaccaggaagaaguuuaagaauaagcugugcagcaagccaauucacauucaauagauauggaaugcacuggguaaggcaagcaccaggaaaaggacuagaauggguagcaucaauaucauacgauggaucagacaaauaccaugcaggacuaguaugggggagauucauaauaagcagagacaauagcaaaaacacacuauaucuacaaaugaauagcuuaagagcagaagauacagcacuauauuacuguguaagagacgaaagagaaagugaaugcgaacuaugggaaucagacuauuacgauuucggaaaaaaauuaccaugcguaaaaccaagaggaguagcaggaacacuagauauauggggacaaggaacaagaguaacaguaaguuca

SEQ ID NO: 47795 - RNA, 432 nt, Artificial Sequence
  derived and/or modified sequence opt6 from anti-HIV_cap256-119-030932_VR-Chain
gaaguacaauuauuagaaagcggaggaggaguaguacaaccaggaagaagucuaagacuaagcugugcagcaaguggauuugcauuuucacauuauggaauauuuuggguaagacaagcaccaggaaaaggauuagaauggguaacaguaauaucaggagauggaaguacacaaugguaugcagauaguguacaagggagauuuacgauaaguagagauaguaguaaaaauacauuauauuuacaaauggauggauuaagaggagaagauacagcauuauauuauugugcaaaagauuuaagagaauuagaaugugaagaaugggcaagugauuauuaugauuuuggaagaccacaaccaugucuagauccaagaggaguaucaggaauaaguaauguauggggacaaggaacaaugguaacaguaaguagu

SEQ ID NO: 47796 - RNA, 438 nt, Artificial Sequence
  derived and/or modified sequence opt6 from anti-HIV_cap256-119-030740_VR-Chain
caaguacaauuaguagaauuuggaggaggaguaguacaaacaggaagaaguuuaagauuaaguugugcagcaaguggguuuacauuuucagauuauggaaugcauuggguaagacaagcgccaggaaaaggauuagaauggguagcaaguauaucaaaugauggaaguaaaaaauaucauggagauaguguaugggcaagauuuauaauaaguagagauaauaguaaaaauacauuauuuuuacaaaugaguaguuuaagagcagaagauacagcauuauauuuuuguguaagagaucauagagaagaugaaugugaagaaugguggagugauuauuaugauuuuggaagagaauuaccauguagaaaauuuagaggauuaggauuagcaggaauauuugauauauggggacauggaacaaugguaacaguaaguagu

SEQ ID NO: 47797 - RNA, 438 nt, Artificial Sequence
  derived and/or modified sequence opt6 from anti-HIV_cap256-119-030197_VR-Chain
caaguacauuuaguagaaaguggaggaggaguaguacaaccaggaaaaaguuuaagauuaaguugugcagcaagucaauuuacauuuuguagauauggaaugcauuggguaagacaagcaccaggaaaaggauuagaauggguagcaucgauaaguaaugauggaacagauaaauaucaugcagauaauguauggggaagauuuacaauaagcagagauaauaguaaaaauacacuauauuuagaaaugaauaguuuaagaggagaagauacagcauuauauuauugugcaaaagauaugagagaagaugaaugugaagaaugguggagugauuauuaugauuuuggaaaagaauuaccauguagaaaauggaaaacaaggggaguagcaggaauauuagauaauuggggacaaggaacaaugguaacaguaaguagu

SEQ ID NO: 47798 - RNA, 438 nt, Artificial Sequence
  derived and/or modified sequence opt6 from anti-HIV_cap256-119-027047_VR-Chain
caaaugcaauuaguagaaaguggaggaggaguaguacaaccaggaagaagcuuaacauuaaguugugcagcaagucaauuuacauuuagaaauuauggaaugcauuggguaagacaagcaccaggaaaaggauuagaauggguagcaaguauaaguaaagauggaacaaaaaaauaucauggagauaguguauggggaagauuuauaauaaguagagauaauaguaaaaauacauuauuuuuacaaaugaguaguuuaagagcagaagauacagcauuauauuuuuguguaagagaucaaagagaagcagaaugugaagaaugguggagugauuauuaugauuuuggaagagaauuaccauguagaaaauuuagaggauuaggauuagcaggaauauuugauauauggggacauggaacaaugguaacaguaaguagu

SEQ ID NO: 47799 - RNA, 432 nt, Artificial Sequence
  derived and/or modified sequence opt6 from anti-HIV_cap256-119-026950_VR-Chain
caaguacaauuaguagaaagcggaggaggaguaguacaaccaggaaaaaguuuaagaauaagcugugcagcaagcagauucacauucggaagauuuggaaugcacuggguaagacaagcaccaggaaaaggacuagaauggguagcaucaauaucauacgauggaucagacaaauaccaugcaggauuaguauggggaagauuuauaauaagcagagacaauaguaaaaauacacuauaucuacaaaugaauagcuuaagagcggaagauacagcacuauauuacuguguaagagacgaaagagaaagcgaaugugaacuaugggaaucagacuauuacaauuucgggaaaaauuacccaugcguaaaaccgagaggaguagcaggaacacuagauauauggggacaaggaacaacaguaauaguaagcuca

SEQ ID NO: 47800 - RNA, 438 nt, Artificial Sequence
  derived and/or modified sequence opt6 from anti-HIV_cap256-119-026279_VR-Chain
caaaugcaauuaguagaaaguggaggaggaguaguacaaccaggaacaagcuuaacauuaagcugugcagcaagucaauucucauucacaaguuauggaaugcacuggguaagacaagcaccaggaaaaggauuagaauggguggcaucaauaucaaacgauggaacaaaaaaauaccaugcagaaagcguauggggaagauuuacaauaagcaaagacaauagcaaaaacacacuauuucuacaaaugaauagcuuaagaguagaagauacagcacuauauuucuguguaaaagaccaaagagaagaugaaugcgaagaaugguggucagacuauuacgauuucggaagagaacuaccaugcagaaaaucaagaggacuaggacuagcaggaauauucgauauauggggacauggaacaguaguaauaguaaguuca

SEQ ID NO: 47801 - RNA, 432 nt, Artificial Sequence
  derived and/or modified sequence opt6 from anti-HIV_cap256-119-025355_VR-Chain
gaaguacaauuaguagaaaguggaggaggacuaguacaaccaggaagaaguuuaagacuaaguugugcagcaaguggguuuaguuuuagugauuaugcaaugcauuggguaagacaagcaccaggacaaggauuagaauggguagcauuuauaaguuaugauggaacaaaaaaauaucauagugauaguguauggggaagauuaacaauaaguagagauaauaguagaaauacauuauuuuuacaaaugaauaguuuaagaacagaagauacagcauuauauuuuuguguaagagaucaaagagaagaugauugugaagaaugguggagugauuauuaugauuuuggaaaaaaauuaccauguagaaaaucaagaggauuagcaggaauauuugauauauggggacauggaacgaugguaacaguaaguagu

SEQ ID NO: 47802 - RNA, 432 nt, Artificial Sequence
  derived and/or modified sequence opt6 from anti-HIV_cap256-119-025301_VR-Chain
caaguacacuuaguagcaagcggaggaggaguaguaccaccaggaagaagcuuaagauuaagcuguguagcaagccaauucacauucucaggauuuggauuauacuggguaagacaagcaccaggaaaaggauuagaauggguagcagcaauaucauucgcaggaacaaaaaaacacuaugcaaauagcguaaaaggaagauuuacaauaagcagagacaauaguaaaaacacacuauaucuacaaaugaauagcuuaagaccagacgauacagcauuauauuacugugcaaaagacuuaagagaauacgaaugcgaagaauggacaucagacuauuacgauuucggaagaccacaaccaugcauagacucaagaggaguaguaggaauacuagauauauggagccaaggaacaaugguaacaguaaguuca

SEQ ID NO: 47803 - RNA, 438 nt, Artificial Sequence
  derived and/or modified sequence opt6 from anti-HIV_cap256-119-025010_VR-Chain
caaguacaauuaguagaaagcggaggaggaguaguacaaccaggaagaaguuuaagauuaagcuguccagcaagcggauucucauucucaacauauggaaugcacuggguaagacaagcaccaggaaaaggacuagaauggguagcaucaauaucaaacgauggaaauaaaaaauaccauggagaaaguguaugggauagauuuacaauaagcagagacaauagcaaaaauacacuauuucuacaaaugaauagauugagaguagaagauacagcacuauauuucuguguaaaagaccaaagagaagacgaaugcgaagaaugguggucagacuauuacgauuucggaagagaacuaccaugcagaaaauuuagaggacuaggacuagcaggaauauucgauguauggggacauggaacaaugguaacaguaagcuca

SEQ ID NO: 47804 - RNA, 432 nt, Artificial Sequence
  derived and/or modified sequence opt6 from anti-HIV_cap256-119-024631_VR-Chain
caaguacaauuaauggaaaguggaggagggguaguacaaccaggaggaaguuuaagauuaaguugugcggcaaguggauuuacauuuaguaguuauggaaugcauuggguaagacaagcaccaggaaaaggauuagaauggguagcaggaauaaguuaugauggaagugauaaauaucaugcacauuuuguauggggaagauuuauaauaaguagagauaauaguaaaaaugcauuauauuuacaaaugaauagcuuaagaccagaagauacagcauuauauuuuuguguaagagauuuaagagaaagugaaugugaagaauggcaaaguuauuauuaugauuuugggagaaaaggaccauguuuaaaaccaagaggaguagcaggaaguuuugauauauggggacaaggaacaguaguaacaguaaguagu

SEQ ID NO: 47805 - RNA, 432 nt, Artificial Sequence
  derived and/or modified sequence opt6 from anti-HIV_cap256-119-024467_VR-Chain
gaaguacaauuaguagaaaguggaggaggauuaguacaaccaggaggaagucuaaauguaagcugugcagcaaguggauucacauucagaacauaugcaaugcacuggguaagacaagcaccaggaaaaggacuagaauggguagcagcaauaucauaugauggagauaauaaauauucagcagauaguguaaaaggaagauuuacaauaagcagagaccaaagcaaaaacacacuauauuuacaaaugaauagcguaagaguagaagauacagcaagauauuacugugcaagagacaugagagaauaugaaugugaauuaugggcaucagacuauuaugauuucggaaaaccacaaccaugugaagacccaagaggaguaguaggaacauucgauauguggggauuaggaacauuaguaacaguaaguuca

SEQ ID NO: 47806 - RNA, 432 nt, Artificial Sequence
  derived and/or modified sequence opt6 from anti-HIV_cap256-119-023805_VR-Chain
caaguacaauuaguagaaaguggaggaggaguaguacaaccaggaaaaaguuuaagauuaaguugugcagcaagucaauuuggauuuggaaguuauggaaugcauuggguaagacaagcaccaggaaaaggauuagaauggguagcaacaauaaguuuugauggagcagauaaauaucaugcagaugauguauggggaagauuuaguauaaguagagauaauaguaaaaauacauuauauuuacaaaugaauaauuuaagaccagaagauacagcauuauauuauugugcaaaagauuuaagagaagaugaaugugaagaaagauggucagauuauuaugauuuuggaaaacaauuaccauguagaaaaucaagaggaguagcaggaguauuugauaauuggggacaaggaacaaugguaacaguaaguagu

SEQ ID NO: 47807 - RNA, 432 nt, Artificial Sequence
  derived and/or modified sequence opt6 from anti-HIV_cap256-119-021736_VR-Chain
caaguacaauuaguagaaaguggaggaggaguaguacaaccaggaagaaguguaagauuaaguuguguagcaagucaauuuaguuuugauagauauggaaugcauuggguaagacaagcaccaggaaaaggauuagaauggguagcaaguauaaguuaugaugguacagauaaauaucaugcagauaaaguauggggaagauuuacaauaagcagagauaauaguaaaaaaacauuauauuuacaaaugaauaguuuaagaccagaagaugcagcauuauauuauugugcaaaagauuuaagagaagaugaaugugaagaaugguggagugauuauuaugauuuuggaaaacaauuaccauguagaaaaaguagaggaguagcaggaauauuugauaguuggggacaaggaacaaugguaacaguaaguagu

SEQ ID NO: 47808 - RNA, 438 nt, Artificial Sequence
  derived and/or modified sequence opt6 from anti-HIV_cap256-119-021203_VR-Chain
caaaugcaauuaguagaaaguggaggaggaguaguacaaccaggaagaaguuuaacauuaaguugugcugcaagucaauuuacauuuucaaauuauggaaugcauuggguaagacaagcaccaggaaaaggauuagaauggguagcaucaguaaguaaugauggaacaaaaaaauaucauggagauaguguaugggauagauuuacaauaaguagagauaauagcaaaaauacauuauuuuuacaaaugaguagcuuaagagcagaagauacagcaguauauuuuuguguaagagaugaaagagaagaugaaugugaagaaugguggucggauuauuaugauuuuggaagagaauuaccauguagaaaauuuagaggauuaggauuagcaggaauauuugauauauggggacauggaacauuaguaacagugaguagu

SEQ ID NO: 47809 - RNA, 432 nt, Artificial Sequence
  derived and/or modified sequence opt6 from anti-HIV_cap256-119-020569_VR-Chain
caaguacaauuaguagaaagcggaggaggaguaguacaaccaggagaaucauuaagaauaagcugugcagcaagccaauucacauucucaagauauggaaugcacuggguaagacaagcgccaggaaaaggacuagaauggguagcaucaauaucauucgauggaagagacaaauaccauagcagccuaguguggggaagauuaacaauaagcagagacaauagcaaaagcacacuauuucuacaaaugaauagcuuaagaccagaagauacagcacuauauuacugugcaagagacguaagagaaagcgaaugcgaagaauggcaaucagauuauuacgcauucuauagaaaauuaccaugcguaaaaccaagaggaguagcaggaacacuagauauauggggacaaggaacaaugguaacaguaagcuca

SEQ ID NO: 47810 - RNA, 432 nt, Artificial Sequence
  derived and/or modified sequence opt6 from anti-HIV_cap256-119-019432_VR-Chain
caaguacaauuaguacaaaguggaggaggaguagugcaaccaggaagaagcuuaagaauaaguugugcagcaccauauuuuacauuuggaagauauggauuucauuggguaagacaagcaccaggaaaaggauuagaauggguagcaaguauaaguuuugauggaagagauuauuaucauaguccacauguauggggaagauuaacaauaaguagagauaauaguaaaaauacauuauaucuacaaaugaauagcuuaagagcagaagauacagcacuauauuauugugcaagagauuuaagagaaagugaaugugaagaaugggaaucagauuauuaugauuuuggaaaaaaaggaccauguguaaaaccaagaggaguagcaggaucauuagauauguggggacaaggaacaaugguaacaguaaguagu

SEQ ID NO: 47811 - RNA, 432 nt, Artificial Sequence
  derived and/or modified sequence opt6 from anti-HIV_cap256-119-018827_VR-Chain
caagcacaauuaguagaaaguggaggaggaguaguacaaccaggaagaaguuuaagauuaaguugugcagcaagucauuuuaguuuuaauagguauggaaugcauuggguaagacaagcaccaggaaaaggauuagaauggguagcaggaauaaguuaugauggaagagauuuuuaucaugcagauauaguaugggggagauuaacaauaaguagggauaauaguaaaaauacaguauauuuacaaaugaauaguuuaagagcagaugauacaggauuauauuauugugcaagagauguaagagaaagcgaaugugaagaaugggaaaguuauuauuaugauuuuggaagaaaaggaccauguuuaaaaccaagaggaguagcaggaacauuugauauguggggacaaggaacaauaguaaguguaagugca

SEQ ID NO: 47812 - RNA, 432 nt, Artificial Sequence
  derived and/or modified sequence opt6 from anti-HIV_cap256-119-018483_VR-Chain
cuaguacaauuaguagaaaguggaggaggaguaguacaaccaggaaaaaguuuaagauuaagcuguguagcaagccaauucacauuuaauagauauggaaugcacuggguaagacaagcaccaggaaaaggacuagaauggguagcaggaauaucauaugauggaagagacaaauaccaugcacauuucguauggggaagaauaacaauaagcagagacaauagcaaaaacacacuauauuuacaaaugaauagucuaagagcagaagauacagcacuauaucacuguguaagagacuuaagagaaagugaaugugaacuaugggaaucagacuauuacgauuucggaaaaaaauuaccaugcgugaaaccaagaggaguagcaggaauauucgauuuauggggacaaggaacaaugguaacaguaaguuca

SEQ ID NO: 47813 - RNA, 432 nt, Artificial Sequence
  derived and/or modified sequence opt6 from anti-HIV_cap256-119-018118_VR-Chain
caaguacacuuaguagcaagcggaggaggaguaguaccaccaggaagaaguuuaacauuaagcuguguagcaagccaauucacauucucaggauguggauuacacuggguaagacaagcaccaggaaaaggacuagaauggguagcaucaauaucauucgcaggaacaaaaaaacacuauggaaauagcguaaaaggaagauuuacaauaagcagagacaauaguaaaaacacacuauauuuacaaaugaauagcuuaagaccagaagauacagcacuauauuacugugcaaaagacuuaagagaauacgaaugcgaagaauggacaucagacuauuacgauuucggaagagaucaaccaugcauagacucaagaggaguaguaggaauacuagauauauggggacaaggaacaaugguaacaguaagcuca

SEQ ID NO: 47814 - RNA, 432 nt, Artificial Sequence
  derived and/or modified sequence opt6 from anti-HIV_cap256-119-017782_VR-Chain
caaguacaauuaguagaaagcggaggaggaguaguacaaccaggaaaaagcuuaagauuaagcugugcagcaagcggauucccauucucaaacuaugcaaugcacuggguaagacaaacaccaggaagaggacuagaauggguagcagggauaucauucgcagcaacaaaaaaauacuauagaccaagcguaagaggaagauuuacaguaagcacagacauaagcaaaaacacacuauauuuagaaaugaauagcuuaagaccagaagauacagcacuauauuucugugcaagagaccaaagauauuacgaaugcgaagaaugggcaucagacuauuacgauuucggaagagaacaaccaugcuuagacccaagaggaguaguaggaauauucgaucuauggggacaaggaacaaugguaacaguaagcuca

SEQ ID NO: 47815 - RNA, 432 nt, Artificial Sequence
  derived and/or modified sequence opt6 from anti-HIV_cap256-119-017669_VR-Chain
caaguacaauuaguagaaagcggaggaggaguaguacaaccaggaucaaguuuaagauuaaguugugcagcaagucauuuugcauuuaauagauauggaaugcacuggguaagacaagcaccaggaaaaggauuagaauggguagcaggaauaucauuugauggagcagacaaauuucaugcagauaaaguauggggaagauuuacaauaagcagagacaauaguaaaaauacauuaucauuacaaaugaauagcuuaagaccagaagauacagcauuauauuauugugcaaaagauuuaagagaagaugaaugcgaagaaugguggucagacuauuaugauuucggaagaagacuaccauguagaaaaucaagaggaguaucaggaauauuugauaauuggggacaaggaacaaugguaacaguaaguuca

SEQ ID NO: 47816 - RNA, 432 nt, Artificial Sequence
  derived and/or modified sequence opt6 from anti-HIV_cap256-119-016976_VR-Chain
caaguacaauuaguagaaaguggaggaggaguaguacaaccaggaagaaguuuaagauuaaguugugcagcaagucaauuuucauuuggagauuuuggaaugcauuggguaagacaagcaccaggaaaaggauuagaauggguagcugcaauaucauuugcaggaacaaaaaaaaauuaugcagauaguguaagaggaagauuuacaauaaguagagauucaaguaaaaauacauuauauuuacaaaugaauaguuuaagaccagaagauacagcauuauauuauuguguaaaagauaugagaggauaugaaugugaagaauggacaucagauuauuaugauuuuggaagaccacaaccauguauagauucaagaggaguaguaggaacauuugauguauggggacaaggaacaaugguaacaguaaguuca

SEQ ID NO: 47817 - RNA, 432 nt, Artificial Sequence
  derived and/or modified sequence opt6 from anti-HIV_cap256-119-015432_VR-Chain
gaaguacaauuacuagaaagcggaggaggauuaguacaaccaggaggaagccuaagauuaagcugugcagcuagcggauucacauuuucaggauauaguuuaaacuggguaagacaagcaccaggaaaaggauuagaauggguagcaucaauaucguacgauggaucagacaaauaccaugcagauagaguauggggaagauuuacaauaaguagagacaauaguaaaaacacacuauaucuacaaaugaauagcuuaagagcagaagauacagcacuauauuacuguguaagagacgcaagagaaagcgaaugcgaacuaugggaaagugacuauuacaauuucggaagaaaacuaccauguguaaaaccaagaggaguagcaggaacacuagauauauggggacaaggaacaaugguaacaguaagcuca

SEQ ID NO: 47818 - RNA, 432 nt, Artificial Sequence
  derived and/or modified sequence opt6 from anti-HIV_cap256-119-015281_VR-Chain
cuaggaagauuaguagcgagcggaggaggaguaguaccaccaggaagaagcuuaagauuaagcuguguagcaagucaauuuacauuuucaggauguggauuacacuggguaagacaagcaccaggaaaaggacuagaauggguagcaucaauaaguuuugcaggaacaaaaaaacauuauggaaauagcguaaaaggaagauuuacaauaaguagagacaauaguaaaaauacaguauauuuagaaaugaauagcuuaagagcagaagauacagcacuauauuacugugcuaaagauuuaagagaauaugaaugugaagaauggacaucagacuauuaugauuucggaagaccacaaccauguauagacucaagaggaguaguaggaauauuagauauauggggacaaggaacaaugguaacaguaaguuca

SEQ ID NO: 47819 - RNA, 432 nt, Artificial Sequence
  derived and/or modified sequence opt6 from anti-HIV_cap256-119-014957_VR-Chain
caaguacaaguaguagaaaguggaggaggaguaguacaaccaggaacaagccuaagauuaagcuguacaguaagcggauucucauucucaaacuaugacuuacacuggguaagacaaacaccagcaaaaggacuagaauggguagcaguaguaucauacgauggaucaagagaauacuauacagauagcguaaaaggaagauuuauaauaagcagagaccaaagcaaaaacacacuauauuuacaaaugaauaguguaagauuagaagauacagcacgauauuacugugcaagagacaugagagaauacgaaugcgaacuaugggcaucagacuauuacgauuucggaaaaccacaaccaugcgaagacccaagaggaguaguaggaacauucgauauguggggauuaggaacauuaguaacaguaagcuca

SEQ ID NO: 47820 - RNA, 432 nt, Artificial Sequence
  derived and/or modified sequence opt6 from anti-HIV_cap256-119-014777_VR-Chain
caaguacauuuaguagaaaguggaggaggaguaguacaaccaggaagaaguuuaagauuaaguugugcagcaagucauuuuagucuaucaaguuauggaaugcauuggguaagacaagcaccaggaaaaggauuagaauggguagcaggaauaaguuuugcagcaacaaaaacauauuauggaggaagugugaaaggaagauuuacaguaaguagagauauaaguaaaaauacauuauauuuacaaaugaauaguuuaagaccagaagauacagcaauguauuauugugcaagagaucaaagauauuaugaaugugaagaaugggcaagugauuauuaugauuuuggaagagaacaaccaugucaagauccaagaggaguaguaggaguauuugauauguggggacaaggaacaaugguaacaguaaguagu

SEQ ID NO: 47821 - RNA, 432 nt, Artificial Sequence
  derived and/or modified sequence opt6 from anti-HIV_cap256-119-014313_VR-Chain
caaguacaauuaguagaaagcggaggaggaguaguacaaccaggaagaaguuuaagaauaaguugugcagcaagccaauuuacauuuagcagauauggaaugcauuggguaagacaagcaccaggaaaaggauuagaauggguagcaaguauaaguuaugauggaagagauuaucaucaugcaggagcaguauggggaagauuuauaauaaguagagauaauagcaaaaauaguuuacaucuacaaaugaauaguuuaagaccagaagauacagcauuauauuuuugugcaagagauuuaagagaaagugaaugugaagaaugggaaagugauuauuauaauuuuuggaaaaaauuaccauguguaaaaccaaggggaguaguaggaauauuagauauauggggacaaggaacaguaguaacaguaaguagu

SEQ ID NO: 47822 - RNA, 438 nt, Artificial Sequence
  derived and/or modified sequence opt6 from anti-HIV_cap256-119-014219_VR-Chain
caaaugcaauuaguagaaagcggaggaggaguagugcaaccaggaucaagcuugacauuaaguugugcagcaagccaauucacauucucaaacuauggaaugcacuggguaagacaagcaccaggaaaaggacuagaauggguagcaucaauaucaaacgauggaacaaaaaaauaccauggagauagcguaugggauagauuuacaauaagcagagacaauaguaaaaacacacuauuucuacaaaugaauagcuuaagagcagaagauacagcacuauauuucuguguaaaagaccaaagagaagacgaaugcgaagaaugguggucagacuauuacgauuucggaagagaacuaccaugcagaaaauuuagaggacuaggacuagcaggaacauuugauauauggggacauggaacaauguuaauaguaagcuca

SEQ ID NO: 47823 - RNA, 432 nt, Artificial Sequence
  derived and/or modified sequence opt6 from anti-HIV_cap256-119-013631_VR-Chain
caaguacaauuaguagaaagcggaggaggaguaguacaaccaggaagaaguuuaagauuaaguugugcagcaagucaauucacauucggaaguuauggaaugcacuggguaagacaaauaccagggaaaggacuagaauggguagcaacaauaucauaugauggaacaaaaaaauaccaugcagauaguguaugggauagauuuauaauaagcagagacaauagcaaaaacacauuauuucuacaaaugaauaguuuaagaccagaagauacagcauuauauuucuguguaaaagaccaaagacaagacgaaugcgaagaaugguggucagacuauuaugauuucggaagaagacuaccaugcagaaaaucaagaggacuagcaggaauauucgauguauggggacauggaacaaugguaacaguaagcuca

SEQ ID NO: 47824 - RNA, 432 nt, Artificial Sequence
  derived and/or modified sequence opt6 from anti-HIV_cap256-119-012924_VR-Chain
caaguaacauuaguagaaaguggaggaggauuuguacaaccaggaggaaguuuaagauuaaguugugcaacaaguggauuuacauuuaguaguuaugcaaugcauuggguaagacaagcaccaggaaaaggauuagaauggguagcagcgauaucauuugauggagcagauaaauaucaugcagauaauguauggggaagauuaaguauaaguagagauaauaguaaaaguacauuauauuuacaaaugaauaguuuaagaccagaagauacagcaguauauuuuugugcaaaagauuuaagagaagaugaaugugaagaaagauggagugauuauuaugauuuuggaaaacaauuaccauguagaaaaaguagaggaguagcaggaauauuugauaauuggggacaaggaacaaugguaacaguaagugca

SEQ ID NO: 47825 - RNA, 432 nt, Artificial Sequence
  derived and/or modified sequence opt6 from anti-HIV_cap256-119-011793_VR-Chain
caaguacaauuaguagaaaguggaggaggaguaguacaaccgggaggaaguuuaagauuaaguuguguagcaagucaauuuacauuuaguagauauggaaugcauuggguaagacaagcaccaggaaaaggauuagaauggguagcaaguauaaguuaugauggaagagauaaauaucaugcagauuuuguauggggaagauuaacaauaaguagagaugauaguaaaaaaacauuauaucuacaaauggauaguuuaagaguagaugauacagcauuauauuauuguguaagagauaugagagaaagugaaugugaauuaugggaaucagauuauuaugauuuuggaaaaagauuaccauguguaaaaccaagaggaguagcaggaauauuugauauauggggacaaggaacaaugguaacaguaaguuca

SEQ ID NO: 47826 - RNA, 432 nt, Artificial Sequence
  derived and/or modified sequence opt6 from anti-HIV_cap256-119-011413_VR-Chain
caaguacaauuaguagaaagcggaggagauguaguacaaccaggaagaaguuuaagauuaagcugugcagcaagcggauucacauuuucaacauauggaaugcacuggguaagacaagcaccagggaaaggauuagaauggguagcagcaauaucauuugcaggaacaaaaaaaaauuaugcagauaguguaagaggaagauuuacaauaagcagagacaguaguaaaaauacacuauauuuagaaaugaauaguuugagaccagaagauacagcauuauauuauugugcaaaagacaugagaggauaugaaugugaagaauggacaucagacuauuaugauuucggaagaccacaaccauguauagacaguagaggagucguaggaacauuugauguauggggacaaggaacaaugguaacaguaaguuca

SEQ ID NO: 47827 - RNA, 432 nt, Artificial Sequence
  derived and/or modified sequence opt6 from anti-HIV_cap256-119-011323_VR-Chain
caaguaaaauuaguagaaagcggaggaggaguaguaccaccaggaaaaagucuaagauuaagcuguacagcaagccaauucacauucucaaacuuuggaaugcacuggguaagacaagcaccaggaaaaggacuagaauggguagcaucgauaucauucguaggaauaaaaacacacuaugcaaauagcguaagaggaagauuuacaauaaguagagaccaaagcaaaaacacacuauaucuacaaaugaauaguguaagaguagaagauacaggaagauauuacugugcaagagacaugagagaauacgaaugcgaacuaugggcaucagacuauuacgauuucggaaaaccacaaccaugcgaagacccaagaggaguaguaggaacauucgauauguggggauuaggaacauuaguaacaguaaguuca

SEQ ID NO: 47828 - RNA, 432 nt, Artificial Sequence
  derived and/or modified sequence opt6 from anti-HIV_cap256-119-011233_VR-Chain
caaguacauuuaguagaaagcggaggaggaguaguacaaccaggaagaaguguaagauuaaguugugcagcaagccauuuuucauuaucaaguuauggaaugcacuggguaagacaagcaccaggaaaaggauuagaauggguaacaggaauaucauuugcaggaacaaaaacauauuauggagauagcguaagaggaagauuuacaguaagcagagacauaaguaaaaauacauuauuuuuacaaaugaauaguuuaagaccagacgauacagcaauguauuauugugcaagagaucaaagauauuaugaaugugaagaaugggcaagugauuauuaugauuucggaagagaacaaccaugucuagauccaagaggaguaguaggaauauuugauuuauggggacaaggaacaaugguaacaguaaguuca

SEQ ID NO: 47829 - RNA, 432 nt, Artificial Sequence
  derived and/or modified sequence opt6 from anti-HIV_cap256-119-009038_VR-Chain
caagaacaauuaguagaaaguggaggaggaguaguacaaccaggaagaaguuuaagauuaaguuguguagcaaguagauuuacauuuagugcauuuggaaugcauugggugagacaagcaccaggaaaaggauuagaauggguagcaagcauaaguuuugcaggaauaaaaaaauauuauggagauaguguaaaaggaagauuuacaauaaguagagauaauagcaaaaauacauuauauuuacaaauggauggauuaagaggagaagauacagcacuauauuauugugcaaaagauuuaagagaauuagaaugugaagaaugggcaagugauuauuaugauuuuggaagaccacaaccauguuuagauccaagaggaguaaguggaauaaguaauguauggggacaaggaacaaugguaacaguaaguagu

SEQ ID NO: 47830 - RNA, 432 nt, Artificial Sequence
  derived and/or modified sequence opt6 from anti-HIV_cap256-119-008756_VR-Chain
caaguacaauuaguagaaagcggaggaggaguaguacaaccaggaaaaaguuuaagauuaaguuguguaguaagucaauucacauuuggaagauauggaaugcacuggguaagacaagcaccagggaaaggauuagaauggguagcaucaauaucguaugauggaucagacaaauaucauacaucaaguuuauggggacgauuuauaguaagcagagacaauagcaaaaacacauuauaucuacaaaugaauaguuuaagaccagaagauacagcauuauauuacuguguaagagacagaagagaaagugaaugugaagaaagauggucagacuauuacgauuuuggaaaacaauuaccguguguaaaaccaagaggaguagcaggaauauuugauauauggggacaaggaacaaugguaacaguaaguuca

SEQ ID NO: 47831 - RNA, 438 nt, Artificial Sequence
  derived and/or modified sequence opt6 from anti-HIV_cap256-119-008055_VR-Chain
caaaugcaauuaguagaaagcggaggaggaguaguacaaccaggaagaaguuuaacauuaagcugugcagcaagccaauucucauucgcaaacuauggaaugcacuggguaagacaagcaccaggaaaaggacuagaauggguagcaucaauaucaaacgauggaacaaaaaaauaccaugaagaaagcguauggggaagauuuacaauaagcaaagacaauagcaaaaacacacuauuucuacaaaugaauaguuuaagaauagaagauacagcacuauauuucuguguaaaagaccaaagagaagacgaaugcgaagaaugguggucagacuauuacgauuuuggaagagaacuaccaugcagaaaaucaagaggacuaggacuagcaggaauauucgauauguggggacauggaacaaugguaacaguaagcuca

SEQ ID NO: 47832 - RNA, 435 nt, Artificial Sequence
  derived and/or modified sequence opt6 from anti-HIV_cap256-119-006949_VR-Chain
caaguacaucuaguagaaaguggaggaggaguaguacaaccaggaagaaguuuaagauuaaguugugcagcaagcggauucaguguaaguaauaauuauaugaauuggguaagacaagcaccaggagaaggacuagaauggguagcauuaauaaguuuugauggaagacaaaaagauuuagcagauaguguaaaaggaagauuugcaauaaguagagauaauaguaaaaauacauuauauuuacaaaugaauaguuuaagauuagaagauacagcauuauauuauugugcaagagauuuaagagaauuagauugugaagaauggacauuauauaauuauuaugauuuuggaaguagaggaccauguguagauccaaggggaguaggaggaaguuuugauguauggggacaaggaacaaugguaacaguaaguagu

SEQ ID NO: 47833 - RNA, 432 nt, Artificial Sequence
  derived and/or modified sequence opt6 from anti-HIV_cap256-119-006685_VR-Chain
caaguacaauuaguagaaagcggaggagggguaguacaaccaggaagaaguuuaagaguaagcugugcagcaagucauuucacguuuucaagauauggaaugcauuggguaagacaagcaccaggaaaaggacuagaauggguagcaucaauaucauaugauggaagagacuuuuaucaugcaagaagcguauggggaagauuuacaauaagcagagacaauagcaaaaacacacuacauuuacaaaugaauaguuuaagaccagaagauacagcacuauauuucugugcaagagacuuaagagaaagcgaaugugaagaaugggaaucauauuauuacgauuucggaaaaaaaggaccauguguaaaaccgagaggaguaguaggaguauuagauauauggggacaaggaacacuaguaacaguaaguuca

SEQ ID NO: 47834 - RNA, 432 nt, Artificial Sequence
  derived and/or modified sequence opt6 from anti-HIV_cap256-119-006015_VR-Chain
caaguacaauuaguagaaaguggaggaggaguaguacaaccaggaaaaaguuuaagauuaagcugugcagcaaguagauuuacauuuaauagauauggaaugcauuggguaagacaagcaccaggaaaaggguuagaauggguagcagcaauaaguuuugauggaacagauaaauaucauagcgaugauguauggggaagauuuacaauaaguagagauaauaguaaaaauacauuauaucuacaaaugaauaguuuaagaccagaagauacagcauuauauuauugugcaaaagauuuacaagaagaugaaugugaagaaugguggucagauuauuaugauuuuggaaaacaauuaccauguagaaaaaguagaggaguagcaggaauauuugaugauuggggacaaggaacaaugguaacaguaaguagu

SEQ ID NO: 47835 - RNA, 432 nt, Artificial Sequence
  derived and/or modified sequence opt6 from anti-HIV_cap256-119-005841_VR-Chain
caaguacaauuaguagaaaguggaggaggaguaguacaaccaggaagaaguuuaagauuaaguugugcagcaagccaauucucauucggaaacuuuggaaugcacuggguaagacaagcaccaggaaaaggacuagaauggguagcagcaauaucauucgcaggaacaaaagaaaacuaugcaaauaguguaagaggaagauuuacaauaagcagagacaauagcaaaaacacacuauaucuacaaaugaauagcuuaagagcagaagauacagcacuauauuacuguacaaaagacaugagagaauacgaaugcgaagaauggacaucagacuauuacgauuucggaagaccacaaccaugcauagacucaagaggaguaguaggaacauucgauguauggggacaaggaacaaugguaacaguaaguuca

SEQ ID NO: 47836 - RNA, 432 nt, Artificial Sequence
  derived and/or modified sequence opt6 from anti-HIV_cap256-119-005824_VR-Chain
caaguacaauuaguagaaaguggaggaggaguaguacaaccaggaggaaguuuaagauuaaguugugcagcaaguggauuuacauuuagaagauaugcaaugcauuggguaagacaagcaccaggaaaaggauuagaauggguagcaucaauaucauaugauggaagugauaaauaucacacaucaaguuuauggggaagguuuauaguaaguagagauaauaguaaaaauacauuauauuuacaaaugaauaguuuaagaccagaagauacagcauuauauuauuguguaagagauagaagagaaagugaaugugaagaaagauggagugauuauuaugauuuuggaaaacaauuaccauguguaaaaccaagaggaguagcaggaauauuugauauauggggacaaggaacaaugguaacaguaaguagu

SEQ ID NO: 47837 - RNA, 432 nt, Artificial Sequence
  derived and/or modified sequence opt6 from anti-HIV_cap256-119-005494_VR-Chain
caaguaagauuaguagaaagcggaggaggaguaguacaaccaggaaggagcuuaagaauaagcugugcagcaagccaauucauguucaauaaauauggaaugcacuggguaagacaagcaccaggaaaaggacuagaauggguagcaucaauaucauaugauggaucagacaaauaccaugcagaucuaguauggggaagauuuacaauaagcagagacaauagcaaaaacacauuauauuuacaaaugaauagcuuaagagcagaagauacagcacuauauuacuguguaagagacgcaagagaaagcgaaugcgaacuaugggaaucagacuauuacaauuucggaagaaaacuaccauguguaaaaccaagaggaguagcaggaacauuagauauauggggacaaggaacaaugguaacaguaagcuca

SEQ ID NO: 47838 - RNA, 432 nt, Artificial Sequence
  derived and/or modified sequence opt6 from anti-HIV_cap256-119-004949_VR-Chain
caaguacaauuaguagaaagcggaggaggaguaguacaaccaggaagaagcuuaagauuaagcugugcagcaagcaaauucucacuaucaagcuauggaaugcacuggguaagacaagcaccaggaagaggacuagaauggguagcaggaauaucauucgcagcaacaaaaaaauacuauagaccgagcguaagaggaagauuuacaguaagcacagacauaaguaaaaacacauuauaucuagaaaugaauagcuuaagaccagaagauacagcacuauauuucugugcaagagaucaaagauauuacgaaugcgaagaaugggcaucagacuauuacgauuucggaagagaacaaccaugcuuagacccgagaggaguaguaggaauauucgaucuauggggacaaggaacaaugguaacaguaaguuca

SEQ ID NO: 47839 - RNA, 432 nt, Artificial Sequence
  derived and/or modified sequence opt6 from anti-HIV_cap256-119-004422_VR-Chain
cacguacaauuaguagaaaguggaggaggaguaguacaaccaggaagaaguuuacgauuaaguugugcagcaaguggacuaucauucucaaguuaugcaaugcacuggguaagacaagcaccaggaaaaggacuagaauggguagcaguaguaucauaugauggaacaacaaaauucuaugcagauagcguaaaaggaagauuuacaauaaguagagacaauaguaaaaacacauuauauuuacaaaugaauagcuuaagaggagaagauacagcacuauauuacugugcaaaagacuuaagagaauaugaaugcgaagaauggacaucagacuauuaugauuucggaagaccacaaccaugcauagacucaagaggaguaguaggcauacuagauauauggagucaaggaacaaugguaacaguaaguuca

SEQ ID NO: 47840 - RNA, 432 nt, Artificial Sequence
  derived and/or modified sequence opt6 from anti-HIV_cap256-119-003932_VR-Chain
caaguacaauuauuagaaaguggaggaggaguaguacaaccaggaggaaguuuaagauuaaguuguaaagcaagucauuucaguuuugauagauauggaaugcauuggguaagacaagcaccaggaaaaggacuagaauggguagcagcaauaaguuuugauggagcagacaaauaucaugcagauaaugugugggggagauugaguauaaguagagauaauaguaaaaguacauuauauuuacaaaugaauaguuuaagaccagaagauacagcaguauauuuuugugcaaaagauuuaagagaagaugaaugugaagaaagauggucagacuauuaugauuuugggaaacaauuaccauguagaaaaucaagaggaguagcaggaauauuugauaauuggggacaaggaacaaugguaacaguaagugca

SEQ ID NO: 47841 - RNA, 438 nt, Artificial Sequence
  derived and/or modified sequence opt6 from anti-HIV_cap256-119-003577_VR-Chain
caaguacaauuaguagaaagcggaggaggaggaguacaaccaggaagaaguuuaagauuaaguugugcggcaaguggauuuacauuuagaaguuaugcaaugcauuggguaagacaagcaccaggaaaaggauuagaauggguagcaguaauaaguaaugauggaacaaaaaaauaucaugcagaaaguguaugggauagauuuaguauaaguaaagauaauaguaaaaauacauuauuuuuacaaaugaauaguuuaagaguagaagauacagcauuauauuuuuguguaaaagaucaaagagaagaugaaugugaagaaugguggagugauuauuaugauuuuggaagagaauuaccauguagaaaaaguagaggacuaggauuagcaggaauauuugauauguggggacauggaacaaugguaacaguaaguagu

SEQ ID NO: 47842 - RNA, 432 nt, Artificial Sequence
  derived and/or modified sequence opt6 from anti-HIV_cap256-119-002155_VR-Chain
cuaggaagauuaguagcaagcggaggaggaguaguaccaccaggaagaaguuuaagauuaagcuguguagcaagucaauucacauuuucaggauguggauuacacuggguaagacaaguaccaggaaaaggacuagaauggguagcaucaauaucauuugcaggaacaaaaacacacuacggaaauagcguaaaaggaagauuuaguauaagcagagacaauaguauaaacacaguauaucuacaaaugaauagcuuaagagcagaagauacagcacuauauuacugugcaaaagacuuaagagaauaugaaugugaagaauggacaucagacuauuacgauuucggaagaccacaaccauguauagacucaagaggaguaguaggaauacuagauauauggagucaaggaacaaugguaacaguaaguuca

SEQ ID NO: 47843 - RNA, 432 nt, Artificial Sequence
  derived and/or modified sequence opt6 from anti-HIV_cap256-119-002017_VR-Chain
caaguacaauuaguagaaaguggaggaggaguaguacaaccaggaagaaguuuaagauuaaguugugcagcaaguggauuuacauuuaguuauuauggaauacauuggguaagacaagcaccaggaaaaggacuagaauggguagcaaguauaaguuaugaugaaagagauuuuuaucaugcaagaaguguauggggaagauuugcaauaaguagagauaauaguaaaaauacauuacaucuacaaaugaauaguuuaagaccagaagauacagcauuauauuuuugugcaagagauuuaagagaaagugaaugugaagaaugggaaaguuauuauuaugauuuuggaaaaaaaggaccauguguaaaaccaagaggaguaguaggaguauuagauauauggggacaaggaacauuaguaacaguaaguagu

SEQ ID NO: 47844 - RNA, 432 nt, Artificial Sequence
  derived and/or modified sequence opt6 from anti-HIV_cap256-119-001312_VR-Chain
caaguacaauuaauggaaaguggaggaggaguaguacaaccaggaagaaguuuaagauuagcaugugcagcaaguggauuuacauuuucaaguuaugcaauacacuggguaagacaagcaccagggaaaggauuagaauggguagcagcaauaaguuuugcaggaacaaaaaaaaauuaugcagauagugugagaggaagauuuacaauaagcagagauucaaguaaaaauacauuauauuuagaaaugaauaguuuaagaccagaagauacagcauuauauuacugugcaaaagauaugcgaggauaugaaugugaagaauggacaucagauuauuaugauuuuggaagaccacaaccauguauagauucaagaggaguaguaggaacauuugauguauggggacaaggaacaaugguaacaguaaguuca

SEQ ID NO: 47845 - RNA, 438 nt, Artificial Sequence
  derived and/or modified sequence opt6 from anti-HIV_cap256-119-001017_VR-Chain
caaaugcaauuaguagaaagcggaggagggguaguacaaccaggaagaagcuuaacauuaagcugugcagcaagccaauucucauucacgaacuauggaaugcacugggucagacaagcaccaggaaaaggacuagaauggguagcaucaauaucaaacgauggaaauaaaaaauaccauggagaaagcguaugggauagauuuacaauaagcagagacaauaguaaaaacacacuauuucuacaaaugaauagauuaagaguagaagauacagcacuauauuucuguguaaaagaccaaagagaagacgaaugcgaagaaugguggucagacuauuacgauuucggaagagaacuaccaugcagaaaauuuagaggacuaggacuagcaggaauauuugauguauggggacauggaacaaugguaacaguaaguuca

SEQ ID NO: 47846 - RNA, 432 nt, Artificial Sequence
  derived and/or modified sequence opt6 from anti-HIV_cap256-119-000594_VR-Chain
caaguacaacuaguagaaagcggaggaggauuaguacaaccaggaacaagcuuaagauuaagcugugcagcaagcgcauucacauucaaaaacuauggaaugcacuggguaagacaagcaccaggaaaaggacuagauuggguagcaucgauaucauacgauggaagagacaaauaccauagcucacuaguauggggaagacuaacaauaagcagagacaauagcaaaaguacauuauuucuacaaaugaauagcuuaagagcagaagauacagcacuauauuacugugcaagagacuuaagagaaagcgaaugcgaagaauggcaaucagacuauuacgcauucuauaaaaaacuaccaugcguaaaaccaagaggaguagcaggaacacuagauauauggggacaaggaacaaugguaacaguaagcucg

SEQ ID NO: 47847 - RNA, 432 nt, Artificial Sequence
  derived and/or modified sequence opt6 from anti-HIV_cap256-059-241099_VR-Chain
caaguacaauuaguagaaaguggaggaggaguaguacaaccaggaagaaguuuaagauuaaguugugcagcaaguggauuuacauuuaguaguuauggaaugcacuggguaagacaagcaccaggaaaaggauuagaauggguagcaguaauaaguuaugauggaaguaauaaauauuauguagauaguguacaaggaagauuuacaauaaguagagauaauaguaaaaauacaauguuuuuacaaaugaauaguuuaagaacggaagauacagcaguauauuauugugcaagagauuuaggagaaagugaaguagaagaaugggcaacagauuauuaugauuuuaguauagcauauccaguagaaggaccaagaggaguaguaggaauauuugauauauggggacaaggaacaaugguaacaguaaguagu

SEQ ID NO: 47848 - RNA, 432 nt, Artificial Sequence
  derived and/or modified sequence opt6 from anti-HIV_cap256-059-207529_VR-Chain
caaguacaauuaguagaaaguggaggaggaguaguacaaccaggaagaaguuuaagauuaaguugugcagcaaguggauuuacauuuaguaguuauggaaugcauuggguaagacaagcaccaggaaaaggauuagaguggguagcaggaauaucauuugcaggaauaaauaaauauuauggaaauaguguaaaaggaagauuuacaauaagcagggauaauaguaggaauacauuauaucuacaaaugaauaguuugagagcagaagauacagcauuauauuauugugcaagagauuuaagagaaauggaaugugaagaaugggcaagugauuauuaugauuuuggaagaggaggaccaugucaagauccaagaggaguaguaggaacauuugauauauggggacaaggaacaaugguaacaguaagcuca

SEQ ID NO: 47849 - RNA, 435 nt, Artificial Sequence
  derived and/or modified sequence opt6 from anti-HIV_cap256-059-205541_VR-Chain
caaaugcaauuaguagaaaguggaggaggaguaguacaaccaggaggaaguuuaagauuaaguugugcagcaaguggauuuaguuuuaguuauuaugcaauggauuggguaagacaagcaccaggaaaaggauuagaauggguagcauuuauaaguagugauggaagcgauaaaaauuaugcagauaguguaaaaggaagauuuacaauaaguagagauaauaguaaaaauacauuauauuuacaaaugaauaguuuaagagcagaagauacagcaguauauuauugugcaaaagauguaggaggacauaaaaaugaugaaugggcaacaaauuauuauuaugauauaagcauagcauauccaauacaagauccaagagcaguagcaggagcauuugauguauggggacaaggaacaaugguaacaguaaguagu

SEQ ID NO: 47850 - RNA, 432 nt, Artificial Sequence
  derived and/or modified sequence opt6 from anti-HIV_cap256-059-188439_VR-Chain
caaguacaauuaguagaaagcggaggaggaguaguacaaccaggaaggagcuuaagauuaagcugugcagcaagucaauucacauucucaaauuauggcaugcacuggguaagacaagcaccaggaaaaggauuagaauggguagcagcaauaucauucgcaggaauaaacaaauacuauacagauagcguaaaaggaagauuuacaauaagcagagacaauaguaaaaacacacuauaucuacaaaugaauaguuuaagagcagaagauacagcacuauauuacugugcaaaagacuuaagaggauuugaaugcgaagaaugggcaucagacuauuacgauuucggaagagaucuaccaugccaagacccgagaggaguaguaggaacauucgauguauggggacaaggaacaaaaguaacaguaagcagu

SEQ ID NO: 47851 - RNA, 432 nt, Artificial Sequence
  derived and/or modified sequence opt6 from anti-HIV_cap256-059-187234_VR-Chain
caaguacaauuaguagaaagcggaggaggaguaguacaagcaggaagaaguuugagauuaagcugugcagcgagucaauucacauucggaaguuauggaaugcacuggguaagacaagcaccaggaaaaggacuagaauggguagcagcaauaucauucgcaggaacaaaaauacacuaugcagauagcguaaaaggaagauuuacaauaagcagagacaauagcaaaaacgcacuauaucuacaaaugcauagcuuaagagcagaagauacagcauuauauuacugugcaaaagacuuaagagaauacgaaugcgaagaaugggcaucggacuauuacgauuucggaagagaucaaccaugccaagacccaagaggaguaguaggaauauucgauauauggggacaaggaacaaugguaacaguaagcuca

SEQ ID NO: 47852 - RNA, 432 nt, Artificial Sequence
  derived and/or modified sequence opt6 from anti-HIV_cap256-059-187047_VR-Chain
caagugcaauugguagaaagcggaggaggaguaguacaaccaggaagaagcuuaagauuaagcugugcaguaagccaacuaacauucucaagcuauggaaugcacuggguaagacaagcaccaggaaaaggauuagaauggguagcagcaauaucauucguaggaauaaaaaaauacuaugcagauagcgugaaaggaagauuuacaauaagcagagacaauaguaaaaacacacuauaucuacaaaugaauagcuuaagaguagaagauacagcacuauauuacugugcaaaagacuuaagagaauacgaaugcgaagaaugggcaucagacuauuacgauuucggaagagaucaaccaugccaagacgcaagaggaguaguaggaacaagcgauauauggggacaaggaacaaugguaacaguaagcuca

SEQ ID NO: 47853 - RNA, 432 nt, Artificial Sequence
  derived and/or modified sequence opt6 from anti-HIV_cap256-059-186068_VR-Chain
caaguacaauuaguagaaagcggaggaggaguaguacaaccaggaagaagcuuaagauuaagcugugcagcaagucaauucucauuuucaaauuauggaaugcacuggguaagacaagcaccaggaaaaggauuagaauggguagcaggaauaucauuugcagcaacaaaaaaauauuaugcagauaguguaaaaggaagauuuaguguaagcagagacaauaguaaaaaugcauuauauuuacaaaugaauagcuuacgagcagaagauacagcacuuuauuacugugcaagagacuuaagagauuaugaaugugaagaaugggcaucagacuauuaugauuucggaagagaauacccaugucaagacccaagaggaguaguaggaacauuugauauauggggacaaggaacaaugguaacaguaaguaca

SEQ ID NO: 47854 - RNA, 435 nt, Artificial Sequence
  derived and/or modified sequence opt6 from anti-HIV_cap256-059-182835_VR-Chain
caaguacaauuaguagaaaguggaggaggauuaguacaaccaggaagaaguuuaagauuaaguugugcagcaagcggauuuaguuuuaauaauuuugcaauggauuggguaagacaagcaccaggaaaaggauuagaauggguagcauuuguaaguagugauggaaguaauaaaaauuaugcagauaguguaaaaggaagauuuauaauaaguagagauaauaguaaaaauacaguauauuuacaaaugaauaguuuaagaguagaagauacagcaguauauuauugugcaaaagauuuaggagcaaauaaagaugaugaaugggcaacagauuauuauuaugaucuaucaguagcaagaccaguaccagauccaagagcaguaguaggagcauuugauguauggggacaaggaacaaugguaacaguaaguagu

SEQ ID NO: 47855 - RNA, 432 nt, Artificial Sequence
  derived and/or modified sequence opt6 from anti-HIV_cap256-059-176659_VR-Chain
agaguacaauuaguagaaagcggaggaggaguaguacaaccaggaagaagccuaagauuaaguugugcagcaagccaauucucauucucaaacuauggaaugcacuggguaagacaagcaccaggaaaaggacuagaauggguagcaggaauaucauucgcagcaauaaaaaaauacuaugcagauagcguaaaaggaagauuuacaauaaguagagacaauagcaaaaacgcacuauauuuacaaaugaauagccuaagagcagaagauacagcacuauauuacugugcaagagacuuaagagaauacgaaugcgaagaaugggcaucagacuauuacgauuucggaagagaacuaccaugccaagacccaagaggaguaguaggaacauucgauacauggggacaaggaacaaugguaacaguaagcaca

SEQ ID NO: 47856 - RNA, 432 nt, Artificial Sequence
  derived and/or modified sequence opt6 from anti-HIV_cap256-059-172956_VR-Chain
caaguacaauuaguagaaaguggaggaggaguaguacaaccaggaagaagccuaagauuaaguugugcagcaagucaauuuucauuuucaagcuauggaaugcauuggguaagacaagcaccaggaaaaggauuagaauggguagcagcaaugaguuuugcaggaacaaaucaauauuaugcagcaaguguaaaaggaagauuuacaauaaguagggauaauaguaaaaauacauuauauuuacauaugaauaguuuaagaccagaagauacagcauuauauuauugugcaagagauuuaagagaauaugaaugugaagaaugggcagcagauuauuaugauuuuggaagagaauauccaugucaagauccaagaggaguaguaggaauauuugauguauggggacaaggaacauuaguaacaguaaguuca

SEQ ID NO: 47857 - RNA, 432 nt, Artificial Sequence
  derived and/or modified sequence opt6 from anti-HIV_cap256-059-171272_VR-Chain
caaguacuauuaguagaaaguggaggaggaguaguacaaccaggaaggagcuuaagauuaagcugugcagcgagccaauucacauucucaaacuauggaaugcacuggguaagacaagcaccaggaaaaggacuagaauggguagcagcaauaucauucgcaggaaugaaaaaauacuaugcagauagcguaaaaggaagauuuacaauaagcagagacaauagcaaaaacacacuauaucuacaaaugaauagcuuaagagcagaagauacagcacuauauuacugugcaaaagacuuaagagaauucgaaugcgaagaaugggcaucagacuauuacgauuucggaagagcacaaccaugccaagacccaagaggaguaguaggaacauucgauuuauggggacaaggaacaaugguaacaguaagcuca

SEQ ID NO: 47858 - RNA, 432 nt, Artificial Sequence
  derived and/or modified sequence opt6 from anti-HIV_cap256-059-168734_VR-Chain
caaguacaauuaguagaaagcggaggaggaguaguacaaccaggaagaagcuuaagauuaaguuguacagcaagccaauucucauucucaaguuauggaaugcacuggguaagacaagcaccagggaaaggauuagaauggguagcagcaauaucauucgcaggaacaaaaaaauacuauguaggaacaguaaaaggaagauuuacaauaagcagagacaauagcaaaaacacacuauaucuacaaaugaauagcuuaagagcagaagauacagcauuauauuacugugcaaaagacaugagagaauacgaaugcgaagaaugggcaucagacuauuacgauuucggaagagaauacccaugccaagacccaagaggaguaguaggaacauucgauauauggggacaaggaacaaugguaacaguaagcuca

SEQ ID NO: 47859 - RNA, 432 nt, Artificial Sequence
  derived and/or modified sequence opt6 from anti-HIV_cap256-059-155838_VR-Chain
caaguacaauuaguagaaagcggaggaggaguaguacaaccaggaagaaguuuaagauuaagcugugcaguaagccaauucacauucucaaacuauggaaugcacuggguaagacaagcaccaggaaaaggacuagaauggguagcagcaauaucauucgcaggaacaaaaaaaagcuaugcagcaagcguaaaaggaagauuuacaauaagcagagacaauagcaaaaacacacuauaucuacaaaugaauagcuuaagaccagaagauacagcguuauauuacugugcaaaagacaugagaggauucgaaugcgaagaaugggcaucagacuauuacgauuucggaagagaacaaccaugccaagacccaagaggaguaguaggaauauucgaucuauggggacaaggaacaaugguaagcguaagcuca

SEQ ID NO: 47860 - RNA, 432 nt, Artificial Sequence
  derived and/or modified sequence opt6 from anti-HIV_cap256-059-149799_VR-Chain
caaguacauuuaguagaaaguggaggaggaguaguacaaccaggaagaagcuuaagauuaagcugugcagcaagccaauucacauucucgaacuauggauuucacuggguaagacaagcaccaggaaaaggacuagaauggguagcagcaauaucauucgcaggaguaaaaaaacacuaugcagauagcguaaaaggaagauuuacaauaagcagagacaauaguaaaaacacauuauaucuacaacuaaauagcuuaagagcagaagauacagcacuauauuacugugcaaaagacuuaagagaauacgaaugcgaagaaugggcaagugacuauuacgauuucggaagagauuucccaugccaagacccaagaggaguaguaggaacauucgauauauggggacaaggaacaaugguaacaguaagcuca

SEQ ID NO: 47861 - RNA, 432 nt, Artificial Sequence
  derived and/or modified sequence opt6 from anti-HIV_cap256-059-148168_VR-Chain
caaguacaauuaguagaaagcggaggaggaguaguacaaccaggaagaagcuuaagacuaagcuguacagcaagccaauucacauucucaaacuauggaaugcacuggguaagacaagcaccaggaaaaggacuagaauggguagcaggaauaucauucgcagcaacaaaaaaauacuauagugauagcguaaaaggaagauuuacaauaagcagagacaauagcaaaaacgcacuauaucuacaaaugaauagcuuaagagcagaagauacagcacuauaucacugugcaaaagacuuaagagaauacgaaugcgaagaaugggcaucagacuauuacgauuucggacgagaacaaccaugccaagacccaagaggaguaguaggaacauucgauauauggggacaaggaacaaugguaacaguaaguaca

SEQ ID NO: 47862 - RNA, 435 nt, Artificial Sequence
  derived and/or modified sequence opt6 from anti-HIV_cap256-059-144685_VR-Chain
caaguacauuuaguagaaaguggaggaggaguaguacaaccaggaagaaguuuaagauuaaguugugcagcaaguggauuuacauuuucaaauuuugcaauggauuggguaagacaagcaccaggaaaaggauuagaauggguagcauuuguaaguagugauggaaauaauaaaaauuauggagauaguguaaaaggaagauuuacaauaaguagagauaauagcaaaaauacauuauuuuuacaaaugaauaguuuaagagcagaagauacagcauuauauuauuguguaaaagauguaggagauuauaaaagugaugaaugggcaacacauuauuauuaugauuuaaguauagcagauccaauacaagauccuagggcaguaguaggagcauuugauauauggggaagaggaacaaugguagcaguaaguagu

SEQ ID NO: 47863 - RNA, 432 nt, Artificial Sequence
  derived and/or modified sequence opt6 from anti-HIV_cap256-059-140017_VR-Chain
caaguacaauuaguagaaagcggaggaggaguaguacaaccaggaagaaguuuaagauuaagcugugcagcaagucaauuuucauucggaaauuuuggaaugcacuggguaagacaagcaccaggaaaaggacuagaauggguagcaggaauaucauuugcgggaacaaaaaaauauuaugcagauaguguaaaaggaagauuuacaauaagcagagacaauaguaaaagugcauuauuuuuacaaaugaauaguuugagagcagaagauacagcacuauauuacugugcaaaagacuuaagauauuaugaaugugaagaaugggcaucagacuauuaugauuucggaagagaucaaccaugucaagauccaagaggaguaguaggaacauuugauauguggggacaaggaacgaugguaacaguaaguuca

SEQ ID NO: 47864 - RNA, 432 nt, Artificial Sequence
  derived and/or modified sequence opt6 from anti-HIV_cap256-059-137547_VR-Chain
caaguacaauuaguagaaagcggaggaggaguaguacaaccaggaagaagcuuaagauuaaguugugcagcaagccaauucacauucucaagauauggaaugcacuggguaagacaagcaccaggaaaaggacuagaauggguagcagcaauaucauucgcaggaauaaaaaaaaacuaugcagauagcguaaaagggagauuuacaauaagcagagacaauaguaaaaacacauuauaucuacaaaugaauagcuuaagagcagaagauacagcacuauauuacugugcaagagacuugagagaauuugaaugcgaagaaugggcaucagacuauuacgauuucggacgagauuucccaugccaagacccaagaggaguaguaggaauauucgauauauggggacaaggaacaaugguaacaguaagcuca

SEQ ID NO: 47865 - RNA, 435 nt, Artificial Sequence
  derived and/or modified sequence opt6 from anti-HIV_cap256-059-131908_VR-Chain
caaguacaauuaguagaaaguggaggaggaguaguacaaccaggaagaagucuaagguuaaguuguacagcaaguggauuuacguuuaguaauuauggaauacauuggguaagacaagcaccaggaaaaggauuagaauggguagcagcaauaaguuaugaaggaaguauaaaauauuauguagauaguguaaaaggaagauuuacaauaaguagagaugauaguaaaaauacauuauuucuacaaaugaauaguuuaagaacagaagauacagcaguauauuauuguacaagagauguaagagaaugggaaacagaagaaugggcaacaaauuauuauuaugauuuaagcauagcauauccaauaagacauccaagaggaguaguaggaauauuugauguauggggauuaggaacaagaguaacaguaucaagu

SEQ ID NO: 47866 - RNA, 432 nt, Artificial Sequence
  derived and/or modified sequence opt6 from anti-HIV_cap256-059-116006_VR-Chain
caagcacaauuaguagaaagcggaggaggaguaguacaaccaggaagaaguuuacgauuaaguugugcagcaagucaauucucauucucaagcuauggaaugcacuggguaagacaagcaccaggaaaaggacuagaauggguagcaucaauaucauucgcaggaguaaaaaaaacaaaugcagauaguguaaaaggaagauuuacaauaagcagagacaauagcaaaaacacauuacaucuacaaaugaauggauuaagaaaugacgauacagcauuauauuacugugcaagagacuuaagagauuucgaaugcgaagaaugggcaagugacuauuacgauuucggaagagaauucccaugccaagacccaagaggaguaguaggaacauucgauauauggggacaaggaacaaaaguaacaguaagcuca

SEQ ID NO: 47867 - RNA, 411 nt, Artificial Sequence
  derived and/or modified sequence opt6 from anti-HIV_cap256-059-115783_VR-Chain
caaguacaauuaguagaaaguggaggaggaguaguacaaccaggaagaagucuaagauuaaguugugcagcaagucaauuuacguuuaguaguuauggaaugcauuggguaagacaagcaccaggaaaaggauuagaauggguagcagcaauaaguuaugcagauaguguaaaaggaagauuuacaauaaguagagauaauaguaaaaauacauuauauuuacaaaugaauaguuuaagagcagaagauacagcauuauauuacugugcaaaagauuuaagagaaauggaaugugaagaaugggcaagcgauuauuaugauuuuggaagagauuuaccaugucaagauccaagaggaguaguaggaacauuagauauauggggacaaggaacaaugguaacaguaaguagu

SEQ ID NO: 47868 - RNA, 432 nt, Artificial Sequence
  derived and/or modified sequence opt6 from anti-HIV_cap256-059-114609_VR-Chain
caaguacaauuaguagaaagcggaggaggaguaguacaaccaggaagaagcuuaagauuaagcugugcagcaagucaacuaacauucucaaacuuuggaaugcacuggguaagacaagcaccaggaaaaggacuagaauggguagcaggaauaucauucgcaggaacaaaaaaauacuaugcagauaguguaaaaggaagauuuacaauaagcagagacaauagcaaaaacgcacuauaucuacaaaugaauacauuaagagcagaagauacagcauuauauuucugugcaaaagacuuaagagaauacgaaugcgaagaaugggcaucagacuauuacgauuucggaagagaucaaccaugccaagacccaagaggaguaguaggaauauucgauauauggggacaaggaacaaugguaacaguaagcuca

SEQ ID NO: 47869 - RNA, 432 nt, Artificial Sequence
  derived and/or modified sequence opt6 from anti-HIV_cap256-059-113952_VR-Chain
caagcacaauuaguagaaaguggaggaggaguaguacaaccaggaagaaguuuaagauuaagcugugcagcaagucauuuuacauucaguaguuauggauuucauuggguaagacaagcaccaggaaaaggauuagaauggguagcaggaauaaguuuugcagcaacgaaaaaauauuaugcagauaguguaaaaggaagauuuacaauaaguagggauaauaguaaagaugcauuauauuuacaaaugaauaguuuaagagcagaagauacagcauuauauuauugugcaagagauuuaagaggauaugaaugugaagaaugggcaagugauuauuaugauuuuggaagagaucaaccaugucaagauccaagaggaguaguaggaauauuugauuuauggggacaaggaacaaugguaacaguaaguagu

SEQ ID NO: 47870 - RNA, 432 nt, Artificial Sequence
  derived and/or modified sequence opt6 from anti-HIV_cap256-059-113878_VR-Chain
caaguacaauuaguagaaaguggaggaggaguaguacaaccaggaagaaguuuaagauuaaguugugcagcaagcggauuuacauuuaguacauaugcaaugcauuggguaagacaagcaccaggaaaaggauuagaauggguagcauuaauaagcuaugaugcaacaaauaaauauuauguagacaguguaaaaggaagauuuacaauaaguagagauaauaguaaaaauacauuauauuuacaaaugucaaguuuaacagcagaagauacagcaguauauuauugugcaaaagauuuaggaggaauaaaaauagaugaauggggaacagauuauuaugauauaaguguaaguuauccaguacaagauccaagagcaguagcaggaauauuugauguauggggacauggaacaaugguaaguguaaguagu

SEQ ID NO: 47871 - RNA, 432 nt, Artificial Sequence
  derived and/or modified sequence opt6 from anti-HIV_cap256-059-113622_VR-Chain
caaguacaauuaguagaaagcggaggaggaguaguacaaccaggaagaaguuuaagauuaagcugugcagcaagccaauucacauucacaaguuauggaaugcacuggguaagacaagcaccaggaaaaggauuagaauggguagcaggaauaucauucgcaggaacaaaaaaacacuaugcagauagcguaaaaggaagauuuacaauaagcagagacaauagcaaaagcacacuauauuuacaaaugaauaguuuaagagcagaagauacagcauuauauuacugugcaaaagacaugagagaauacgaaugcgaagaaugggcaucagacuauuacgauuucggaagagaucaaccaugccaagacccaagaggaguaguaggaauauucgaucuauggggacaaggaacaaugguaacaguaagcagc

SEQ ID NO: 47872 - RNA, 432 nt, Artificial Sequence
  derived and/or modified sequence opt6 from anti-HIV_cap256-059-109427_VR-Chain
caaguacaauuaguagaaagcggaggaggaguaguacaaccaggaagaagcuuaagauuaagcugugcagcaagccaauucacauucucaaacuauggaaugcacuggguaagacaagcaccaggaaaaggacuagaauggguagcaucaauaucauucgcaggaauaaaaaaacacuauacagauagcguaaaaggaagauuuacaauaagcagagacaauagcaaaaacacacuauuucuacaaaugaauagccuaagagcagaagauacagcacuauauuacugugcaagagacuuaagagaauacgaaugcgaagaaugggcaucagacuauuacgauuucggaagagaucaaccaugccaagacccaagaggaguaguaggaacaagcgauauauggggacaaggaacaaaaguaacaguaagcuca

SEQ ID NO: 47873 - RNA, 432 nt, Artificial Sequence
  derived and/or modified sequence opt6 from anti-HIV_cap256-059-109081_VR-Chain
caagaacaauuaguagaaaguggaggaggaguaguacaaccaggaagaaguuuaagauuaagcugugcagcaagucaauuuaguuuuagugcauacggaaugcauuggguaagacaagcaccaggaaaaggauuagaauggguagcaggaauaaguuuugcagcaacaaaaaaauauuaugaagauaguguaaaaggaagauuuacaauaagcagagauaauaguaaaaauacauuauauuuacaaaugaauaguuuaagaggagaagauacagcauuauauuauugugcaaaagauaugagagaaauggaaugugaagaaugggcaagugauuauuaugauuuuggaagaccacaaccaugucaagauccaagaggaguaguaggaauauuugauauguggggacaaggaacaaugguaacaguaaguagu

SEQ ID NO: 47874 - RNA, 432 nt, Artificial Sequence
  derived and/or modified sequence opt6 from anti-HIV_cap256-059-107590_VR-Chain
caagaacaauuaguagaaaguggaggaggaguaguacaaccaggaagaaguuuaagauuaaguugugcagcgagucaauuuaguauaagugcauauggaaugcauuggguaagacaagcaccaggaaaaggauuagaauggguagcaggaauaaguuuugcaggaacaaaaaaauauuaugcagauaguguaaaaggaagauuuacaauaaguagagauaauaguaaaaauacauuauauuuacaaaugaauaguuuaagaggagaagauacagcauuauauuauugugcaaaagauaugagagaaauggaaugugaagaaugggcaagugacuauuaugauuuuggaagagaucaaccaugucaagauccaagaggaguaguaggaauauuugauauguggggacaaggaacaaugguaacaguaaguagu

SEQ ID NO: 47875 - RNA, 435 nt, Artificial Sequence
  derived and/or modified sequence opt6 from anti-HIV_cap256-059-107504_VR-Chain
caaguauuauuaguagaaaguggaggaggaguaguacaaccaggaaaaaguuuaagauuaaguuguagcgcaaguagauuuacauuuaguaauuauggaaugcauuggguaagacaagcaccaggaaaaggauuagaauggguagcagcaguaaguuuugcaggaauaaaaaaaacaaaugcagauaguguaaaaggaagauuuacaauaaguagagauaauaguaaaaauacauuauauuuacaaaugaauaguuuaagagcagaagauacagcauuauauuauugugcaagagauuuaagagauuuugaaugugaagaaugggcaagugauuauuaugauuuuuggggagauccacaaccaugucaagauccaagaggagugguaggaacauuugauuuauggggacaaggaacaaugguaacaguaaguagu

SEQ ID NO: 47876 - RNA, 432 nt, Artificial Sequence
  derived and/or modified sequence opt6 from anti-HIV_cap256-059-099614_VR-Chain
gaaguauuauuacuagaaaguggaggcggacuaguacaaccaggaagaaguuuaagauuaagcugugcagcaagccaauucacauucucaagcuauggaaugcacuggguaagacaagcaccaggaaaaggauuagaauggguagcaggaauaucauucguaggaauaaaaaaauacuaugcagauagcguaaaaggaagauuuacaauaagcagagacaauagcaaaaacacacuauaucuacaaaugaauagcuuaagagcagaagauacagcacuauauuacugugcaagagacuuaagagaauacgaaugcgaagaaugggcaucagacuauuacgauuucggaagagaucaaccaugccaagacccaagaggaguaguaggaacauucgauauauggggacaaggaacaaugguaacaguaaguuca

SEQ ID NO: 47877 - RNA, 432 nt, Artificial Sequence
  derived and/or modified sequence opt6 from anti-HIV_cap256-059-098972_VR-Chain
caaguacaacuaguagaaagcggaggaggaguaguacaaccaggaagaagccuaagauuaagcugugcagcaagccaauucacauuuucaagcuauggaaugcacuggguaagacaagcaccaggaaaaggacuagaauggguagcaucaauaucauucgcaggaauaaaaaaaaacuauagagauagcguaaaaggaagauuuacaauaagcagagacaauagcaaaaacacacuauauuuacaaaugacaagcuuaagaccagaagauacagcacuauauuacugugcaaaagacuuaagaggauucgaaugcgaagaaugggcaucagacuauuacgauuucggaagagaacuaccaugccaagacccaagaggaguaguaggaacauucgauauguggggacaaggaacaaugguaacaguaaguuca

SEQ ID NO: 47878 - RNA, 432 nt, Artificial Sequence
  derived and/or modified sequence opt6 from anti-HIV_cap256-059-097236_VR-Chain
caaguacaacuaguagaaaguggaggaggaguaguacaaccagggagaagcuuaagauuaagcugugcagcaaguggauuuagcuuuaguaauuuuggauuucauuggguaagacaagcaccaggaaaaggauuagaauggguagcagcaauaaguuuuguaggaaauaaaaaauauuaugcagaaaguguaaaaggaagauuuacaauaaguagagaaaauaguaaaaauauguuauuuuuacaaaugaauaguuuaagaggagaagauacagcaguauauuauugugcaaaagauuuaagagaauuugaaugugaagaaugggcaagugauuauuaugauuuuggaagagaacaaccaugucaagauccaagaggaguaguaggaaguauagauguauggggacauggaagucuaguaacaguaaguagc

SEQ ID NO: 47879 - RNA, 432 nt, Artificial Sequence
  derived and/or modified sequence opt6 from anti-HIV_cap256-059-091487_VR-Chain
caaguacaauuaguagaaagcggaggaggaguaguacaaccaggaagaucauuaagauuaagcugugcagcaagccaauucacauucaauagauauggaaugcacuggguaagacaagcaccaggaaaaggauuagaauggguggcaguaauaagcuacgauggaacaaacaaauacuauggagaaaguguaaaaggaagauuuacaauaaguagagacaauagcaaaaacacacuauaucuacaaaugaauagcuuaagagcagaagauacagcacuauauuacugugcaaaagacuuaagagaagacgaaugcgaagaaugguggucagacuauuacgauuucggaagagaauuaccaugcagaaaaaguagaggaguagcaggaauauucgauauauggggacaaggaacaaugguaacaguaagcuca

SEQ ID NO: 47880 - RNA, 432 nt, Artificial Sequence
  derived and/or modified sequence opt6 from anti-HIV_cap256-059-089812_VR-Chain
caaguacaauuaguagaaaguggaggaggaguaguacaaccaggaagaagcuuaagauuaagcugugcagcaagccaacuaacauucucaagcuauggaaugcacuggguaagacaagcaccaggaaaaggacuagaauggguagcaggaauaucauucgcaggaacaaaaaaacacuauagcgauagcguaaaaggaagauuuacaauaagcagagacaauagcaaaaacgcacuauaucuacaaaugaauagcuuaagagcagaagauacagcacuauauuacugugcaaaagacuuaagagaauacgaaugugaagaaugggcaucagacuauuacgauuucggaagagaacaaccgugccaagacccaagaggaguaguaggaauauucgauauguggggacaaggaacaaugguaacaguaagcuca

SEQ ID NO: 47881 - RNA, 432 nt, Artificial Sequence
  derived and/or modified sequence opt6 from anti-HIV_cap256-059-088468_VR-Chain
caaguacaauuaguagaaagcggaggaggaguaguacaaccaggaagaaguuuaagauuaagcugugcagcaagucaauuuacauuuaguaguuauggaaugcauuggguaagacaagcaccaggaaaaggauuagaauggguagcagcaauaaguuuuguaggaauaaaaaaauauuaugcaaauaguguaaaaggaagauuuacaauaaguagagauaauaguaaaaauacauuauauuuacaaaugaauaguuuaagagcagaagauacagcauuauauuauugugcaagagauuuaagagaauaugaaugugaagaaugggcaagugauuauuaugauuuuggaagaggaggaccaugucaagauccaagaggaguaguaggaaguuuugauauauggggacaaggaacaaugguaacaguaagcagu

SEQ ID NO: 47882 - RNA, 432 nt, Artificial Sequence
  derived and/or modified sequence opt6 from anti-HIV_cap256-059-088341_VR-Chain
caaguacaauuaguagaaagcggaggaggaguaguacaaccaggaagaagcuuaagauuaaguugugcagcaagccaauucacauucucaaguuauggaaugcacuggguaagacaagcaccaggaaaaggauuagaauggguagcagcaauaucauucgcaggaauaaaaaaacacuaugcagauagcguaaaaggaagauuuacaauaagcagagacaauagcaaaaacaugguauuuuuacaaaugaauagcuuaagagcagaagauacagcacuauauuacugugcaagagacuuaagagaauacgaaugcgaagaaugggcaucagacuauuacgauuucggaagagaucaaccaugccaagacccaagaggaguagugggaacaagcgauauauggggacaaggcacaaugguaacaguaagcuca

SEQ ID NO: 47883 - RNA, 432 nt, Artificial Sequence
  derived and/or modified sequence opt6 from anti-HIV_cap256-059-086533_VR-Chain
caaguauuauuaguagaaagcggaggaggaguaguacaaccaggaagaaguuuaagauuaagcugugcagcaagucaauucacauucucaaauuuuggaaugcacuggguaagacaagcaccaggaaaaggauuagaauggguagcaggaauaucauucguaggaauaaaaaaauacuaugcaggaagcguaaaaggaagauuuacaauaagcagagacaauagcaaaaacacacuauaucuacaaaugaauagcuuaagagcagaagauacagcacuauauuacugugcaaaagacuuaagagaauuugaaugugaagaaugggcaucagacuauuacgauuucggaagaccacaaccaugucaagacccaagaggaguaguaggaacauucgauuuauggggacuaggaacacuaguaacaguaaguuca

SEQ ID NO: 47884 - RNA, 432 nt, Artificial Sequence
  derived and/or modified sequence opt6 from anti-HIV_cap256-059-086043_VR-Chain
gaaguacauuuaguagaaaguggaggaggauuaguaaaaccaggaggaaguuuaagauuaaguugugcagcaaguggauuuacauuuaguacauauaguaugaauuggguaagacaagcaccaggaaaaggauuagaauggguagcauuuguagcauuugaugaaagugauaaauauuaugcagauaguguaaaaggaagauuuacaauaaguagagauaauaguaaaaauacauuaaguuuacaaaugaauaguuuaagaguagaagauacagcaauauauuauugugcaaaagaaguaggagauaauaaagaugaugaaugggcaagugauuauuaugauuuaaguauagcauauccaauacaagauccaagagcaguaggaagaggauaugauauauggggacaaggaacaaugguaacaguaaguagu

SEQ ID NO: 47885 - RNA, 432 nt, Artificial Sequence
  derived and/or modified sequence opt6 from anti-HIV_cap256-059-084191_VR-Chain
caaguacaauuaguagaaagcggaggaggaguaguacaaccaggaagaaguuuaagauuaaguugugcagcaagccaauucacauucucaagcuauggaaugcacuggguaagacaagcaccaggaaaaggauuagaauggguagcagcaauaucauucguaggaauaaaaaaauacuaugcagauagcguaaaaggaagauuuacaguaaguagagacaauaguaaaagcacacuauauuuacaaaugaauagcuuaagagcagaagauacagcgcuauauuacugugcaagagacuuaagagaauacgaaugcgaagaaugggcaucagacuauuacgauuucgggagagaucaaccaugucaagacccaagaggaguaguaggaauauucgauauauggggacaaggaacagcaguaacaguaaguagu

SEQ ID NO: 47886 - RNA, 417 nt, Artificial Sequence
  derived and/or modified sequence opt6 from anti-HIV_cap256-059-082135_VR-Chain
caaguacaauuaguagaaucaggaggaggaguaguacaaccaggaagaucacuaagacuaucauguacagcaucaggauuuacauuuagaucauacgcaauacauuggguaagacaagcaccaggaaaaggauuagaauggguagcacuaauaagcuaugacggaaguaauaaauauuacgcagacucaguaaaaggaagauucacaauaucaagagauaacagcaaaaauacauuauacuuacaaaugaacucacuaacaucagaagacacagcaguauacuauugcgcaaaagaucuaggaggaucaaaaacagacgaauggggaacagauuacuguuacccaguacaagacccaagaguaguaguaggagcauucgauauauggggacauggaacaaugguaacaguaagcuca

SEQ ID NO: 47887 - RNA, 432 nt, Artificial Sequence
  derived and/or modified sequence opt6 from anti-HIV_cap256-059-079417_VR-Chain
caaguacaauuaguagaaaguggaggaggaguaguacaaccaggaagaaguuuaagauuaaguugugcagcaaguggauuuaguuuuaguaauuaugcaauggauuggguaagacaagcaccaggaaaaggauuagaauggguagcauuuguaaguagugauggaaauaauaaaaaauaugcagauaguguaaaaggaagauuuacauuaaguagagauaauuauaaaaauacaguauauuugcaaaugaauaguuuaacaguagaagauacagcaguauauuauugugcaaaagauuuaggagcaaauaaagaugaugaauggggaacagauuauuaugauaugaguguaagcuauccaauaccagauccaagagcaguaguaggagcauuugauguauggggacaaggaacauuaguaacaguaaguagu

SEQ ID NO: 47888 - RNA, 435 nt, Artificial Sequence
  derived and/or modified sequence opt6 from anti-HIV_cap256-059-076027_VR-Chain
caaguacaauuaguagaaaguggaggaggaguaguacaaccaggaagaaguuuaagauuaagcugugcagcaucaggauuuagcuuuaguaaauauggaaugcauuggguaagacaagcaccaggaaaaggacuagaauggguagcauuuguagcauuugaugaaagcgaaaaauauuaugcagcaaguguaaaaggaagauuuacaauaaguagagauaauaguaaaaauacauuaaguuuacaaaugaauaguuuaagaacagaagauacagcaauauauuauugugcaaaagaaguaggagauaauaaagacgaugaauggacaaguccauauuauuaugauauaaguauagcauauccaguacaugauccaagagcaguaguaggaguaagugauguauggggacaaggaacaaugguaacaguaagcagu

SEQ ID NO: 47889 - RNA, 432 nt, Artificial Sequence
  derived and/or modified sequence opt6 from anti-HIV_cap256-059-075082_VR-Chain
caaguacaauuaguagaaagcggaggaggaguaguacaaccaggaagaagcuuaagauuaagcugugcagcaagccaauucacauucucaagcuauggaaugcacuggguaagacaagcaccaggaaaaggacuagaauggguagcagcaauaucauucguaggaauaaaaaaauacuaugcagauagcguaaaaggaagauuuacaauaagcagagacaauagcaaaaacacauuauaucuacaaaugaauagcuuaagagcagaagauacagcacuauauuacugugcaaaagacuuaagagaaauggaaugcgaagaaugggcaucagacuauuacgauuucggaagagaucuaccaugccaagacccaagaggaguaguaggaacacuagauauauggggacaaggaacaaugguaacaguaagcuca

SEQ ID NO: 47890 - RNA, 432 nt, Artificial Sequence
  derived and/or modified sequence opt6 from anti-HIV_cap256-059-072575_VR-Chain
caaggacaauuaguagaaagcggaggaggaguaguacaaccaggaagaaguuuaagauugagcugugcagcaagucaauuuacauuuaguaauuuuggaaugcauuggguaagacaagcaccaggaaaaggauuagaauggguagcaguaauaaguuaugauggaacgaaaaaauauuaugcagauaguguaaaaggaagauuuacaauaaguagagauaauagcaaaaauacauuauaucuacaaaugaauaguuuaagagcagaagauacagcauuauauuauugugcaaaagauaugagagaagaugaaugugaagaauggggagcagacuauuaugauuucggaaaagauuauccaugucaagcaaguagaggaguaguaggaauauuugauauauggggacaaggaacaaugguaacaguaagugca

SEQ ID NO: 47891 - RNA, 432 nt, Artificial Sequence
  derived and/or modified sequence opt6 from anti-HIV_cap256-059-071926_VR-Chain
caaguacaauuaguagaaaguggaggaggaguaguacaaccaggaagaagcuuaagauuaaguugugcagcaagccaacuaucauucucaaacuauggaaugcacuggguaagacaagcaccaggaaaaggacuagaauggguagcaggaauaucauucguaggcauaaaaaaauacuauagagauagcguaaaaggaagauuuacaauaagcagagacaauagcaaaaacacacuauaucuacaaaugaauagcuuaagaacagaagauacagcacuauauuacuguguaaaagacuuaagagaauucgaaugcgaagaaugggcaucggacuauuacgauuucggaagagaucaaccaugcuuagacccaagaggaguaguaggaacauucgauauauggggacaaggaacaaugguaacaguaagcuca

SEQ ID NO: 47892 - RNA, 432 nt, Artificial Sequence
  derived and/or modified sequence opt6 from anti-HIV_cap256-059-069638_VR-Chain
caaguacaauuaguagaaagcggaggaggaguaguacaaccaggaagaaguuuaagauuaaguugugcagcaaguggauuuacauuuaguaaaaaugcaaugcauuggguaaggcaagcaccaggaagaggauuagaauggguagcaaguguagcauuugauggaagugauaaauauuaugcagauaguguaaaaggaagauuuacaauaagcagagauaauaguaaaaauacauuaaguuuacaaaugaauaguuuaagggcagaagauacagcaguauauuauugugcaaaagaaguagauuuauauaaagaugaugaauggggaagugauuauuaugauuuaaguauagcauauccaauacaagauccaagagcaguaguaggaggauuuggaauauggggacaaggaacaaugguaacaguaaguagc

SEQ ID NO: 47893 - RNA, 432 nt, Artificial Sequence
  derived and/or modified sequence opt6 from anti-HIV_cap256-059-069165_VR-Chain
uuaguacaauuaguagaaaguggaggaggaguaguacaaccaggaagaaguuuaagauuaaguugugcagcaaguagauuuacauuuaguaauuauggaaugcauuggguaagacaagcaccaggaaaaggacuagaauggguagcaggaauaaguuuugcaggaacaacaaaauauuaugcagauaguguaagaggaagauuuacaauaaguagagauaauaguaaaaauacauuauauuuacaaaugaauaguuuaagagcagaagauacagcauuauauuauugugcaaaagauaugagagaaauggaaugugaagaaugggcaagugauuauuaugauuuuggaagaccacaaccaugucaagauccaagaggaguaguaggaauauuugauauauggggacaaggaacaaugguaacaguaaguagu

SEQ ID NO: 47894 - RNA, 432 nt, Artificial Sequence
  derived and/or modified sequence opt6 from anti-HIV_cap256-059-068956_VR-Chain
caaguacaauuaguagaaagcggaggaggaguaguacaaccaggaagaagccuaagguuaaguugugcagcaaguggauuuacauuuaguacauaugcaaugcauuggguaagacaagcaccaggaagaggauuagaauggguagcauuaauaaguuaugauggaaguaauaaauauuauguagauagcguaaaaggaagauuuacaauaaguagagauaauaguaaaaauacacuauauuuacaaaugaauaguuuaacagcagaagauacagcaguauauuauugugcaaaagauuuaggaggaaguaaagaugaugaaugggcaacagauuauuaugauuuaagcauagcauauccaauacaagauccaagagcaguagcaggaauauuugauguauggggaagaggaacaguaguaacaguaaguagu

SEQ ID NO: 47895 - RNA, 432 nt, Artificial Sequence
  derived and/or modified sequence opt6 from anti-HIV_cap256-059-068876_VR-Chain
caaguacaauuaguagaaagcggaggaggaguaguacaaccaggaagaagcuuaagauuaagcugugcagcaagucaauucacauucucaagcuauggaaugcacuggguaagacaagcaccaggaaaaggacuagaauggguagcagcaauaucauucgcaggaacaaaaaaauacuaugcaaauaguguaaaaggaagauuuacaauaagcagagacaauagcaaaaacacacuaucacuacaaaugaauagcuuaagaggggaagauacagcaagauauuacugugcaagagacccaagagaauacgaaugcgaagaaugggcaucagacuauuacgauuucggaagagaucaaccaugccaagacccaagaggaguaauaggaauauucgauauauggggacaaggaacaaugguaacaguaagcuca

SEQ ID NO: 47896 - RNA, 432 nt, Artificial Sequence
  derived and/or modified sequence opt6 from anti-HIV_cap256-059-067733_VR-Chain
caaguacaauuaguagaaagcggaggaggaguaguacaaccaggaagaagcuuaagauuaagcuguacagcaagccaauucucauucucaaguuauggaaugcacuggguaagacaagcgccaggaaaaggacuagaauggguagcagcaauaucauucgcaggaacaaaaaaaaacuauguagauagcguaaaaggaagauuuacaauaagcagagacaauagcaaaaacacacuauaucuacaaaugaauagcuugagagcagacgauacagcacuauauuacugugcaaaagacaugagagaauacgaaugcgaagaaugggcaucagacuauuacgauuucggaagagaauacccaugcacagacccaagaggaguaguaggaacauucgauguauggggacaaggaacaaugguaacaguaaguuca

SEQ ID NO: 47897 - RNA, 432 nt, Artificial Sequence
  derived and/or modified sequence opt6 from anti-HIV_cap256-059-067450_VR-Chain
caaguacaauuaguagaaagcggaggaggaguaguacaaccaggaagaagcuuaagauuaagcugugcagcaagucaauucacauucucaaacuauggaaugcacuggguaagacaagcaccaggaaaaggacuagaauggguagcaggaauaucauucgcaggaauaaaaaaauacuaugcagauagcguaaaaggaagauuuacaauaagcagagacaaugcaaaaaacacauuauaucuacaaaugaauagccuaagagcagaagauacagcacuauauuacugugcaaaagacuuaagagaauacgaaugcgaagaaugggcaucagacuauuacgauuucggaagagaacuaccaugccaagacccaagaggaguaguaggaacauucgauauauggggacaaggaacaaugguaacaguaagcuca

SEQ ID NO: 47898 - RNA, 432 nt, Artificial Sequence
  derived and/or modified sequence opt6 from anti-HIV_cap256-059-065694_VR-Chain
caaguacaauuaguagaaagcggaggaggaguaguacaaccaggaagaagccuaagauuaagcugugcagcaagccaauuaacauucaauaacuauggaaugcacuggguaagacaaacaccaggaaaaggacuagaauggguagcaggaauaucauucgcaggaauaaauaaauacuaugcagauaguguaaaaggaagauuuacaauaagcagagacaauagcaaaaacgcacuauaucuacaaaugacaucauuaagagcagaagauacagcacuauauuacuguguaaaagacuuaagagaaauggaaugcgaagaaugggcaagcgacuauuacgauuucggaagagaucaaccaugccaagacccaagaggaguaguaggaacauucgauauauggggacaaggaacaaugguaacaguaagcuca

SEQ ID NO: 47899 - RNA, 432 nt, Artificial Sequence
  derived and/or modified sequence opt6 from anti-HIV_cap256-059-065109_VR-Chain
caaguacaauuaguagaaaguggaggaggaguaguacaaccaggaaaaaguuuaagauuaaguugugcagcaagcggauuuacauuuacaaauaaugcaaugaauuggguaagacaagcaccaggaaaaggauuagaauggguagcauuuguaaguagugauggaaggaauaaaaauuaugcagauagcguaaaaggaagauuuacaauaaguagagauaauaguaaaaauacaguauauuuacaaaugaauaguuuaagaguagaagauacagcauuauauuauugugcaaaagauuuaggagcaaauaaagaugaugaaugggcaacagauuauuaugauuuaaguguagcauauccaauaccagauccaagagcaguaguaggagcauuugauguguggggacaaggaacaaugguaacaguaaguagu

SEQ ID NO: 47900 - RNA, 432 nt, Artificial Sequence
  derived and/or modified sequence opt6 from anti-HIV_cap256-059-065060_VR-Chain
caaguacaauuaguagaaaguggaggaggaguaguacaaccaggaacaaguuuaagauuaagcugugcagcaaguggauuuacauucaguaauuaugcaaugggauggguaagacaagcaccaggaaaaggacuagaauggguagcaguaguaaguuaugauggaaguaaaaaaaguuaugcagauaguguaaaagggagauuuacaauaagcagagacaauagcagaaauacauuauauuuacaauuaaauagucuaagagcagaagauacagcaauguuuuacugugcaaaagacuuaggaaaaggagaaauagaagaaugggcaacagacuauuaugauuggucaaaagcauauccaauagaaggaccaagagauguaguaggagcauuugauacauggggacaaggaacacuaguaacaguaaguuca

SEQ ID NO: 47901 - RNA, 432 nt, Artificial Sequence
  derived and/or modified sequence opt6 from anti-HIV_cap256-059-064001_VR-Chain
caaguacaauuaguagaaagcggaggaggaguaguacaaccaggaagaagcuuaagauuaagcugugcagcaagccaauucacauucucaaauuauggaaugcacuggguaagacaagcaccaggaaaaggauuagaauggguagcaggaauaucauucgcaggaacaaaaaauuacuaugcaaaaagcguaaaaggaagauuuacaauaaguagagacaauagcaaaaacgcacuauaucuacaaaugaauagcuuaagagcagaagauacagcacuauauuacugugcaaaagacaugagagaauacgaaugcgaagaaugggcaucagacuauuacgauuucggaagagaucaaccaugccaagacccaagaggaguaguaggaacauucgauauauggggacaaggaacaaugguagcaguaagcuca

SEQ ID NO: 47902 - RNA, 432 nt, Artificial Sequence
  derived and/or modified sequence opt6 from anti-HIV_cap256-059-063270_VR-Chain
caaguacaauugguagaaagcggaggaggaguaguacaaccaggaagaagcuuaagauuaagcugugcagcaagccaauucacauucucaaacuauggaaugcacuggguaagacaagcaccaggaaaaggacuagaauggguagcagcaauaucauucgcaggaacaaaaaaacacuaugcagauagcguaaaaggaagauuuacaauaagcagagacaauagcaaaaacgcacuauauuuacaaaugaauagccuaagagcagaagauacagcacuauauuacugugcaaaagacuuaagagaauacgaaugcgaagaaugggcaucagacuauuacgauuucggaagagaucaaccaugcuuagacccaagaggaguaguaggaauauucgauauauggggacaaggaacacuagugacaguaagcuca

SEQ ID NO: 47903 - RNA, 432 nt, Artificial Sequence
  derived and/or modified sequence opt6 from anti-HIV_cap256-059-061357_VR-Chain
caaguacaauuaguagaaaguggaggaggaguaguacaaccaggaagaaguuugagauuaagcugugcagcaagcggauuuacauuuaguaauuuuggauuucauuggguaagacaagcaccaggaaaaggauuagaauggguagcaggaauaaguuuugcaggaacaaaaauauauuaugcagauaguguaaaaggaagauuuacaauaagcagagaaaauaguaaaaauauguuauauuuacaaaugaauaguuuaagaggagaagauacagcaguauauuuuugugcaaaagauuuaagagaauuugaaugugaagaaugggcaagugauuauuaugauuuuggaagagaauuuccaugucaagauccaagaggaguaguaggaacauuugauguauggggacauggagcaguaguaacaguaagcagu

SEQ ID NO: 47904 - RNA, 435 nt, Artificial Sequence
  derived and/or modified sequence opt6 from anti-HIV_cap256-059-059834_VR-Chain
caaguacaauuaguagaaaguggaggaggaguaguacaaccaggaagaaguuuaagauuaaguugugcagcaagcggauuuacauuuaguaauuuuggaaugcauuggguaagacaagcaccaggaaaaggauuagaauggguagcauuuguagcauuugaugaaagugauaaauauuaugcagcaucaguaaaaggaagauuuacaguaaguagagauaauaguaaaaauacaguaagccuacaaaugaauaguuuaagaacagaagauacagcaguauauuauugugcaaaagaaguaggagauaauaaagaugaugaauggacaaguccauauuauuaugauuuuaguauagcauauccaguacaugauccaagagcaguaguaggaggauaugauguauggggacaaggaacgaugguaacaguaaguagu

SEQ ID NO: 47905 - RNA, 432 nt, Artificial Sequence
  derived and/or modified sequence opt6 from anti-HIV_cap256-059-059313_VR-Chain
caaguacacuuaguagaaagcggaggaggaguaguacaaccaggaaaaagcuuaagauuaagcugugcagcaagccaauucacauucucaaacuuuggaaugcacuggguaagacaagcaccaggaaaaggacuagaauggguagcaggaauaucauucgcaggaacaaaaaaauacuaugcagauaguguaaaaggaagauuuacaauaagcagagacaauagcaaaaacacacuauaucuacaaaugaauagcguaagagcagaagauacagcacuauauuacugugcaaaagacaugagagaauacgaaugcgaagaaugggcaucagacuauuacgauuucggaaaaccacaaccaugccaagacccaagaggaguaguaggaacauucgauauguggggauuaggaacacuaguaacaguaagcuca

SEQ ID NO: 47906 - RNA, 432 nt, Artificial Sequence
  derived and/or modified sequence opt6 from anti-HIV_cap256-059-057130_VR-Chain
caaguacaauuaguagaaagcggaggaggaguaguacaaccaggaagaagcuuaagauuaagcugugcagcaagucaauucucauuuucaagcuauggaaugcacuggguaagacaagcaccaggaaaaggacuagaauggguagcagcaauaucauucgcaggaauaaaaaaacacuaugcagauagcguaaaaggaagauuuacaauaagcagagacaauagcaaaaacacauuauaucuacaaaugaauagcuuaagaguagaagauacagcacuauauuacugugcaaaagacuuaagagaauacgaaugcgaagaaugggcaucagacuauuacgauuucggaagaccacaaccaugucaagacccaagaggaguaguaggaacaagcgauauauggggacaaggaacaaugguaacaguaaguuca

SEQ ID NO: 47907 - RNA, 411 nt, Artificial Sequence
  derived and/or modified sequence opt6 from anti-HIV_cap256-059-050520_VR-Chain
caagugcaauuaguagaaaguggaggaggaguaguacaaccaggaagaagucuaagauuaaguugugcagcaagucaauuuacauuuaauagguauggaaugcauuggguaagacaagcaccaggaaaaggauuagaauggguagcaguaauaaguuaugcagauaguguaaaaggaagauuuacaauaaguagagauaauagcaaaaauacauuauauuuacaaaugaauaguuuaagagcagaagauacagcauuauauuauugugcaaaagauuuaagagaagaugaaugugaagaaugguggagugauuauuaugauuuuggaagagaauuaccauguagaaaaaguagaggaguagcaggaauauuugauauauggggacaaggaacaaugguaacaguaaguagu

SEQ ID NO: 47908 - RNA, 432 nt, Artificial Sequence
  derived and/or modified sequence opt6 from anti-HIV_cap256-059-049839_VR-Chain
caaguacaauuaguagaaaguggaggaggaguaguacaaccaggaagaaguuuaagauuaaguugugcagcaaguggauuuaguuuuaguaauuaugcaauggauuggguaagacaagcaccaggaaaaggauuagaauggguagcgguaguaaguagcgauggaaaaacaaaaaauuaugcagauaguguaaaaggaagauuuacaauaaguagagauaauaguaaaaauacaguauauuuacaaaugaauaguuuaagaccagaagauacagcaguauauuauugugcaaaagacuuaggagcaaauaaagaugaugaauggacaacagauuauuaugauuggaguguagcauauccaguaccagauccaagagcaguaguaggagcauuugauguauggggacaaggaacaaugguaacaguaagcagu

SEQ ID NO: 47909 - RNA, 432 nt, Artificial Sequence
  derived and/or modified sequence opt6 from anti-HIV_cap256-059-048503_VR-Chain
caaguacaauuaguagaaagcggaggcggaguaguacaaccaggaagaagcuuaagacuaaguugugcagcgagccaacuaucauucucaaacuauggaaugcacuggguaagacaagcacccggaaaaggacuagaauggguagcaggaacaucauucgcaggaacaaaaaaauacuaugcagauagcguaaaaggaagauuuacaauaagcagagacaauaguaaaaacgcacuauaucuacaaaugaauaguuuaagagcagaagauacagcauuauauuacugugcaaaagacuuaagagaauacgaaugcgaagaaugggcaucagacuauuacgauuucggaagagaucaaccaugccaagacccaagaggaguaguaggaacauucgauauauggggacaaggaacaaugguaacaguaagcgca

SEQ ID NO: 47910 - RNA, 432 nt, Artificial Sequence
  derived and/or modified sequence opt6 from anti-HIV_cap256-059-045516_VR-Chain
caaguacaauuaguagaaaguggaggaggaguaguacaaccaggaagaaguuuaagauuaaguugugcagcaagucaauuuacauuuucaggauauggaaugcauuggguaagacaagcaccaggaaaaggauuagaauggguagcagcaauaaguuuugcaggaaauaaaagauauuuugcagauaguguaaaaggaagauuuacaauaaguagagauaauaguaaaaauacauuauuuuuacaaaugaauaguuuaagagcagaagauacagcauuauauuauugugcaagagauaugagagaauaugaaugugaagaaugggcaagugauuauuaugauuuuggaagaccacaaccaugucaagauccaagaggaguaguaggaguauuugauauauggggacaaggaacaaugguaacaguaaguagu

SEQ ID NO: 47911 - RNA, 432 nt, Artificial Sequence
  derived and/or modified sequence opt6 from anti-HIV_cap256-059-044188_VR-Chain
caaguacauuuaguagaaaguggaggaggaguaguacaaccaggaagaaguuuaagauuaagcugugcagcaagucaauucacauuuucaaguuauggaaugcacuggguaagacaagcaccaggaaaaggacuagaauggguagcaggaauaucauucgcaggaacaaauaaauauuaugcagauaguguaaaaggaagauuuacaguaagcagagacaauaguaaaaauacauuauauguacaaaugaauaguuuaagagcagaagauacagcacuauauuauugugcaagagauuuaagagaauacgaaugugaagaaugggcaucagacuauuaugauuucggaagagaacaaccaugucaagacccaagaggaguaguaggaauauuugauauauggggaccaggaacaaugguaacaguaaguuca

SEQ ID NO: 47912 - RNA, 435 nt, Artificial Sequence
  derived and/or modified sequence opt6 from anti-HIV_cap256-059-044105_VR-Chain
caaggacaauuaguagaaaguggaggaggaguaguacaaccaggaagaaguuuaaguuuaaguugugcagcaaguggauuuaguuuuaauaauuaugcaauggauuggguaagacaagcaccaggaaaaggauuagaauggguagcaguaguaaguagugauggaaauaauaaaaauuaugcagauaguguaaaaggaagauuuacaauaaguagagauaauaguaaaaauacaguauaucuacaaaugaauaguuuaagagcagaagauacagcaauauauuauugugcaaaagauguaggagcaaauaaagaugaugaaugggcaacaaauuauuauuaugauuggucaguagcauauccaguaccagauccaagagcaguaauaggagcauuugauguauggggacaaggaacaaugguaacaguaaguagu

SEQ ID NO: 47913 - RNA, 432 nt, Artificial Sequence
  derived and/or modified sequence opt6 from anti-HIV_cap256-059-042100_VR-Chain
caaguacaauuaguagaaagcggaggaggaguaguacaaccaggaagaagccaaagauuaagcugugcagcaagccaauucacauucucgagcuauggaaugcacuggguaagacaagcaccaggaaaaggacuagaauggguagcagcaauaucauucgcaggaacaaacaaauacuauggagauagcguaaaaggaagauuuacaauaaguagagacaauagcaaaaacacacuauaucuacaaaugaauaguuuaagagcagaagauacagcacuauaucacugugcaagagacaugagagaauacgaaugugaagaaugggcaucagacuauuacgauuucggaagagaucaaccaugccaagacccaagaggaguaguaggaauauucgauuuauggggacaaggaacaaugguaacaguaagcuca

SEQ ID NO: 47914 - RNA, 432 nt, Artificial Sequence
  derived and/or modified sequence opt6 from anti-HIV_cap256-059-040742_VR-Chain
caaguacaauuaguagaaacaggaggaggagucggacaaccaggaaaaaguuuaagauuaagcugugcagcaagcggauucacauucucaaacuuugcaauggacuggguaagacaagcaccaggaaaaggacuagaauggguagcauuuauaucaagcgauggaauaaacaaaaaauauggagauuucguaaaaggaagauuuacaauaaguagagacaauagcaaaaacacacuauuucuacaaaugaauagcuugagagcagaagacacagcauuauauuacugugcaaaagacguaggagauuacaaaagcgaugaauggggaacagacuauuacgaucuaucgauagaauacccaauacaagacccaagagcaguaguaggagcauucgauaacuggggacaaggaacaaugguaauaguaagcuca

SEQ ID NO: 47915 - RNA, 432 nt, Artificial Sequence
  derived and/or modified sequence opt6 from anti-HIV_cap256-059-040554_VR-Chain
caaguacaauuaguagaaagcggaggaggaguaguacaaccaggaagaaguuuaagauuaagcugugcagcaagucaauucacauucucaaguuauggaaugcacuggguaagacaagcaccaggaaaaggauuagaauggguagcaggaauaucauucgcagcaacaaauaaauacuauggaggaagcguaaaaggaagauuuacaauaagcagagacaauaguaaaaacacacuauaucuacaaaugaauaguuuaagagcagaagauacagcauuauauuacuguacaagagacaugagagaauaugaaugugaagaaugggcaagugacuauuaugauuucggaaaagaucaaccaugucaagacccaagaggaguaguaggaacacuagauauauggggacaaggaacaaugguaacaguaaguuca

SEQ ID NO: 47916 - RNA, 432 nt, Artificial Sequence
  derived and/or modified sequence opt6 from anti-HIV_cap256-059-039660_VR-Chain
caaguacaauuaguagaaagcggaggaggaguaguacaaccaggaagaagcuuaagauuaagcugugcagcaagccaauucucauucucaaacuauggaaugcacuggguaagacaagcaccaggaaaaggacuagaauggguagcaucaauaucauucgcaggaacaaaaaaaaaauaugcagauagcguaaaaggaagauuuacaauaagcagagacaauagcaaaaauacacuauuucuacaaaugaauagcuuaagaacagaagaugcagcacuauauuacugugcaaaagacaugagagaauucgaaugcgaagaaugggcaucggacuauuacgauuucggaagagaacaaccgugccaagacacaagagauguaguaggaauauucgauauauggggacaaggaacaaugguaacaguaaguuca

SEQ ID NO: 47917 - RNA, 435 nt, Artificial Sequence
  derived and/or modified sequence opt6 from anti-HIV_cap256-059-039298_VR-Chain
caaguacaauuaguagaaagcggaggaggaguaguacaaccaggaagaaguuuaagauuaaguugugcagcaaguggauuuacauuuaguaaauauggaaugcauuggguaagacaagcaccaggaaaaggauuagaauggguagcauuuguagcauuugacgaaagugauaaauauuaugcagcaagugcaaaaggaagauuuauaauaaguagagauaauaguaaaaauacauuaaguuuacaaaugaauaguuuaagaacagaagauacagcaguauauuauugugcaaaagaaguaggagauaauaaagaugaugaauggacaaguccauauuauuaugauauaaguauagcauauccgguacaagauccaagagcaguaguaggaggauaugauguauggggacaaggaacaaugguaacaguaaguagu

SEQ ID NO: 47918 - RNA, 432 nt, Artificial Sequence
  derived and/or modified sequence opt6 from anti-HIV_cap256-059-037873_VR-Chain
caaguacaacuaguagaaaguggaggaggaguaguacaaccaggaagaagcuuaagauuaaguugugcagcaagucaauucacauucucaaacuauggaaugcauuggguaagacaagcaccaggaaaaggacuagaauggguagcagcaauaucauucgcaggaauaaacaaauacuaugcagauagcguaaaaggaagauuuacauuaagcagagacaauacaaaaaacacacuauauuuacaaaugaauagcuuaagagcagaagauacagcacuauauuacugugcaagagacuuaagagaauaugaaugcgaagaaugggcaucagacuauuacgauuucggaagaccacaaccaugccaagacccaagaggaguaguaggaacaagcgauauauggggacaaggaacaaugguaacaguaagcuca

SEQ ID NO: 47919 - RNA, 432 nt, Artificial Sequence
  derived and/or modified sequence opt6 from anti-HIV_cap256-059-037633_VR-Chain
caaguacaauuaguagaaagcggaggaggaguaguacaaccaggaagaucauuaagauuaagcugugcagcaagccaauuuacauucagcaacuuuggaaugcacuggguaagacaagcaccaggaaaaggacuagaauggguagcagcaauaucauucgcaggaauaaacaaaaacuaugcagauagcguaaaaggaagauuuacaauaagcagagacaauagcaaaaauacacuacaucuacaacuaaauaguuuaagagcagaagauacagcauuauauuacugugcaaaagacuuaagagaauacgaaugcgaagaaugggcaucagacuauuacgauuucggaagagaucaaccaugccaagacccaagaggaguaguaggaacauuugauauauggggacaaggaacaaugguaacaguaagcucg

SEQ ID NO: 47920 - RNA, 432 nt, Artificial Sequence
  derived and/or modified sequence opt6 from anti-HIV_cap256-059-036817_VR-Chain
caaguacaauuacuagaaagcggaggaggaguaguacaaccaggaagaagcuuaagauuaagcugugaagcaagccaauucacauucucaaacuuuggaaugcacuggguaagacaagcaccaggaaaaggacuagaauggguagcagcaauaucauucgcaggaauaaaaaaaaacuaugcagauaguguaaaagggagauuuacaauaagcagagacaauaguaaaaacacacuauaucuacaaaugaauagcuuaagaguagaagauacagcacuauauuacugugcaaaagacuuaagagaauacgaaugcgaagaaugggcaucagacuauuacgauuucggaagagaacaaccaugccaagacccaagaggaguaauaggaacauucgauauauggggacaaggaacaaugguaacaguaagcuca

SEQ ID NO: 47921 - RNA, 432 nt, Artificial Sequence
  derived and/or modified sequence opt6 from anti-HIV_cap256-059-032787_VR-Chain
caaguacaauuaguagaaaguggaggaggaguaguacaaccaggaagaaguuuaagauuaaguugugcagcaagcggauuuacauucaguaaauaugcaaugcauuggguaagacaagcaccaggaaaaggacuagaauggguagcauuuguagcauuugaugaaagugauaaauauuauguagauaguguaaaaggaagauuuacaauaaguagagauaauaguaaaaauacauuaaguuuacaaaugaauaguuuaagagcagaagauacagcaguauauuauugugcaaaagaaguacauguaaauaaagaugaugaaugggcaagugauuauuaugauuuaaguauagcauauccaauacaagauccaagagcaguaguaggaggauuagauauauggggacaaggaacaaugguaacaguaaguagu

SEQ ID NO: 47922 - RNA, 432 nt, Artificial Sequence
  derived and/or modified sequence opt6 from anti-HIV_cap256-059-032427_VR-Chain
caaguacaauuaguagaaucaggaggaggaguaguacaaccaggaagaaguuuaagauuaagcugugcagcaagccaauucacauuuucaaauuuuggaaugcacuggguaagacaagcaccaggaaaaggacuagaauggguagcaggaauaucauuuccaggaacaaaaaaauacuaugcagauaguguaaaaggaagauuuacaauaagcagagacaauagcaaaaaugcauuauaucuacaaaugaauagcuuaagagcagaagauacagcacuauauuauugugcaagagaucuaagagaauaugaaugugaagaaugggcaucagacuauuaugauuucggaaaaccacaaccauguuuagacccaagaggaguaguaggaacauuugauauauggggacaaggaacaaugguaacaguaaguuca

SEQ ID NO: 47923 - RNA, 435 nt, Artificial Sequence
  derived and/or modified sequence opt6 from anti-HIV_cap256-059-029390_VR-Chain
caaguacaauuaguagaaucaggaggaggaguaguacaaccaggaagaucacuaagacuaucaugcgcagcaucaggauuuacauuuaaccaacacggaaugcauuggguaagacaagcaccagacaaaggacuagaauggguagcauucguaggauuugacgaaagugaaaaauauuacgcagacucaguaaaaggaagauucacaauaagcagagauaacaguaaaaauacauuaucacuacaaaugaacucacuaagaccagaagacacagcaguauauuauugcgcaaaagaaguaggagacaauaaagaagaugaaugggcaagugauuacuauuacgaucuaucaaaugcauacccaauacaugacccaagagcaguaguaggaggauacgauauauggggacaaggaacaaugguaacaguaugcuca

SEQ ID NO: 47924 - RNA, 435 nt, Artificial Sequence
  derived and/or modified sequence opt6 from anti-HIV_cap256-059-027877_VR-Chain
caaguacaauuaguagaaucaggaggaggaguaguacaaccaggaagaucacuaagauuaaguuguucagcaucagcauuuaguuuuaguuauuuugcaauggauuggguaagacaagcaccaggaaaaggauuagaauggguagcauuuguaaguucagauggaaauaauaaaaauuaugcagauucaguaaaaggaagauucacaauaucaagagauaauaguaaaaauacaguauuuuuacaaauggauucauuaagaccagaagauacagcaguauauuauugugcaaaagauuuaggaggaaauaaagaugaugaauggucaacaaauuauuauuaugauauaucaauagcagauccaguaccagauccaagagcaguagcaggagcauucgauguauggggacaaggaacaaugguaacaguaucauca

SEQ ID NO: 47925 - RNA, 435 nt, Artificial Sequence
  derived and/or modified sequence opt6 from anti-HIV_cap256-059-026640_VR-Chain
caaguacaauuaguagaaaguggaggaggaguaguacaaccaggaagaaguuuaagauuaaguugugcagcaaguggauuuaguuuuagcaaauauggaaugcauuggguaagacaagcaccaggaaaaggauuagaauggguagcauuuguagcauuugaugaaagcgauagauauuaugcagcaaguguaaaaggaagauuuacaauaaguagagauaauaguaaaaauacauuaaguuuacaaaugaauaguuuaagaacagaagauacagcaauauauuauugugcaaaagaaguaggagauaauaaagaugaugaauggacaucaccauauuauuaugauaugaguauagcauauccaguacaagauccaagagcaguaguaggaggauaugauauauggggacaaggaacaaugguaacaguaaguagu

SEQ ID NO: 47926 - RNA, 432 nt, Artificial Sequence
  derived and/or modified sequence opt6 from anti-HIV_cap256-059-026017_VR-Chain
caaguacaauuaguagaaaguggaggaggaguaguacaaccaggaagaaguuuaagauuaucaugugcagcaaguggauuuacauuuaguacauaugcaaugcauuggguaagacaagcaccaggaaaaggauuagaauggguagcauuaauaaguuaugauggaacaaauaaauauuauguagauagcgcaaaaggaagauuuacaauaucaagagauaauaguaaaaauacauuauauuuacaaaugaauaguuuaacaccagaagauacagcaguauuuuauugugcaaaagauuuaggaggauauaaagaugaugaauggggaacagaauauuaugauauaaguguaaguuauccaguacaagauccaagagcaguagcaggaguauuugauguauggggacauggaacaaugguaacaguaaguagu

SEQ ID NO: 47927 - RNA, 432 nt, Artificial Sequence
  derived and/or modified sequence opt6 from anti-HIV_cap256-059-024100_VR-Chain
ugucaaguauuaguagaaagcggaggaggaguaguacaaccaggaagaagucuaagauuaagcugugcagcaagucaauucacauuuucaaguuauggaaugcacuggguaagacaagcaccaggaaaaggacuagaauggguagcagcaauaucauuugcaggaacaaaaaaauauuaugcagauaguguaaaaggaagauuugcaauaagcagagacacaaguaaaaaugcacuauauuuacaaaugaauacauuaagagcagaagauacagcauuauauuacugugcaagagauuuaagagaauuugaaugugaagaaugggcaucagacuauuaugauuucggaagaccacaaccaugucaagacccaagaggaguaguaggaucauuugauauauggggacaaggaacaaugguaacaguaaguuua

SEQ ID NO: 47928 - RNA, 432 nt, Artificial Sequence
  derived and/or modified sequence opt6 from anti-HIV_cap256-059-023966_VR-Chain
caaguacaauuaguagaaagcggaggaggaguaguacaaccaggaagaagucuaagauuaaguugugcagcaagucaauucucauucucaagcuauggaaugcacuggguaagacaagcaccaggaaaaggauuagaauggguagcagcaauaucauucgcaggaauaaaaaaacacuauacagauagcguaaaaggaagauuuacaauaagcagagacaauagcaaaaacacauuauaucuacaaaugaauagcuuaagagcagaagauacagcacuauauuacugugcaaaagacuugagaggauucgaaugcgaagaaugggcaucagacuauuacgauuucggaagagaucaaccaugccaagacccaagaggaguaguaggaacauucgauauauggggacaaggaacauuaguaacaguaagcagu

SEQ ID NO: 47929 - RNA, 432 nt, Artificial Sequence
  derived and/or modified sequence opt6 from anti-HIV_cap256-059-020534_VR-Chain
caaguacaauuaguugaaaguggaggaggaguaguacaaccaggaagaaguuuaagauuaagcugugcagcaagucaauuuacauuuucaaacuauggaaugcauuggguaagacaagcaccaggaaaaggauuagaauggguagcaggaaugucauuugcaggaacaaauacauauuaugcagauaguguaaaaggaagauuuacaauaaguagagauaauaguaaaaauacguuauauuuacaaaugaauaguuuaagagcaguagauacagcauuauauuauugugcaagagauaugagagaauaugaaugugaagaaugggcaucagauuauuaugauuuuggaagagaauauccaugucaagacccaagaggaguaguaggaauauuugauuuauggggacaaggaacaaugguaacaguaagcuca

SEQ ID NO: 47930 - RNA, 435 nt, Artificial Sequence
  derived and/or modified sequence opt6 from anti-HIV_cap256-059-019513_VR-Chain
caaguacaauuaguagaaucaggaggaggaguaguacaaccaggaagaucacuaagacuaucaugcgcagcaucgggauuuacauuuagcaauuucgcaaugggauggguaagacaagcaccaggaaaaggacuagaauggguagcaguaauaagcucagacggaacaaauaaaaauuacggagacucaguaaaaggaagauucacaauaucaagagauaacagcaaaaauacauuauucuuacaaaugaacucacuaagagcagaagacacaucauuauacuauugcgcaaaagaucuaggaggauauaaaacagacgaaugggcaacaaauuacuauuacgauauaucaauagcaagcccaauacaagacccaagagcaguaguaggagcauucgauauauggggacaaggaacaaugguaacaguaacauca

SEQ ID NO: 47931 - RNA, 432 nt, Artificial Sequence
  derived and/or modified sequence opt6 from anti-HIV_cap256-059-012963_VR-Chain
caaguacaauuaguagaaaguggaggaggaguaguacaaccaggaagaaguuuaagauuaaguuguguagcaaguggauuuaguuuuucaaguuauggaauggcauggguaagacaagcaccagggaaaggauuagaauggguaacaguaauaaguuuugcaggaguaaaaacauauuaugcagauaguguaaaaggaagauuuacaauaaguagagacaauaguaaaggaacauuauauuuacaaauggauggauuaagaccagaagauacagcauuauauuauugugcaaaagauuuagcagaaagagaaugugaagaaugggcaagugauuauuaugauuuuggaagagaauuaccaugucaagauccaagaggaguaguaggaacauuugauguauggggacaaggaacaaugguaacaguaaguagu

SEQ ID NO: 47932 - RNA, 435 nt, Artificial Sequence
  derived and/or modified sequence opt6 from anti-HIV_cap256-059-010396_VR-Chain
caaguacaauuaguagaaucaggaggaggaguaguacaaccaggaagaucacuaagauuaucaugugcagcaucaggauuuucauuuaauaauuaugcaaugaauuggguaagacaagcaccaggaaaaggauuagaauggguagcauuuguaaguucagacggaaguaauaaaaauuaugcagauucaguaacaggaagauuuacauuaucaagagauaauaguaaaaauacaguauuuuuacaaaugaauaguuuaagaguagaagacacagcaguauauuauugugcaaaagauguaggagcaaauaaagaugaugaauggacaacaaauuauuauuaugauauaucaauagcagauccaguaccagauccaagagcaguaauaggagcauuugauguauggggacaaggaacaaugguaacaguaucauca

SEQ ID NO: 47933 - RNA, 432 nt, Artificial Sequence
  derived and/or modified sequence opt6 from anti-HIV_cap256-059-008136_VR-Chain
caaguacaauuaguagaaaguggaggaggaguaguacaaccaggaagaagucuaagacuaagcugugcagcaagcggauucacauucaauacauaugcaaugcacuggguaagacaagcaccaggaaaaggacuagaauggguagcauuaauaucauaugauggaacagaaaaauacuaugcagauucaguaaaaggaagauuuacaauaagcagagacaauagcagaaacacacuauaucuacaaaugaauagcuuaagauuagaagaugcagcauuauaucaaugugcaaaagacuuaggaggaaguaaaagcgacgaauggggaacagacuauuacgauaugucaauaucauacccaauacaagacccaagagcaguagcaggaguauucgauauauggggacaaggaacauuaguaacaguaaguuca

SEQ ID NO: 47934 - RNA, 432 nt, Artificial Sequence
  derived and/or modified sequence opt6 from anti-HIV_cap256-059-006147_VR-Chain
caaguacaaguaguagaaagcggaggaggaguaguacaaccaggaagaaguuuaagauuaagcuguacagcaagcggauucacauucucaaacuuugcaaugggauggguaagacaagcaccaggaaaaggacuagaauggguagcauuuauaucaagcgauggaucaaacaaaaacuauggagauaguguaaaaggaagauuuacaauaaguagagacaauaguaaaaacacaguauuucuacaaaugaauaguuuaagaguagaagauacagcacuauauuacugugcaaaagacguaggagauuacaaaagcgaugaauggggaacagaauauuacgauauaucaauaucguacccaauacaagacccaagagcaaugguaggagcauucgaucuauggggacaaggaacaaugguaacaguaagccca

SEQ ID NO: 47935 - RNA, 432 nt, Artificial Sequence
  derived and/or modified sequence opt6 from anti-HIV_cap256-059-005081_VR-Chain
caaguacaauuaguagaaagcggaggaggaguaguacaaccaggaagaagcuuaagauuaaguugugcagcaagucaauucacauucucaagcuauggaaugcacuggguaagacaagcaccaggaaaaggacuagaauggguagcaggaauaucauucgcagcaacaaaaaaauacuauagcgaaagcguaaaaggaagauuuacaauaagcagagacaauagcaaaaacgcacuacaucuacauaugaauaguuuacgagcagaagauacagcauuauauuacugugcaaaagacuuaagagaauucgaaugcgaagaaugggcaucagacuauuacgauuucggaagagaucaaccaugccaagacccaagaggaguaguaggaauauucgauauguggggacaaggaacaaugguaacaguaaguuca

SEQ ID NO: 47936 - RNA, 432 nt, Artificial Sequence
  derived and/or modified sequence opt6 from anti-HIV_cap256-059-005006_VR-Chain
caagcacaauuaguagaaaguggaggaggaguaguacaaccagcaaaaaguuuaagauuaaguugugcagcaaguggauuuacauuuaauaaauaugcaaugcauuggguaaggcaagcaccaggaaaaggauuagaauggguagcauuuguagcauuugaugaaagugauaaauauuaugcagauaguguaaaaggaagauuuacaauaaguagagauaauaguaaaaauacauuaaguuuacaaaugaauaauuuaagagcagaagauacagcaguauauuauugugcaaaagaaguaggagauaauaaagaugaugaaugggcaagugauuauuaugauuuaaguauagcauauccaauacaagauccaagagcaguaggaagaggauaugauauauggggacaaggaacaaugguaacaguaaguagu

SEQ ID NO: 47937 - RNA, 432 nt, Artificial Sequence
  derived and/or modified sequence opt6 from anti-HIV_cap256-059-004451_VR-Chain
caaguacauuuaguagaaaguggaggaggaguaguacaaccaggaaaaaguuugagauuaaguuguacagcaaguggauuuacauuuacaaauuuugcaauggacuggguaagacaagcaccaggaaaaggauuagaauggguagcauuuauaucaagugauggaucaaauaaauauuauagugaaaguguaaaaggaagauuuacaauaagcagagacaauaguaaaaauacauuauauguacaaaugaauaguuuaagaacagaagauacagcaguauauuacugugcaaaagauuuaggaggauauaaagaugaugaauggaguacagacuauuaugauuggucaacagcauauccaguacaagacccaagagcaguagcaggagcauuugauuuauggggacaaggaacaaugguaagcguaaguuca

SEQ ID NO: 47938 - RNA, 432 nt, Artificial Sequence
  derived and/or modified sequence opt6 from anti-HIV_cap256-059-003571_VR-Chain
caagaacaauuaguagaaaguggaggaggaguaguacaaccaggaagaaguuuaagauuaaguugugcagcaagccaauuuacauuuggagcauauggaaugcauuggguaagacaagcaccaggaaaaggauuagaauggguagcaggaguaaguuuuguaggaaauaauaaauauuaugcagauaguguaaaaggaagauuuacaauaaguagagauaauaguaaaaauacauuauauuuacaaaugaauaguuuaagaggagaagauacagcauuauauuauugugcaagagauaugagagaaauggaaugugaagaaugggcaagugauuauuaugauuuuggaagaccacaaccaugucaagauccaagaggaguaguaggaauauuugauauguggggacaaggaacaaugguaacaguaaguagc

SEQ ID NO: 47939 - RNA, 432 nt, Artificial Sequence
  derived and/or modified sequence opt6 from anti-HIV_cap256-059-003449_VR-Chain
caaguacaauuaguagaaagcggaggaggaguaguacaaccaggaaaaagcuuaagauuaagcugugcagcaagccaaguaacauucucaagcuauggaaugcacuggguaagacaagcaccaggaaaaggacuagaauggguagcaggaauaucauucgcaggaacaaaaaaauacuaugcagauagcguaaaaggaagauuuacaauaaguagagacaauagcaaaaacgcacuauaucuacaaaugaauagauuaagagcaggagauacagcacuauauuacugugcaaaagacuuaagagaauacgaaugcgaagaaugggcaucagacuauuacgauuuuggaagagaacaaccaugccaagacccaagagggguaguaggaauauucgauauauggggauuaggaacaaugguaacaguaaguuca

SEQ ID NO: 47940 - RNA, 432 nt, Artificial Sequence
  derived and/or modified sequence opt6 from anti-HIV_cap256-059-002712_VR-Chain
caaguacaauuagcagaaaguggaggaggaguaguacaaccaggaagaagcuuaagauuaagcugugcagcaagccaauucacauucaguagcuauggaaugcacuggguaagacaagcaccaggaaaaggacuagaauggguagcagcaauaucauucgcaggaacaaaaaaacacuaugcagauagcgugaaaggaagauuuacaauaagcagagacaauagcaaaaacacacuaaauuuacaaaugaauaguuuaagagcagaagauacagcacuauauuacugugcaagagacaugcgagaauaugaaugcgaaguaugggcaucagacuauuacgauuucggaagagaacaaccaugccaagacccaagaggaguaguaggaacauuugauauauggggacaaggaacaaugguaacaguaagccca

SEQ ID NO: 47941 - RNA, 432 nt, Artificial Sequence
  derived and/or modified sequence opt6 from anti-HIV_cap256-059-001573_VR-Chain
caaguacaauuaguagaaaguggaggcggaguaguacaaccaggaagaaguuugagauuaaguugugcagcaagccaauucacauucucaaguuauggaaugcacuggguaagacaagcaccaggaaaaggacuagaauggguagcaggaauaucauaugauggaacaaguaaauacuaugcagauagcguaaaaggaagauuuacaauaaguagggacaauagcaaaaacacauuauauuuacaaaugaauagcuuaagagcagaagauacagcacuauauuacugugcaaaagacuuaagagaagacgaaugcgaagaaugguggucagacuauuacgauuucggaagagaacuaccaugcagaaaaucaagagggguagcaggaacauucgauauauggggacauggaacaaugguaaccguaaguuca

SEQ ID NO: 47942 - RNA, 432 nt, Artificial Sequence
  derived and/or modified sequence opt6 from anti-HIV_cap256-059-001379_VR-Chain
caaguaagauuaguagaaagcggaggaggaguaguacaaccaggaaggagcuuaagacuaagcugugcagcaaguggauuuacauuuaauaguuauccaaugcacuggguaagacaagcacccggaaaaggacuagauuggguagcauuaauaucauaugauggaacaaauaaauuuuauguagauaguguaaaaggaagauuuacaauaagcagagacaauaguaaaaauacacuauauuuacaaaugaauaguuuaacagcagaagauacagcaauguauuacugugcaaaagauuuaggaggaaauaaagaugaugaauggggaacagacuauuaugauauaucaguagcuuauccaauacaugacccaagagcaguagcaggaauauuugauguauggggacauggaacaaugguaacaguaaguuca

SEQ ID NO: 47943 - RNA, 432 nt, Artificial Sequence
  derived and/or modified sequence opt6 from anti-HIV_cap256-059-001029_VR-Chain
caagaacaauuaguacaaaguggaggaggaguaguacaaccaggaagaagcuuaagauuaagcugugcaccaagucaauucacauucucagcacauggaaugcauuggguaagacaagcaccaggaaaaggacuagaauggguagcaggaauaaguuucgcaggaacaaaaaauuacuaugcagauagcguaaaaggaagauuuacaauaaguagagacaauagcaaaaacacacuauaucuacaaaugaauagcuuaagaguagaagauacagcacuauauuacugugcaaaagacaugagagaaauggaaugcgaagaaugggcaucagacuauuacgauuucggaagacaucaaccaugccaagacccaagaggaguaguaggaauauucgauauauggggacaaggaacaaugguaacaguaagcuca

SEQ ID NO: 47944 - RNA, 432 nt, Artificial Sequence
  derived and/or modified sequence opt6 from anti-HIV_cap256-048-165087_VR-Chain
gaaguaaaauuauuagaaaguggaggaggauuaguacaaccaggaggauauagaagauuaaguugugcagcaaguggauuuacauuuaguagauaugcaaugcauugggcaagacaagcaccaggaaaaggauuagaauggguagcaguaguaagugaugauggaguaaaaaaauauuauccagauucaguaagaggaagauuuacaauaagcagagauaauaguagaaauacaguaucauuacaaaugaauagcuuaagaccagaagauacagcaguauauuauugugcaaaagauguaggagcaaauaaagaugaugaaugggcaacagauuauuaugauuuaaguauagcauauccaguaccagauccaagagcaguaguaggagcauuugauauauggggacaaggaacaaugguaacaguaaguagu

SEQ ID NO: 47945 - RNA, 432 nt, Artificial Sequence
  derived and/or modified sequence opt6 from anti-HIV_cap256-048-158861_VR-Chain
gaaguacaauuaguagaaaguggaggaggauuaguacaaccaggaggaaguuuaagauuaaguuguguagauuuuggauuuagauuuucagaauauuggaugaguuggguaagacaagcaccaggaaaaggauuagaauggguagcaguaauaaguuaugauggaacaaauaaauauuaugcagauagcgugaaaggaagauuuacaauaaguagagauaauagcaaaaauacauuauauuuacaaaugaauaguuuaagagcagaagauacagcauuauauuauugugcaaaagauaugagagaaagugaaugugaagaaugggcgucagauuauuaugauuuuggaaaagauuauccaugucaagauccaaggggaguaguaggaacauuugauauauggggacaaggaacaaugguaacaguaaguagu

SEQ ID NO: 47946 - RNA, 435 nt, Artificial Sequence
  derived and/or modified sequence opt6 from anti-HIV_cap256-048-158280_VR-Chain
caaguacaucuaguagaaucaggaggaggaguaguacaaccaggaagaucacuaagaauauauugcgcaguaucagaauuuacauucagaaauuacgcaaugcauuggguaagauuagcaccaggaaaaggauuacaauggguagcaguaauaagccaugacggaauaaaugacuauuacgcagacucaguaaaaggaagauucacaauaucaagagauaacagcaaaaauacagugucauuacaaaugaacucacuaagaccagaagacacagcaguauacuauugcgcaaaagaucuaggagcaaauaaagaugacgaaugggcaacagauuacuaugacuuaagcauagcauauccaguaccagauccaacaggaccaugguuuggagcauucgauauauggggacaaggaacaauggugacaguaagcuca

SEQ ID NO: 47947 - RNA, 432 nt, Artificial Sequence
  derived and/or modified sequence opt6 from anti-HIV_cap256-048-157928_VR-Chain
caaguacaauuaauggaaagcggaggaggaguaguacaaccaggaagaaguuuaagauuaagcugugcaauaaguggauucacauuuucaaauuauuggaugagcuggguaagacaagcaccaggaaaaggacuagaauggguagcaguaauaucaagugauggaucaaguaaaaauuaugcagauaguguaaaaggaagauuuacaauaagcagagauaauagcaaaaauacaguaucauuacaaaugaauaguuuaagaccagaagauacagcaguauauuauugugcaaaagauguaggagcaaauaaagaugaugaaugggcaacagacuauuaugauuuaucaauagcauauccaguaccagacccaagagcaguaguaggagcauuugauauauggggacaaggaacaaugguaacaguaaguuca

SEQ ID NO: 47948 - RNA, 432 nt, Artificial Sequence
  derived and/or modified sequence opt6 from anti-HIV_cap256-048-157056_VR-Chain
caaguacaauuaguagaaaguggaggagggguaguacaaccaggaagaaguuuaagauuaagcugugcagcaagcggauuuacacuaaguaguuaugcaaugcauuggguaagacaagcaccaggaaaaggauuagaauggguagcauuuauaaguaaugauggaaguaauaaauauuuugcagauaguguaaaaggaagauuuacaauaaguagagauaauaguaaaaauacauuauauuuacaaaugaauaguuuaagagcagaagauacagcaguauauuacugugcaaaagauuuaggaggaaauaaagaugaugaaugggcaacagauuauuaugauuuaaguauagcauauccaguacaagauccaagaguaguaguaggaauauuugauauauggggacaaggaacaaugguaacaguaaguagu

SEQ ID NO: 47949 - RNA, 432 nt, Artificial Sequence
  derived and/or modified sequence opt6 from anti-HIV_cap256-048-156422_VR-Chain
caaguacaauuaguagaaaguggaggaacaguaguacaaccaggaagaaguuuaagauuaagcuguguaggaaguggauuuucauuaaguuacuaugcaauacauuggguaagacaagcaccaggaaaaggacuagaauggguagcaguaauaaguuaugauggaaguaauuauuauuaugcagauaguguaaaaggaagauuuacaauaaguagagauaauagcaaaaauacaguauauuuacaaaugaauaguuuaagaggaguagauacagcaguauauuauugugcaaaagauuuaggaggaggagaaguagaagaaugggcaacagauuauuaugauuggaguauagcauauccaguagaacauccaagagcaguaguaggaguauuugauauauggggacaaggaacaaaaguaacaguaaguagu

SEQ ID NO: 47950 - RNA, 432 nt, Artificial Sequence
  derived and/or modified sequence opt6 from anti-HIV_cap256-048-152863_VR-Chain
gaaguacaauuauuagaaaguggaggaggauuaguacaaccaggaggaaguuuaagauuaaguugugcaggaaguggauuuacauuuaguaaacauggaaugcauuggguaagacaagcaccaggaaaaggauuagaauggguagcauuuguagcauuugaugaaagugauaaauauuaugcagauaguguaaaaggaagauucacaauaaguagagauaauaguaaaaauacacuaaguuuacaaaugaauagcuuaagagcagaagauacagcaauguauuauugugcaaaagaaguaggagauaauaaagaugaugaaugggcaagugauuauuaugauuuaaguauagcauauccaguacaugauccaagagcaguaguaggaggauaugauauauggggacaaggaacaaugguaacaguaaguagu

SEQ ID NO: 47951 - RNA, 432 nt, Artificial Sequence
  derived and/or modified sequence opt6 from anti-HIV_cap256-048-152770_VR-Chain
caaguacaauuaguagaaaguggaggaggaguaguacaaccaggaagaaguuuaagauuaaguugugcagcaaguggauuuacauuuagaaguaaugcaaugcauuggguaagacaagcaccaggaaaaggacuagaauggguagcaguaauaaguuaugauggaaguaaaacauauuaugcagauaguguaaaaggaagauuuacaauaaguagagauaauaguaaaaauacacuauaucuacaaaugaauaguuuaagagcagaagauacagcaguauauuauugugcgaaagauuuaggagaauauaaaagugaugaaugggcaacagauuauuaugauuuaaguauagcauauccaguacaagauccaagaggaguagcaggagcauuugauauauggggacaaggaacaaugguaacaguaaguagu

SEQ ID NO: 47952 - RNA, 432 nt, Artificial Sequence
  derived and/or modified sequence opt6 from anti-HIV_cap256-048-150027_VR-Chain
gaaguacaauuaguagagagcggaggaggauuaguacaaccaggaggaucauuaagauuaagcugugcaguaagcggauucacauucagcaguuauauaaugcacuggguaagacaagcaccaggaaaaggacuagaauggguagcaguaauaucauaugauggaucaaacaaagacuaugcagauagcguaaaaggaagauuuacaauaaguagagacaauaguaaaaacacacuauaucuacaaaugaauaguuuaagagcagaagauacagcacuauauuacugugcaaaagacuuaagagaauacgaaugcgaagaaugggcaucagacuauuacgauuucggaagagauuacccaugccaagacccaagaggaguaguaggaacauucgauauauggggacaaggaacaaugguaacaguaagcuca

SEQ ID NO: 47953 - RNA, 432 nt, Artificial Sequence
  derived and/or modified sequence opt6 from anti-HIV_cap256-048-148246_VR-Chain
caaguacaauuaguagaaaguggaggaggaguaguacaaccaggaagaaguuuaagauuaaguugugcaacaaguggauuuacauuuaguacauauaguaugcauuggguaagacaagcaccaggaaaaggauuagaauggguagcaguaauaaguuaugauggaaguaaugaauauuauguagauaguguaaaaggaagauuuacaauaaguagagauaauaguaaaaauacauuauauuuacaaaugaauaguuuaagaguagaagauacagcauuauauuauugugcaaaagaucuaggaggaaauaaagaugaugaauggggaacagauuauuaugauuuuaguguagcauauccaguacaagauccaagggcaguaaguggaauauuugauguauggggacauggaacaaugguaacaguaaguagu

SEQ ID NO: 47954 - RNA, 432 nt, Artificial Sequence
  derived and/or modified sequence opt6 from anti-HIV_cap256-048-147428_VR-Chain
caaguacaauuaguagaaagcggaggaggaguaguacaaccgggaagaaguuuaagauuaaguuguagcgcaagcggauucacauucucaaauuauggaaugcacuggguaagacaagcgccaggaaaaggacuagaauggguagcaguaauaucauucgauggaucaaauaaaguauaugcagauagcguaaaaggaagauuuacaauaaguagagacaauagcaaaaacacacuauaucuagaaaugaauagcuuaagagcagaagauacagcagaauauuacugugcaaaagacuuaggagaaagugauaaagaagaauggccaucagacuauuacgauuucggaagagauuucacaggacaagucccaagagcaguaguaggaauauucgauauguggggacaaggaacaaugguaacaguaaguuca

SEQ ID NO: 47955 - RNA, 432 nt, Artificial Sequence
  derived and/or modified sequence opt6 from anti-HIV_cap256-048-146603_VR-Chain
gaaguacaauuaguagaaaguggaggaggauuaguacaaccaggaagaaguuuaagauuaagcugugcagcaaguggauuuacauuugaugauuaugcaauacauuggguaagacaagcaccaggaaaaggauuagaauggguagcauuaauaucauaugauggaacagauaaauauuaugcagauaguguaaaaggaagauuuacaauaaguagagauaauagcaaaaauacauuauauuuacaaaugaauaguuuaagaguagaagauacagcaguauaucauugugcaaaagauuuaggaggaacaaaaagugaugaaugggcaacagauuauuaugauuuaaguauagcauauccaauacaagauccaggagcaguaguaggaguauuugauauauggggacaaggaacaaugguaacaguaaguagu

SEQ ID NO: 47956 - RNA, 432 nt, Artificial Sequence
  derived and/or modified sequence opt6 from anti-HIV_cap256-048-145735_VR-Chain
caaguacaauuaguacaaaguggaggaggaguaguacaaccaggaagaagucuaagauuaaguuguggagcaaguggauuuacauuuaguaauuaugcaaugcauuggguaagacaagcaccaggaaaaggauuagauuggguagcaguaauaaguuaugauggaacaaaugaaaaucaugcagauaguguaaaaggaagauuuacaauaagcagagauaauagcaaaaauacaguauauuuacaaaugaauaguuuaagagcagaagauacagcaguauauuauugugcaaaagauguaggaggaaguaaagaugaugaaugggcaacagauuauuaugauuuaaguauagcauauccaguaccagauccaagagcaguaguaggagcauuugauauauggggacaaggaacaaugguaacaguaaguagu

SEQ ID NO: 47957 - RNA, 432 nt, Artificial Sequence
  derived and/or modified sequence opt6 from anti-HIV_cap256-048-145116_VR-Chain
caaguacaccuaguagaaagcggaggaggaguaguacaaccaggaggaaguuuaagauuaagcugugcagcaagcggauucacauucucaaauuauggaaugcacuggguaagacaagcaccaggaaaaggacuagaauggguagcagcaauaucauucgcaggaacaaauaaauacuaugcagauaguguaaaaggaagauuuacaauaagcagagacaauaguaaaaacgcacuauauuuacaaaugaauaguuuaagagcagaagauacagcacuauauuacugugcaaaagacuuaagagaaagugaaugugaagaaugggcaucagacuauuacgauuucggaagagauuauccaugucaagacccaagaggaguagugggaacacuagauauauggggucaaggaacaaugguaacaguaaguuca

SEQ ID NO: 47958 - RNA, 432 nt, Artificial Sequence
  derived and/or modified sequence opt6 from anti-HIV_cap256-048-144077_VR-Chain
caaguaaaauuaguagaaagcggaggaggaguaguacaaccaggaagaaguuuaagauuaagcugugcagcaaguggauuuacauuaucaaguuaugcaaugcauuggguaagacaagcaccaggaaaaggacuagaauggguagcagugauaucauaugauggaucaaauagauauacagcagauagcguaaaaggaagauuuacaauaaguagagacaauaguaaaaauacauuaaauuuacaaaugaauaguuuaagaccagaagauacagcaguauauuauugugcaaaagauguaggagcaaauaaagaugaugaaugggcaacagauuauuaugauuuaaguauagcauauccaguaccagacccaagagcaguaguaggagcauuugauauauggggacaaggaacaacaguaacaguaucauca

SEQ ID NO: 47959 - RNA, 432 nt, Artificial Sequence
  derived and/or modified sequence opt6 from anti-HIV_cap256-048-142876_VR-Chain
caaguacaauuaguagaaaguggaggaggaguaguacaaccgggaggaaguuuaagauuaaguuguguagcaaguggauuuacauuuaguacauauggaaugcauuggguaagacaagcaccaggaaaaggauuagaauggguagcauuuaugagauuugauggaaguaauagauauuauggagauaguguaaaaggaagauuuacaauaaguagagauaauaguaaaaauacauuauauuuacaaaugauaagucuaagagcagaagauacagcaguauaucauugugcaaaagauuuaggaggaaauaaaccagaugaaugggcaacagauuauuaugauuuaaguauagcauauccaguacaagauccaagagcaguaguaggaguauuugauauauggggacaaggaacaauaauaacaguaaguagu

SEQ ID NO: 47960 - RNA, 432 nt, Artificial Sequence
  derived and/or modified sequence opt6 from anti-HIV_cap256-048-140582_VR-Chain
caaguacaauuaguagaaaguggaggaggaguaguacaaccaggaagaaguuuaagauuaaguugugcagcaaguggguuuagcuuuaguaauuaugcaauggauuggguaagacaagcaccaggaaaaggauuagaauggguagcauuuguaagcagugauggaaguaauaaaaauuaugcagauaguguaaaaggaagauuuacaauaaguagagauaauaguaaaaauacaguguauuuacaaaugaauaguuuaagaguagaagauacagcaguauauuauugugcaaaagauuuaggagcaaauaaagaugaugaaugggcaacagauuauuaugauuuaaguguagcauauccaguaccagauccaagagcaguaguaggagcauucgauguauggggacaaggaacaaugguaacaguaaguagu

SEQ ID NO: 47961 - RNA, 432 nt, Artificial Sequence
  derived and/or modified sequence opt6 from anti-HIV_cap256-048-139355_VR-Chain
caaguacaauuaguagaaagcggaggaggaguaguacaaccaggaagaaguuuaagauuaagcugugcagcaaguggauuuacauuuaguaguuaugcaaugcauuggguaagacaagcaccaggaaaaggauuagaauggguagcaauaauuaguuaugauggaaguaauaaauauuaugcagauaguguaaaaggaagauuuacaauaagcagagauaauaguaaaggaacauuauauuuacaaauggauggaccaagaccagaagauacagcauuauauuauugugcaaaagauuuaggagaaagagaaugugaagaaugggcaagugauuauuaugauuuuggaagagauuuuccaugucaagauccaagaggaguaguaggaacauuugauauauggggacaaggaacaaugguaacaguaaguagu

SEQ ID NO: 47962 - RNA, 432 nt, Artificial Sequence
  derived and/or modified sequence opt6 from anti-HIV_cap256-048-139151_VR-Chain
caaguacaauuaguagaaagcggaggaggaguaguacaaccaggaaaaaguuuaagauuaagcugugcagcaagcggauucacauucaauacauauggaaugcacuggguaagacaagcaccaggaaaaggacuagaauggguagcaguaauaucauacgauggaucaauacaaaaauaugcagauagcguaaaaggaagauuuacaauaagcagagacaauaguaaaaacacacuauaucuacaaaugaauagcuuaagcguagaagauacagcaguauauuacugugcaaaagacuuagggaaaaacaaagacgaugaaugggcaacagacuauuacgauauaucaauagcauacccaguaccagacccaagagcaguaguaggaguauucgauauauggggacaaggaacaguaguaacaguaagcuca

SEQ ID NO: 47963 - RNA, 432 nt, Artificial Sequence
  derived and/or modified sequence opt6 from anti-HIV_cap256-048-137672_VR-Chain
gaaguacaauuaguagaaagcggaggaggaguagcaagaccaggaggaaguuuaagauuaaguugugcagcaaguggauuuauauuuacacauuaugcaauggauuggguaagacaagcaccaggaaaaggauuagaauggguagcaguaauaaguagcgauggaaguaguaaaaauuaugcagauaguguaaaaggaagauuuacaauaaguagagauaauaguaaaaauacaguaucauuacaaaugaauaguuuaagaccagaagauacagcaguauauuauugugcaaaagauguaggagcaaauaaagaugaugaaugggcaacagauuauuaugauuuaaguauagcauauccgguaccagauccaagagcaguaguaggagcauuugauauauggggacaaggaacaaugguaacaguaaguagu

SEQ ID NO: 47964 - RNA, 432 nt, Artificial Sequence
  derived and/or modified sequence opt6 from anti-HIV_cap256-048-137506_VR-Chain
caaguaagauuaguagauagcggaggaggaguaguacaaccaggaggaaguuuaagauuaagcugugcagcaagcggauucacauucucaacauauggaaugcacuggguaagacaagcaccaggaaaaggacuagaauggguagcauuuauaagaagcgauggaucaaacaaauacuaugcagauagcguacaaggaagauuuagcauaagcagagacaauagcaaaaacacacuauauuuacaaaugaauagcuuaagagcagaagauacagcaguauauuacugugcaaaagacuuaggagaaagcgauaaagaagaauggccaucagacuauuacgauuucggaagagauuucacaggacaagacccaagagcaguaguaggaguauucgauauauggggacaaggaacaacaguaauaguaaguucg

SEQ ID NO: 47965 - RNA, 432 nt, Artificial Sequence
  derived and/or modified sequence opt6 from anti-HIV_cap256-048-137270_VR-Chain
caaguacaauuaguagaaaguggaggaggaguaguacaaccaggaagaagucuaagauuaaguugugcagcaaguggauuuacauuuaguaguuaugcaaugcauuggguaagacaagcaccaggaaaaggauuagaauggguagcaguaaugagcccagauggaaguaauagauauuauacagauaguguaaaaggaagauuuacgauaaguagagauaauaguaaaaauacauuaaguuuacaaaugaauagcuuaagaccagaagauacagcaguauauuauugugcaaaagauguaggagcaaauaaagaugaugaaugggcaacagauuauuaugauuuaaguauagcauauccaguaccagauccaagagcaguaguaggagcauuugauauauggggacaaggaacaaugguaacaguaaguagu

SEQ ID NO: 47966 - RNA, 432 nt, Artificial Sequence
  derived and/or modified sequence opt6 from anti-HIV_cap256-048-135447_VR-Chain
gaaguacaauuaguagaaagcggaggagcaguaguacaaccaggaagaagcuuaagauuaagcuguacagcaagcggauucaguuucacaagcuauacaauacacuggguaagacaagcaccaggaaaaggacuagaauggguagcauuuauaucauacgauggaacagaaaaaaaauauacagauagcguaaaaggaagauuuacaauaagcagagacaauagcaaaaacacacuaucacuacaaaugaauagcuuaagaccagaagauacagcagucuauuacugugcaaaagacuuaggagcaagcaaagacgaugaaugggcaacagauuauuacgauuucucaauagcauacccaguacaagacccaagagcaguaguaggagcauucgauauauggggacaaggaacaaugguaacaguaagcuca

SEQ ID NO: 47967 - RNA, 432 nt, Artificial Sequence
  derived and/or modified sequence opt6 from anti-HIV_cap256-048-131966_VR-Chain
caagaacaauuaguagaaaguggaggaggaguaguacaaccaggaagaaguuuaagauuaaguugugcagcaaguggauucacauuuaguaauuaugcaaugcauuggguaagacaagcaccaggaaaaggauuagaauggguagcagcaaugagucaugauggaagugauaaauauuaugcagauaguguaaaaggaagauuuacaauaaguagagauaauaguaaaaauacauuauauaugcaaaugaauaguuuaagagcagaagauacagcaguauauuauugugcaaaagaucaaggagaaagugaaaaagaagaaugggcaagugauuauuaugauuuuggaagagauuauccaggacaagauccaagaagaguaguugcaacauuugcaauauggggacaaggaacaaugguaacaguaaguagu

SEQ ID NO: 47968 - RNA, 432 nt, Artificial Sequence
  derived and/or modified sequence opt6 from anti-HIV_cap256-048-131008_VR-Chain
gaaguaagauuaguagaaagcggaggaggauugguaaaaccaggaggaagccuaagauuaagcugugcagcaagcggauucacaguaucaagcaauuacaugagcuggguaagacaagcaccaggaaaaggacuagaauggguagcagcaauaucauucgcaggaacaaacaaauacuaugcagauagcguaaaaggaagauuuacaauaagcagagacaauagcaaaaacgcacuauaucuacaaaugaauagcuuaagagcagaagauacagcacuauauuacugugcaaaagacuuaagagaaagcgaaugcgaagaaugggcaucagacuauuacgauuucggaagagauuacccgugccaagacccaagaggaguaguaggaacacuagauauauggggacaaggaacaaugguaacaguaagcucg

SEQ ID NO: 47969 - RNA, 432 nt, Artificial Sequence
  derived and/or modified sequence opt6 from anti-HIV_cap256-048-129369_VR-Chain
caaguacaauuaguagaaaguggaggaggaguaguacaaccaggaagaaguuuaagauuaaguugugcagcaaguggauuuacauuuagcaauuauguaaugcauuggguaagacaagcaccaggaaaaggauuagaauggguagcauuaguaaguuuugauggaagcaauaaauauuaugcagauaguguaaaaggaagauuuacaauaaguagagauaauaguaaaaauacaguauauuuacaaaugaauaguuuaagaggaguagauacagcaguauauuauugugcaaaagauuuaggaggaggagaaguagaagaaugggcaacagauuauuaugauuggaguauagcauauccaguagaacauccaagagcaguaguaggaguauuugauauauggggacaaggaacaaaaguaacaguaaguagu

SEQ ID NO: 47970 - RNA, 432 nt, Artificial Sequence
  derived and/or modified sequence opt6 from anti-HIV_cap256-048-128476_VR-Chain
gaaguacaaguauuagaaaguggaggaggauuaguacaaccaggaggaagucuaagacuagcaugugcagcgagcggauuuaguuuuaguaguuauggaaugcauuggguaagacaagcaccaggaaaaggauuagaauggguaaguuuuauaagauaugauggagcaaauaaauaucaugcagauaguguaaaaggaagauuuauaauaaguagagaugauaguaaaaauacaguaaguuuacaaaugaauagucuaagaccagaagauacagcaguauauuauugugcaaaagauuuaggagcaaauaaagaugaugaaugggcaacagauuauuaugauuuaaguauagcauauccaguaccagauccaagagcaguaguaggagcauuugauauauggggacaaggaacaaugguaacaguaaguagu

SEQ ID NO: 47971 - RNA, 432 nt, Artificial Sequence
  derived and/or modified sequence opt6 from anti-HIV_cap256-048-128270_VR-Chain
caaguacaauuaguagaaaguggaggaggaguaguacaaccaggaagaaguuuaagauuaaguuguacagcaaguggauuuacauuuagaaguuaugcaaugcauuggguaagacaagcaccagguaaaggacuagaauggguagcauuaauaaguuaugauggaaguaauaaauauuaugcagauaguguaaaaggaagauuuacaauaaguagagauaauaguaaaaauacauuauauuuacaaaugaauagucuaacaagugaagauacagcaguauauuauugugcaaaagauuuaggaggaaguaaaacagaugaauggggaacagauuauuaugaauuuuggaaugcauauccaguacaagauccaagaguaguaguaggagcauuugauauauggggacauggaacaaugguaacaguaaguagu

SEQ ID NO: 47972 - RNA, 432 nt, Artificial Sequence
  derived and/or modified sequence opt6 from anti-HIV_cap256-048-126220_VR-Chain
caaguacaauuaguagaaaguggaggaggaguaguacaaccaggaagaaguuuaagauuaaguugugcagcaaguggauuuauauuuaguccauauggaauacauuggguaagacaagcaccaggaaaaggauuagaauggguagcauuaauaagucaugauggaucaaaaaaauauuaugcagauaguguaaaaggaagauuuacaauaaguagagauaauuuuaaagauacauuauauuuacaaaugaauaguuuaagaggaguagauacagcaguauauuauugugcaaaagaucuaggaggaggagaaguagaagaaugggcaacagauuauuaugauuggaguacagcauauccaguagaacauccaagagcaguaguaggaguauuugauauauggggacaaggaacaaaaguaacaguaaguagu

SEQ ID NO: 47973 - RNA, 432 nt, Artificial Sequence
  derived and/or modified sequence opt6 from anti-HIV_cap256-048-125713_VR-Chain
gaaguacaauuaguagaaagcggaggaggauuaguacaaccaggaggaagucuaagacuaagcugugaagcgagcggauucucauucucaacauaugaacuaaacuggguaagacaagcaccaggaaaaggacuagaauggguagcaguaauaucauaugauggaucaaauuauuacuaugcagauagcguaaaaggaagauuuacaauaagcagagacaauagcaaaaacacacuauauuuacaaaugaauagcuuaagagcagaagauacagcaguauauuacugugcaaaagacguaggagcaaauaaagacgaugaaugggcaacagacuauuacgauuuaucaauagcauacccaguaccagacccaagagcaguaguaggagcauuugauauauggggacaaggaacaaugguaacaguaaguuca

SEQ ID NO: 47974 - RNA, 432 nt, Artificial Sequence
  derived and/or modified sequence opt6 from anti-HIV_cap256-048-123934_VR-Chain
caaguacaauuaguagaaaguggaggaggaguagugcaaccaggaagaaguuuaagauuaaguugugcagcaaguggauuuacauuuaguaguuauggaauggcauggguaagacaagcaccaggaaaaggauuagaauggguaacagcaauaucauuugcaggaacaaauaaauauuaugcagauagcguaaaaggaagguuuacaauaaguagagauaauaguaaagauacauuauauuuacaaauggauggauuaagaccagaagauacagcauuauauuauugugcaaaagauuuaggagaaagagaaugugaagaaugggcaagugauuauuaugauuuuggaagagauuuuccaggacaagaucaaagagcaguagcaggaguauuugauauguggggacaaggaacaaugguaacaguaagcagu

SEQ ID NO: 47975 - RNA, 432 nt, Artificial Sequence
  derived and/or modified sequence opt6 from anti-HIV_cap256-048-122673_VR-Chain
gaaguacaaguaguagaaaguggaggaggauuaguaaaaccaggaggaaguuuaagauuaagcugugcagcaaguggauuuacauuuagcagucauguaaugaauuggguaagacaagcaccaggaaaaggacuagaauggguaaguucaauaucaggaggaagcaguaguaaagauuaugcagauaguguaaaaggaagauuuacaauaaguagagauaauaguaaaaauacauuaucauuacaaaugaauaguuuaagaccagaagauacagcaguauauuauugugcaaaagauguaggagcaaauaaagaugaugaaugggcaacagauuauuaugauuuaucaauagcauauccaguaccagauccaagagcaguaguaggagcauuugauauauggggacaaggaacaaugguaacaguaaguagu

SEQ ID NO: 47976 - RNA, 432 nt, Artificial Sequence
  derived and/or modified sequence opt6 from anti-HIV_cap256-048-122208_VR-Chain
agaguacaaguaguagaaagcggaggaggaguaguaaaaccaggaggaaguuuaagauuaagcuguggagcaagcggguuuacauuuucaaaugcaugguuaaguuggguaagacaagcaccaggaaaaggacuagaauggguagcaguaauaucaagcgauggaucaaguaaaaauuaugcagauaguguaaaagggagauuuacaauaagcagggacaauaguaaaaauacaguaucauuacaaaugaauaguuuaagaccagaagauacagcaguauauuauugugcaaaagauguaggagcaaauaaagaugaugaaugggcaacagacuauuaugauuuaucaauagcauauccaguuccagacccaagagcaguaguaggagcauuugauauauggggacaaggaacaaugguaacaguaagcuca

SEQ ID NO: 47977 - RNA, 432 nt, Artificial Sequence
  derived and/or modified sequence opt6 from anti-HIV_cap256-048-121552_VR-Chain
caaguacaauuaguagaaaguggaggaggaguaguacaaccaggaggaaguuuaagauuaaguugugcagcaagcggauuuacauuuaguaguuaugcaaugcauuggguaagacaagcaccaggaaaaggauuaaaauggguagcagauauaaguuaugaugcaaguaguaaauauuaugcagauaguguaaaaggaagauuuacaauaaguagagauaauagcaaaaacacauuauauuuagaaaugaauaguuuaagaccagaagauacagcaguauauuauugugcaaaagauuuaggagaaagagaaugugaagaaugggcaagugauuauuaugauuuuggaagagauuuuccaugucaagauccaagaggaguaguaggaacauuugauauauggggacaaggaacaaugguaacaguaagcagu

SEQ ID NO: 47978 - RNA, 432 nt, Artificial Sequence
  derived and/or modified sequence opt6 from anti-HIV_cap256-048-120643_VR-Chain
caaguacaauuaguagaaagcggaggaggaguaguacaaccaggaagaagccuaagguuaagcugugcagcaagcggauucacacuaucagcauauacaaugcacuggguaagacaagcaccaggaaaaggacuagaauggguaagcguaauaucauucgcaggaaauaauaaauacuaugcagacagcguaaaaggaagauuuacaauaagcagagaaaauaguaaaaauauguuauaucuacaaaugaauaguuuaagaggagaagauacagcaguauauuacugugcaaaagacuuaagagaauuugaaugugaagaaugggcaucagacuauuacgauuucggaagagauuacccaugucaagacccaagaggaguaguaggaacauucgauguauggggacauggaucauuaguaacaguaaguuca

SEQ ID NO: 47979 - RNA, 432 nt, Artificial Sequence
  derived and/or modified sequence opt6 from anti-HIV_cap256-048-118458_VR-Chain
caaguacaauuaguagaaaguggaggaggaguaguacaaccaggaagaaguuuaagauuaaguugugcagcaaguggauuuacauuuaguacaaguggaaugcauuggguaagacaagcaccaggaaaaggauuagaauggguagcauuuauaaguagugauagaaguaauaaauuuuaugcagacaguguaaaaggaagauuuaguauaaguagagauaauaguaaauauacacuauauuuacaaaugaauaguuuaagagcagaugauacagcaguauauuuuugugcaaaagauuuaggaguaaauaaaaaugaugaaugggcaacagauuauuaugauuuaaguguagcauauccaguacaagauccaagaggaguagcaggaauauuugauauauggggacaaggaacaaugguaacaguaaguagu

SEQ ID NO: 47980 - RNA, 432 nt, Artificial Sequence
  derived and/or modified sequence opt6 from anti-HIV_cap256-048-118112_VR-Chain
caagaacaauuaguagaaagcggaggaggaguaguacaaccaggaagaagccuaagauuaagcugugcagcaagccaauuuacauuuucaaacuauggaaugcacuggguaagacaagcaccaggaaaaggauuaguauggguagcaggaauaucauucgcaggaacaaauaaauacuaugcagcaagcguaaaaggaagauuuacaauaagcagagacaauaguaaaaacacacuauaucuacaaaugaauagcuuaagagcagaagauacagcacuauauuacugugcaaaagacaugagagaauaugaaugugaagaaugggcaucagacuauuacgauuucggaagagauuacccaugucaagacccaagaggaguaguaggaacauucgauauauggggacaaggaacaauggugacaguaagcucg

SEQ ID NO: 47981 - RNA, 432 nt, Artificial Sequence
  derived and/or modified sequence opt6 from anti-HIV_cap256-048-116469_VR-Chain
caaguacaauuaguagaaaguggaggaggaguaguacaaccaggaagaaguuuaagauuaaguugugcagcgaguggauuuacauuuaguaguuaugcaaugcauuggguaagacaagcaccaggaaaaggauuagaauggguagcaauaauaaguuaugauggaaguaauaaauauuaugcagauaguguaaaaggaagauuuacaauaaguagagauaauccgaaaaauacauuauauuuacaaaugaauaguuuaagagcagaagauacaggauuauauuauugugcaaaagauaugggagaaagugaaaaagaagaaugggcaagugauuauuaugauuuuggaagagauuauccaggacaagaaccaagagcaaugguaggaacauuugauauauggggacaaggaacaaugguaacaguaaguagu

SEQ ID NO: 47982 - RNA, 432 nt, Artificial Sequence
  derived and/or modified sequence opt6 from anti-HIV_cap256-048-113917_VR-Chain
gaaguacaauuaguagaaagcggaggaggauuaguacaaccaggaggaagucuaagacuaaguugugcagcaaguggauuaacaguaagcgauacauauaugaauugguuaagacaagcaccaggaaaaggauuagaauggguagcaguaguaaguagugauggaaguaauaaaaauuaugcagauaguguaaaaggaagauuuacaauaaguagagauaauaguaaaaauacaguauauuuacaaaugaauaguuuaagagcagaagauacagcaguauauuauugugcaaaagauuuaggagcaaauaaagaugaugaaugggcaacagauuauuaugauuuaaguguagcauauccaguaccagauccaagagcaguaguaggagcauuugauguauggggacaaggaacaaugguaacaguaaguagu

SEQ ID NO: 47983 - RNA, 432 nt, Artificial Sequence
  derived and/or modified sequence opt6 from anti-HIV_cap256-048-112368_VR-Chain
caaguacaauuaguagaaaguggaggaggaguaguacaaccaggaagaaguuuaagacuaaguugugcagcaaguggauuuacauuuaguagaaaugcaaugcauuggguaagacaagcaccaggaaaaggauuagaauggguagcaguaauaaguuaugauggaaguaauaaauauuaugcagauaguguaaaaggaagauuuacaauaaguagagauaauaguaaaaauacauuauauuuacaaaugaauagccuaagagcagaagauacagcaguauauuauugugcaaaagauuuaggaggaggagaaguagaagaaugggcaacagauuauuaugauuggucaacagcauauccaguagaacauccaagggcaguaguaggaguauuugauauauggggacaaggaacaaaaguaacaguaaguagu

SEQ ID NO: 47984 - RNA, 432 nt, Artificial Sequence
  derived and/or modified sequence opt6 from anti-HIV_cap256-048-112047_VR-Chain
gaaguacaauuaguagaaaguggaggaggauuaguacaaccaggaggaaguuuaagacuaagcugugcagcaaguggacuaacaguaucaggauauuauaugaguuggguaagacaagcaccaggaaaaggacuagaaugguuagcauuuauacauuuugauggaucaaaaauacauuaugcaggaaguguaaaaggaagaauaacaguaagcagagacaauaguaaaaauacauuagauuuacaaaugaauagcuuaagagcagaagauacagcaguauauuacugugcaaaagauguaggagauaguaaaagugaugaaugggcaacagacuauuaugaucuaucaguagcauauccaguaccggacccaagagcaguaguaggagcauuugauauauggggacaaggaacaaugguaacaguaaguuca

SEQ ID NO: 47985 - RNA, 432 nt, Artificial Sequence
  derived and/or modified sequence opt6 from anti-HIV_cap256-048-112029_VR-Chain
caagugcaauuaguagaaagcggaggaggaguaguacaaccaggaagaagucuaagauuaagcugugcagcaagucaauuuacauuuucaaguuauggaaugcacuggguaagacaagcaccaggaaaaggacuagaauggguagcaggaauaucauuugcaggcauaaaaaaauacuaugcagauaguguaaaaggaagauuuacaauaagcagagacaauagcaaaaacacauuauaucuacaaaugaauagcuuaagaggagaagauacagcacuauauuacugugcaaaagacuuaagagaauaugaaugugaagaaugggcaucagacuauuacgauuucggaagagauuacccaugucaagacccaagaggaguaguaggaauauucgauauauggggacaaggaacaaugguaacaguaaguagu

SEQ ID NO: 47986 - RNA, 432 nt, Artificial Sequence
  derived and/or modified sequence opt6 from anti-HIV_cap256-048-110957_VR-Chain
caaguaagauuaguagaaaguggaggaggaguaguaagaaguggaagaaguuuaagauuaaguugugcagcaaguggauuuacauuuaguaauuuugcauuacauuggguaagacaagcaccaggaaaaggauuagaauggguagcaguaauaaguuaugauggaaauaguaaauuuuaugcagauaguguaaaaggaagauuuacaauaaguacagauaauaguaaaaauacauuauauuuacaaaugaauagucuaacagcagaagauacagcaguauauuauugugcaaaagauuuaggaggaaauaaagaugaugaauggggaacagauuauuaugauuuuaguguagcauauccaguacaagauccaagagcaguaaguggaauauuugauguauggggacauggaacaaugguaacaguaaguagc

SEQ ID NO: 47987 - RNA, 432 nt, Artificial Sequence
  derived and/or modified sequence opt6 from anti-HIV_cap256-048-110526_VR-Chain
caaguacaauuaguagaaagcggaggaggaguaguacaaccaggaagaagccuaagauugaguugugcagcaagcggauucacauucucaaacuucggcuuucacuggguaagacaagcaccaggaaaaggacuagaauggguagcagcaauaucauucgcaggaaauaauaaauacuaugcagauaguguaaaaggaagauuuacaauaagcagagaaaauagcaaaaacauacuauauuuacaaaugaauaguuuaagaggagaagauacagcaguauauuacugugcaaaagaccuaagagaauuugaaugcgaagaaugggcaucagacuauuacgauuggucaacagcauauccaguagaacacccaagagcaguaguaggaguauucgauauauggggacaaggaacaaaaguaacaguaaguuca

SEQ ID NO: 47988 - RNA, 432 nt, Artificial Sequence
  derived and/or modified sequence opt6 from anti-HIV_cap256-048-109336_VR-Chain
gaaguacaauuaguagaaaguggaggaggauuaguacaaccaggaggaagucaaagauuaaguugugcagcaaguggauuaacaguaaauaguaauuauaugacauggguaagacaagcaccaggaaaaggauuagaauggguagcaauaauaaguagugauggaaguggacaauauuaugcagauaguguaaaaggaagauuuacaauaaguagagauaauaguaaaaauacauuaaguuuacaaaugaauaguuuaagaccagaagauacagcaguauauuauugugcaaaagauuuaggagcaaguaaagaugaugaaugggcaacagauuauuaugauuuuaguauagcauauccaguacaagauccaagagcaguaguaggagcauuugauauauggggacaaggaacaaugguaacaguaaguagu

SEQ ID NO: 47989 - RNA, 432 nt, Artificial Sequence
  derived and/or modified sequence opt6 from anti-HIV_cap256-048-108152_VR-Chain
caagcacaauuaguagaaaguggaggaggaguaguacaaccgggaagaaguuuaguauuaaguucaguagcaaguggauuuucauuuaguacauaugcaaugcauuggguaagacaagcaccaggaaaaggauuagaauggguagcaguaauaaguuaugauggaggaaauaaauauuaugcagauaguguaaaaggaagauuuaguauaaguagagauaauaguaaaaauacaguauaucuacaaauaaauaguuuaagagcagaagauacagcaguauauuauugugcaaaagaucuaggagcaaauaaagaugaugaaugggcaacagauuauuaugauuuaucaguagcauauccaguaccagauccaagagcaguaguaggagcauuugauguauggggacaaggaacaaugguaacaguaaguagu

SEQ ID NO: 47990 - RNA, 432 nt, Artificial Sequence
  derived and/or modified sequence opt6 from anti-HIV_cap256-048-107799_VR-Chain
gaaguacaaguaguagaaaguggaggaggaguaguacaaccaggaaggaguuuaagauuaaguugugcagcaaguggauuuacauuuaguaauuaugcaauggauuggguaagacaagcaccaggaaaaggauuagaauggguagcauuuguaaguagugauggaaguaauaaaaauuaugcagauaguguaaaaggaagauuuacaauaaguagagauaauaguaaaaauacauuaaguuuacaaaugaauaguuuaagagcagaagauacagcaguauauuauugugcaaaagaaguaggagaaaauaaagaugaugaaugggcaagugauuauuaugauuuaaguauagcauauccaauacaugauccaagagcaguaguaggaggauuugauauauggggacaaggaacaaugguaacaguaaguagu

SEQ ID NO: 47991 - RNA, 432 nt, Artificial Sequence
  derived and/or modified sequence opt6 from anti-HIV_cap256-048-107384_VR-Chain
gaaguaagauuaguagaaagcggaggagcauuaguaaaaccaggaacaagcuuaagauuaaguugugcagcaagcggauucacauucacacacuaugcaauggacuggguaagacaagcaccaggaaaaggacuagaauggguagccauaauaucaagugauggaucaacaaaaaacuaugcagauagcguaaaaggaagauuuacaauaagcagagacaauaguaaaaacacauuaucacuacaaaugaauagcuuaagaccagaagauacagcaguauauuacugugcaaaagacguaggagcaaauaaagacgaugaaugggcaacagacuauuacgaucuaucaauagcauacccaguaccagacccaagagcaguaguaggagcauucgauauauggggacaaggcacaaugguaacaguaagcuca

SEQ ID NO: 47992 - RNA, 432 nt, Artificial Sequence
  derived and/or modified sequence opt6 from anti-HIV_cap256-048-106530_VR-Chain
gaaguacaauuacuagaaagcggaggaggauuaguacaaccaggaggaucacuaagauuaaguugugcagcaagcggauucacauucucaaguuaugcaauggacuggguaagacaagcgccaggaaaaggacuagaauggguagcaguaauaucaagugauggaucaaacaaaaacuaugcagauagcguaaaaggaagauuuacaauaagcagagacaauaguaaaaacacacuauaucuacaaaugagcagcuuaagaccagaagauacagcaguauauuacugugcaaaagacguaggagauagcaaaagcgaugaaugggcaacagacuauuacgauuucucaauagcauacccaauacaagacccaagagcaguaguaggagcauucgauauauggggacaaggaacaaugguaacaguaagcuca

SEQ ID NO: 47993 - RNA, 432 nt, Artificial Sequence
  derived and/or modified sequence opt6 from anti-HIV_cap256-048-106464_VR-Chain
gaaguacaaaugguacaaaguggaggaggauuaguacaaccaggaggaaguuuaagauuaaguugugcagcauuuggauuuacauuuacaaaucaugcaauggauuggguaagacaaguaccaggaaaaggauuagaauggguagcauuuauaucaagugauggaaguaauaaaaauuaugcagauaguguaaaaggaagauuuacaauaaguagagauaauaguaaaaauacaguauauuuacaaaugaguagucuaagaccagaagauacagcaguauauuauugugcaaaagauguaggagauaguaaaagugaugaaugggcaacagauuauuaugauuuaaguguagcauauccaguaccagauccaagagcaguaguaggagcauuugauauauggggacaaggaacaaugguaacaguaaguuca

SEQ ID NO: 47994 - RNA, 432 nt, Artificial Sequence
  derived and/or modified sequence opt6 from anti-HIV_cap256-048-106411_VR-Chain
caaguacaauuaguagaaaguggaggaggaguaguacaaccaggaagaaguuuaagauuaagcugugcagcaaguggauuuacauuuaguuauaguggaaugcauuggguaagacaagcaccaggaaaaggaauggaauggguagcaguaauaaguuaugauggaaguaauaaauauuaugcagauagugugaaaggaagauuuacaauaaguagagauaauaguaaaaauacauuauaucuacaaaugaauaguuuaagaguagaagauacagcaguauaucauugugcaaaagauuuaggaggaacaaaaagugaugaaugggcaacagauuauuaugauuuaaguauagcauauccaauacaagauccaggagcaguaguaggaguauuugauauauggggacaaggaacaaugguaacaguaaguagu

SEQ ID NO: 47995 - RNA, 432 nt, Artificial Sequence
  derived and/or modified sequence opt6 from anti-HIV_cap256-048-106306_VR-Chain
gaaguacaauuaguagaaaguggaggaggauuaguacaaccaggaggaaguuuaagauuaaguugugaagcaaguggauuuacauuuaauaauuauggaaugguauggguaagacaagcaccaggaaaaggauuagaauggguagcaauaauaaguuaugauggaacagaaaaauauuauguagauagcguaaaaggaagguuuacaauaagcagagauaauaguaaaaauacauuaaguuuacaaaugaauaguuuaagagcagaagauacagcaguauauuauugugcaaaagaaguaggagaaaauaaagaugaugaaugggcaagugauuauuaugauuuaaguauagcauauccaauacaugacccaagagcaguaguaggaggauuugauauauggggacaaggaacaaugguaacaguaaguagc

SEQ ID NO: 47996 - RNA, 432 nt, Artificial Sequence
  derived and/or modified sequence opt6 from anti-HIV_cap256-048-104496_VR-Chain
caaguacaauuaguagaaaguggaggaggauuaguaaaaccaggaggaaguuuaagauuaagcugugcagcaaguggauuuacauuuaguaguuauggaaugcauuggguaagacaagcaccaggaaaaggauuagaauggguagcauuuguaaguagugauggaaauaauaaaaauuaugcagauaguguaaaaggaagauuuacaauaaguagagauaauaguaaaaauacaguauauuuacaaaugaauaguuuaagaguagaagauacagcaguauauuauugugcaaaagauuuaggagcaaauaaagaugaugaaugggcaacagauuauuaugauuuaaguguagcauauccaguaccagauccaagagcaguaguaggagcauuugauguauggggacaaggaacaaugguaacaguaaguagu

SEQ ID NO: 47997 - RNA, 432 nt, Artificial Sequence
  derived and/or modified sequence opt6 from anti-HIV_cap256-048-103074_VR-Chain
caaguacauuuaguagaaaguggagcaggaguagugcaaccaggaggaaguuuaagauuaaguugugcaguaaguggauuuacauuuaauaguuauggaaugcauuggguaagacaagcaccaggaaaaggauuagaauggguagcaguaauaaguuaugauggaagugauaaauauuaugcagauagcguaaaaggaagauuuacaauaaguagagauucaaguaaaaauacauuauauuuacaaaugaauaguuuaagaguagaagauacagcaguauauuauugugcaaaagaucuaggagcaaauaaagaugaugaaugggcaacagauuauuaugauuuaaguguagcguauccaguaccagauccaagagcaguaguaggagcauuugauguauggggacaaggaacaaugguaacaguaaguagu

SEQ ID NO: 47998 - RNA, 432 nt, Artificial Sequence
  derived and/or modified sequence opt6 from anti-HIV_cap256-048-100832_VR-Chain
caaguacaauuaguagaaaguggaggaggaguaguacaaccaggaagaaguuuaagauuaaguugugcagcaaguggauuuacauuuaguagcuauggaaugcauuggguaagacaagcaccaggaaaaggauuagaauggguagcaguaguaaguagugauggaacaaauaaaaauuauggggauaguguaaaaggaagauuuacaauaaguagagauaauaguagaaauacaguauauuuacaaaugaguaguuuaagaccagaagauacagcaguauauuauugugcaaaagauguaggagauacgaaaagugaugaaugggcaacagauuauuaugauuuuaguauagcauauccaguacaagauccaagagcaguagugggagcauuugauauauggggacaaggaacaaugguaacaguaaguagu

SEQ ID NO: 47999 - RNA, 432 nt, Artificial Sequence
  derived and/or modified sequence opt6 from anti-HIV_cap256-048-100188_VR-Chain
caaguacauuuaguagaaaguggaggaggaguaguacaaccaggaagaaguuuaagaauauacugugcaguaagugaauuuacauucagaaauuaugcaaugcacuggguaagacuagcaccaggaaaaggacuacaauggguagcaguaauaucauauaauggagggaaaaaauacuaugcagauagcguaaaaggaagauuuacaauaagcagagacaauaguaaaaacgcacuauaucuacaaaugaauagcuuaagagcagaagauacagggcuauauuacugugcaaaagacuuaagagaauuugaaugugaagaaugggcaucagacuauuacgauuucggaagagaauauccaugucaagacccaagaggaguaguaggaacauucgauauauggggacaaggaacaaugguaacaguaaguuca

SEQ ID NO: 48000 - RNA, 432 nt, Artificial Sequence
  derived and/or modified sequence opt6 from anti-HIV_cap256-048-099645_VR-Chain
caaguacaauuaguagaaaguggaggaggaguaguacaaccaggaagaucauuaagacuaaguugugcagcaaguggauuuacauuuaguagauaugcauuacauuggguaagacaagcaccaggaaaaggauuagaauggguagcaguaauaaguuaugauggaaguagcaaauauuaugcagauaguguaaaaggaagauuuucaauaaguagagauaauaguaaauauacauuauauuuacaaaugaauaguuuaagagcagaugauacagcaguauauuuuugugcaaaagauuuaggaguaaauaaaaaugaugaaugggcaacagauuauuaugauuuaaguguagcauauccaguacaagauccaagaggaguagcaggaauauuugauauauggggacaaggaacaaugguaacaguaaguagu

SEQ ID NO: 48001 - RNA, 432 nt, Artificial Sequence
  derived and/or modified sequence opt6 from anti-HIV_cap256-048-098137_VR-Chain
caaguacaauuaguagaaaguggaggaggaguaguacaaccaggaagaaguuuaagacuaagcugugcagcaagcggauuuacauuaagaaauuaugcaaugcacuggguaagacaagcaccaggaaaaggacuagaauggguagcaguaauaaguagugauggaaauaauaaauacuaugcagacagcguaaaaggaagauuuacaguaaguagagacaauaguaaagacacacuauaucuacaaaugaauaguuuaagaccagaagauacagcauuauauuacugugcaaaagacuuaggagaaagagaaugugaagaaugggcaaguaacuauuacgauuucggaagagauuauccaugucaagacccaagaggaguaguaggaacauucgauauauggggacaaggaacaaugguaacaguaaguuca

SEQ ID NO: 48002 - RNA, 432 nt, Artificial Sequence
  derived and/or modified sequence opt6 from anti-HIV_cap256-048-097878_VR-Chain
caaguacaauuauuagaaaguggaggaggaguaguacaaccaggaaaaaguuuaagauuaagcugugcagcaaguggauucacauucaauacauauggaaugcacuggguaagacaagcaccaggaaaaggacuacaauggguagcaguaauaucauacgauggaacaauacaaaaauaugcagauagcguaaaaggaagauucacaauaagcagagaaaauagcaaaaacauguuauaucuacaaaugaauagcuuaagaggagaagauacagcaguauauuacugugcaaaagacuuaagagaauuugaaugcgaagaaugggcaagugacuauuacgauuucggaagagauuauccaugccaagacccaagaggaguaguaggaacauucgauguauggggacauggaagucuaguaacaguaaguuca

SEQ ID NO: 48003 - RNA, 432 nt, Artificial Sequence
  derived and/or modified sequence opt6 from anti-HIV_cap256-048-097510_VR-Chain
caaguacaauuaguagaaaguggaggaggaguaguacaaccaggaagaaguuuaugguuaaguugugcagcaagugaauuuacauuaagaaguuauggaaugcacuggguaagacaagcaccaggaaaaggauuagaauggguagcauuuguagcauuugaugaaagugauaaauauuaugcagauaguguaaaaggaagauuuacaauaaguagagacaauaguaaaaauacauuaagucuacaaaugaauaguuuaagagcagaagauacagcaguauauuauugugcaaaagaaguaggagauaauaaagaugaugaaugggcaagcgauuauuaugauuuaaguauagcauauccaguacaugauccaagagcaguaguaggaggauuugauauauggggacaaggaacaaugguaacaguaaguagu

SEQ ID NO: 48004 - RNA, 432 nt, Artificial Sequence
  derived and/or modified sequence opt6 from anti-HIV_cap256-048-097313_VR-Chain
caaguacaauuaguagaaaguggaggaggauuaguacaaccaggaggagcauuaagauuaaguuguuuagugaguggauuuacauuugaugauuaugcauuacauuggguaagacaagcaccaggaaaaggaccagaauggguagcaguauuaaguagugauggaaguuauaaauauuauacagaaaguguacaaggaagauuuacaauaaguagagauaauaguaaaaauacaguauauuuacaaaugaauaguuuaagaggaguagauacagcaguauauuauugugcaaaagauuuaggaggaggagaaguagaagaaugggcaacagauuauuaugauuggaguauagcauauccaguagaacauccaagagcaguaguaggaguauuugauauauggggacaaggaacaaaaguaacaguaaguagu

SEQ ID NO: 48005 - RNA, 432 nt, Artificial Sequence
  derived and/or modified sequence opt6 from anti-HIV_cap256-048-096626_VR-Chain
gaaguacaauuaguagaaaguggaggaggauuaguacaaccaggagaaaguuuaagauuaaguugugcaggaaguggauuuacauuuaguagcuauuggaugaguuggguaagacaagcaccaggaaaaggauuagaauggauggcauuaauaaguuaugauggaaguaauaaauauuauguagauaguguaaaaggaagauuuacaauaagcagagauaauaguaaaaauacacuauauuuacaaaugaauaguuuaagagcagaagauacagcaguauauuauugugcaaaagauuuaggaggaaauaaagaugaugaaugggcaacagauuauuaugaucuaaguauagcauauccaguacaagauccaagaguaguaguaggaauauuugauauauggggacaaggaacaaugguaacaguaaguuca

SEQ ID NO: 48006 - RNA, 432 nt, Artificial Sequence
  derived and/or modified sequence opt6 from anti-HIV_cap256-048-096483_VR-Chain
gaaguacaauuaguagaaaguggaggaggauuaguacaaccaggaagaaguuuaagauuaagcugugcagcaaguggauuuucauuugaagauuaugcaaugcacuggguaagacaagcaccaggaaaaggauuagaauggguagcaggaauaaguuuugcaggaacaaaaaaauauuaugcagauaguguaaaaggaagauuuacaauaagcagagacaauaguaaaaaugcauuauauuuacaaaugaauagucuaagagcagaagauacagcauuauauuauugugcaaaagauuuaagagaauaugaaugugaagaaugggcaucagacuauuaugauuuuggaagagauuauccaugucaagacccaagaggaguaguaggaacauuugauauauggggacaaggaacaaugguaacaguaaguuca

SEQ ID NO: 48007 - RNA, 432 nt, Artificial Sequence
  derived and/or modified sequence opt6 from anti-HIV_cap256-048-095691_VR-Chain
caaguacaauuaguagaaaguggaggagggguaguacaaccaggaagaaguuuaagauuaaguugugcagcaaguggauuuacauuuaguaguuauggaauggcauggguaagacaagcaccaggaaaaggauuagaauggguaacagcaauaaguuuugcaggaacaaauaaauauuaugcagauaguguaaaaggaagauuuacaauaaguagagauaauagcaaagacacacuauauuuacaaauggauggauugagaccagaagauacagcauuauauuauugugcaaaagauuuaggagaaagagaaugugaagaaugggcaaguaauuauuaugauuuuggaagagauuauccaugucaagauccaagaggaguaguaggaacauuugauauauggggacaaggaacaaugguaacaguaaguagu

SEQ ID NO: 48008 - RNA, 432 nt, Artificial Sequence
  derived and/or modified sequence opt6 from anti-HIV_cap256-048-095525_VR-Chain
caaguacaauuaguacaaaguggaggaaguguaguacaaccaggaaaaagucuaagauuaaguugugcagcaaguggauuuacauuuaguaguuuuggaaugcauuggguaagacaaacaccgggaaaaggauuagaauggguagcaguaauaaguuaugauggaagugaaaaaagcuaugcagauaguguuaaaggaagauuuacaauaaguagagauaauaguaaaaauacauuauauuuacaaaugaauagcuuaagagcagaagauacagcaguauauuauugugcaaaagauuuaggaggaacaaaagaugaugaaugggcaacagauuauuaugauauaucaauagcauauccaguacaagauccaagagcaguagcaggagcauuugauauauggggacaaggaacaauggugacaguaaguuca

SEQ ID NO: 48009 - RNA, 432 nt, Artificial Sequence
  derived and/or modified sequence opt6 from anti-HIV_cap256-048-094783_VR-Chain
gaaguacaauuaguagaaaguggaggaggauuaguaaaaccaggaggaaguuuaagauuaaguugugcagcaaguggaauaacauuuaguacauaugaaaugaauuggguaagacaagcaccaggaaaaggaauggaauggguagcaguaauaaguuaugauggaaguaauaaauauuaugcagauaguguaaaaggaagauuuacaauaaguagagauaauaguaaaaauacaguauauuuacaaaugaauaguuuaagaggaguagauacagcaguauauuauugugcaaaagauuuaggaggaggagaaguagaagaaugggcaacagauuauuaugauuggaguauagcauauccaguagaacauccaagagcaguaguaggaguauuugauauauggggacaaggaacaaaaguaacaguaaguagu

SEQ ID NO: 48010 - RNA, 432 nt, Artificial Sequence
  derived and/or modified sequence opt6 from anti-HIV_cap256-048-094356_VR-Chain
caaguacaauuaguagaaaguggaggaggaguaguacaaccaggaagaaguuuaagauuaaguugugcagcaaguggauuuauauuuacacauuaugcgauggauuggguaagacaagcaccaggaaaaggauuagaauggguagcaguaauaaguagugauggaaguaguaaaaacuaugcagauaguguaaaaggaagauuuacaauaaguagagauaauaguaaaaauacaguaaguuuacaaaugaauaguuuaagaccagaagauacagcaguauauuauugugcaaaagauguaggagauaauaaaagugaugaaugggcaacagauuauuaugauuuuaguauagcauauccaguaccagauccaagagcaguaguaggagcauuugauuuauggggacaaggaacaaugguaacaguaaguagu

SEQ ID NO: 48011 - RNA, 432 nt, Artificial Sequence
  derived and/or modified sequence opt6 from anti-HIV_cap256-048-090756_VR-Chain
caaguacaauuaguagaaaguggaggaggaguaguaagaccaggaagaaguuuaagauuaaguugugcaguaaguggauuuacauuuaguaauuaugcaauacauuggguaagacaagcaccaggaaaaggauuagaauggguagcaguaauaucauaugauggaagugauaaauauuaugcagauaguguaaaaggaagauuuacaauaaguagagaaaauaguaaaaauauguuauauuuacaaaugaauaguuuaagaggagaagauacagcaguauauuauugugcaaaagauuuaagagaauuugaaugugaagaaugggcaagugauuauuaugauuuuggaagagauuauccaugucaagauccaagaggaguaguaggaacauuugauguauggggacauggaucauuaguaacaguaaguagu

SEQ ID NO: 48012 - RNA, 432 nt, Artificial Sequence
  derived and/or modified sequence opt6 from anti-HIV_cap256-048-089065_VR-Chain
caaguacaauuaguagaaaguggaggaggaguaguacaaccaggaagaaguuuaagauuaaguugugcagcaagcggauuuacauuuaguacauaugcaaugcauuggguaagacaagcaccaggaaaaggacuagaauggguagcauuaauaaguuaugauggaacaaacaaauauuauguagauaguguaaaaggaagauuuacaauaaguagagauaauaguaaaaauacacuauauuuacaaaugaauaguuuaacagcagaagauacagcaguauauuauugugcaaaagauuuaggaggaaauaaagaugaugaauggggaacagauuauuaugauuuuaguguagcauacccaguacaagauccaagagcaguaaguggaauauuugauguauggggacauggaacaaugguaacaguaaguagu

SEQ ID NO: 48013 - RNA, 432 nt, Artificial Sequence
  derived and/or modified sequence opt6 from anti-HIV_cap256-048-084986_VR-Chain
caaguacaauuaguagaaaguggaggaggaguaguacaaccaggaagaaguuuaagauuaaguugugcagcaaguggauuuacauuuagugauuacgcaaugcauuggguaagacaagcaccaggaaaaggauuagaauggguagcauuaauaaguuaugauggaaguaauaaauauuaugcagauaguguaaaaggaagauuuacaauaaguagagauaauaguaaaaauacauuauauuuacaaaugaguaguuuaacagcagaagauacagcaguauauuauugugcaaaagauuuaggaggaaauaaaaaugaugaaugggcaacagauuauuaugauuuaagcauagcauauccaauacaugauccaagagcaguauuaggagcauuugauguauggggacaaggaacaauguuaacaguaaguagc

SEQ ID NO: 48014 - RNA, 432 nt, Artificial Sequence
  derived and/or modified sequence opt6 from anti-HIV_cap256-048-083355_VR-Chain
caaguacaauuaguagaaaguggaggaggaguaguacaaccaggaagaaguuuaagauuaagcugcgcaguaaguggauuuauauuuaguaguuaugcaaugagauggguaagacaagcaccaggaaaaggauuagaauggguagcaguaauaaguuaugauggaaguaaaacaaauuaugcagauaguguaaaaggaagauuuacaauaagcagagauaauagcaaaaauacauuauauuuacaaaugaauaguuuaacaagugaagauacagcaguauauuauugugcaaaagauuuaggaggaaguaaaacagaugaauggggaacagauuauuaugaauuuuggaaugcauauccaguacaagauccaagaguaguaguaggagcauuugacauauggggacauggaacaaugguaacaguaaguagu

SEQ ID NO: 48015 - RNA, 432 nt, Artificial Sequence
  derived and/or modified sequence opt6 from anti-HIV_cap256-048-082462_VR-Chain
caaguacauuuaguagaaaguggaggaggaguaguacaaccaggaaaaaguuuaagauuaaguuguacagcaaguagauuuauauuuagaaauuaugcaauggauuggguaagacaagcaccaggaaaaggacuagaauggguagcaguaauaaguuaugauggaguaaaagagcauuaugcagaaaguguaaaaggaagauuuacaauaaguagagauaauaguaaaaauacaguauauuuacaaaugaauaguuuaagaguagaagauacagcaguauauuauugugcaaaagauuuaggagcaaauaaagaugaugaaugggcaacagauuauuaugauuuaaguguagcauauccaguaccagauccaagagcaguaguaggagcauuugauguauggggacaaggaacaaugguaacaguaagcagc

SEQ ID NO: 48016 - RNA, 432 nt, Artificial Sequence
  derived and/or modified sequence opt6 from anti-HIV_cap256-048-082246_VR-Chain
caaguacauuuaguagaaaguggaggaggaguaguacaaccaggaagaaguuuaagaauaaguugugcagcaagcggauuuacauuuaguaaaaaugcaaugcauuggguaagacaagcaccaggaaaaggauuagaauggguagcauuuguagcauuugaugaaagugauaaauauuaugcagauaguguaaaaggaagauuuacaauaaguagagauaauaguaaaaauauauuaaguuuacaaaugaauagcuuaagagcagaagauacagcaguauauuauugugcaaaagaaguagaugaauauaaagaugaugaaugggcaagcgauuauuaugauuuaaguauagcauauccaguaagagauccaagagcaguaguaggaggauuugauauauggggacaaggaacaaugguaacagugagcgca

SEQ ID NO: 48017 - RNA, 432 nt, Artificial Sequence
  derived and/or modified sequence opt6 from anti-HIV_cap256-048-080752_VR-Chain
caaguacaauuaguagaaagcggaggaggaguaguacaaccaggaggaaguuuaagauugaguugugcagcaagcggauuuacauucucaaauuauggaaugcacuggguaagacaagcaccaggaaaaggacuagaauggguagcauuuauaagauaugauggagauauaacauauuauguagauaguguaaaaggaagauuuacaauaagcagagacaauaguaaaaaugcacuauauuuacaaaugaauaguuuaagagcagaagauacagcacuauauuacugugcaaaagacuuaagagaauaugaaugugaagaaugggcaagugacuauuaugauuucggaagagaauauccaugucaagacccaagaggaguaguaggaacauucgauauauggggacaaggaacaaugguaacaguaaguuca

SEQ ID NO: 48018 - RNA, 435 nt, Artificial Sequence
  derived and/or modified sequence opt6 from anti-HIV_cap256-048-078409_VR-Chain
caaguacaauuaguagaaucaggaggaggaguaguacaaccaggaagaucauuaagacuaucaugugcagcaucaggauuuacauuuaauaauuaugcaauggauuggguaagacaagcaccaggaaaaggauuagaauggguagcacuaauaucauaugacggaaguaauaaauauuaugcagaaucaguaaaaggaagauuuacaauaucaagagauaauaguaaaaauacauuauauuuacaaaugaauaguuuaagagcagaagacacagcaguauauuauugugcaaaagauguaggagaaaaacaaucaaugaugagaugggcaacagacuauuaugauuuaucaauagcauauccaguaccagacccaagagcaguaguaggagcauuugauuuauggggaagaggaacaaugguaacaguaucauca

SEQ ID NO: 48019 - RNA, 432 nt, Artificial Sequence
  derived and/or modified sequence opt6 from anti-HIV_cap256-048-078273_VR-Chain
gaaguacaauuaguagaaagcggaggaggauuaguacaaccaggaggaaguuuaagauuaagcugugcagcaagcggauuuacaguaucaaguaauuacaugagcuggguaagacaagcaccaggaaaaggacuagaauggguagcaguaauaucaagugauggaucaaauaaaaauuaugcagauaguguaaaaggaagauuuacaauaagcagagacaauaguaaaaauacacuauuucuacaaaugaauagcuuaagaccagaagauacagcaguauauuucugugcaaaagacuuaggagcaaauaaagaugaugaaugggcaacagacuauuacgauuuaaguauagcauauccaguacaugacccaagagcaguaguaggaauauuugauuuauggggacaaggaacaaugguaacaguaaguuca

SEQ ID NO: 48020 - RNA, 432 nt, Artificial Sequence
  derived and/or modified sequence opt6 from anti-HIV_cap256-048-078062_VR-Chain
gauguauauuuaguagaaaguggaggaggauuaguacaaccaggaggaaguuuaagauuaaguuguacagcaaguggaauaacauuuaguacauaugaaaugaauuggguaagacaagcaccaggaaaaggauuagaauggguagcauuuguagcauuugauggaagugauaaauauuaugcagauaguguaaaaggaagauuuguaauaaguagagauaauaguaaaaauacauuaaguuuacaaaugaauaguuuaagagcagaagauacagcaguauauuauugugcaaaagaaguaggagaagauaaagacgaugaaugggcaagugauuauuaugauuuaagcauagcauauccaguacaugauccaagagcaguaguaggaggauuugauauauggggacaaggaacaaugguaacaguaaguagu

SEQ ID NO: 48021 - RNA, 432 nt, Artificial Sequence
  derived and/or modified sequence opt6 from anti-HIV_cap256-048-077798_VR-Chain
caaguacaauuaguagaaagcggaggaggaguaguacaaccaggaagaaguuuaagauuaagcugugcagcaagcggauuuacauucaguaauuauggaaugcacuggguaagacaaacaccaggaaaaggauuagaauggguagcaguaauaucauaugauggaucaaauaaauuuuaugcagauagugugaaaggaagauuuacaauaagcagagacaauaguaaaaauacauuauauuuacaaaugaauaguuuaagaguagaagauacagcaguauaucauugugcaaaagauuuaggaggaaguaaaagugaugaaugggcaacagacuauuaugauuggucaauagcauauccaguacaugacccaagagcaguaguaggaguauuugauauauggggacaaggaacauuaguaacaguaaguuca

SEQ ID NO: 48022 - RNA, 432 nt, Artificial Sequence
  derived and/or modified sequence opt6 from anti-HIV_cap256-048-073853_VR-Chain
gaaguacaauugguagaaagugggggaggauuaguaaaaccaggaggaaguuuaagauugaguugugcagcaaguggauuuacauuuagugaugcauggaugaauuggguaagacaagcaccaggaaaaggauuagaauggguagcaggaauaaguuuugcaggaacaaauaaauauuaugcagauaguguaaaaggaagauuuacaauaaguagagauaauaguaaaaauacauuauauuuacaaaugaauaguuuaagagcagaagauacagcauuauauuauugugcaaaagauaugagagaauaugaaugugaagaaugggcaagugauuauuaugauuuuggaagagauuauccaugucaggauccaagaggaguaguaggaacauuugauauauggggacaaggaacaaugguaacaguaaguagu

SEQ ID NO: 48023 - RNA, 435 nt, Artificial Sequence
  derived and/or modified sequence opt6 from anti-HIV_cap256-048-071661_VR-Chain
caaguacaauuaguagaaaguggaggagggguaguacaaccaggaagaaguuuaggauuaaguugugaaguaaguggauuuacauuuagugauuauuuuaugaguuggauaagacaagcaccaggaaaaggauuagaauggguagcaguaauaagucaugacggaaauaauaaauauuauccagauaguguacaaggaagauuuacaauaaguagagaaaauaguaaaaauacauuauauuuacaaaugaauaguuuaaaaccagaagauacagcaguauauuuuugugcaaaagauuuaggaggagaaagcgaaguagaagaaugggcaagugauuauuaugauuuuggaagagauauaccaggaccagauccaagaggaguaguaggaacacuagauauauggggacauggaacaaugguaacaguaaguagc

SEQ ID NO: 48024 - RNA, 432 nt, Artificial Sequence
  derived and/or modified sequence opt6 from anti-HIV_cap256-048-071360_VR-Chain
caaguacaauuaguagaaaguggaggaggaguaguacaaccaggaagaaguuuaagauuaaguugugcagcaaguggauuuacacuaacaaauuaugcaauggauuggguaagacaagcaccaggaaaaggauuagaauggguagcaguaauaucaagugauggcaguaauaaaaauuaugaagauaguguaaaaggacgauuuacaauaaguagagauaauaguaaaaauacacuauauuuacaaaugucaaguuuaagaccagaagauacagcaguauauuauugugcaaaagauguaggagauaauaaaagugaugaaugggcaacagauuauuaugauuuuaguauagcauauccaguaccagauccaagagcaguaguaggagcauuugauuuauggggacaaggaacuaugguaacaguaaguagu

SEQ ID NO: 48025 - RNA, 432 nt, Artificial Sequence
  derived and/or modified sequence opt6 from anti-HIV_cap256-048-070955_VR-Chain
gaaguacaauuaguagaaagcggaggaggauuaguacaaccaggaggaaguguaagauuaaguugugcaguaaguggauuuacauuuaguaguuauuggaugaguuggguaagacaagcaccaggaaaaggauuagaauggguagcagugauaagugauaguggaucaaauaaauauuaugcagauaguguaaaaggaagauuuacaauaaguagagauaauaguaaaaauacauuauauuuacaaaugaauagcuuaagagcagaagauacagcaguauauuuuugugcaaaagauuuaggagggagagaaacagaagaaugggcaucagauuauuaugauuuuggaagagauuuuccaggacaagaucaaagagcaguagcaggaguauuugauauguggggacaaggaacaaugguaacaguaaguuca

SEQ ID NO: 48026 - RNA, 432 nt, Artificial Sequence
  derived and/or modified sequence opt6 from anti-HIV_cap256-048-070061_VR-Chain
gaaguacaauuauuagaaaguggaggaggauuaguacaaccaggaggaagucuaagauuaaguugugcagcaagcggauuuacauuuaguucauaugcaaugcauuggguaagacaagcaccaggaaaaggauuagaauggguagcaguaacaaguuaugauggaaguaauaaauauuaugcagauaguguaaaaggaagauuuacaauaaguagagauaauagcaaaaauacauuauauaugcaaaugaauaguuuaagagcagaagauacagcaguauauuauugugcaaaagaucaaggagaaagugaaaaagaagaaugggcaagugauuauuaugauuuuggaagagauuauccaggaagagauccaagaaggguaguagcaacauuugcaauauggggacaaggaacaaugguaacaguaaguagu

SEQ ID NO: 48027 - RNA, 432 nt, Artificial Sequence
  derived and/or modified sequence opt6 from anti-HIV_cap256-048-069669_VR-Chain
caaguacaauuaguagaaagcggaggaggaguagugcaaccaggaagaaguuuaagauuaaguugugcaguaagcggauucacauucucaaaauuuccaaugcacuggguaagacaagcaccaggaaaaggacuagaauggguagcaguaauaucauaugauggaaacaaaaaauacuauguagauagugcaaaaggaagauuuacaauaagcagagacaauaguagaaaaacacuauaucuacagaugacaggauuaagaccagaagauacagcaguauauuacugugcaaaagacuuaggaggaggagaaugugaaacaugggcaucagacuauuacgauuucggaaaagauuacccgugcuuagacccaagagauguaguaggaacauucgauauauggggacaaggaacacuaguaacaguaaguuca

SEQ ID NO: 48028 - RNA, 432 nt, Artificial Sequence
  derived and/or modified sequence opt6 from anti-HIV_cap256-048-069205_VR-Chain
caaguacaauuaguagaaagcggaggaggaguaguacaaccaggaagaaguuuaagauuaaguugugcagcaaguggauucacauucucaagcuaugcaaugcacuggguaagacaagcaccaggaaaaggacuagaauggguaguaguaauaucaaacgauggaaauaacaaauacuacgcagauagcguaaaaggaagauuuacaauaagcagagacaauaguaaaaacacaguauaucuacaaaugaauagcuuaagagcagaagauacagcaguauauuacugugcaaaagacguaggagauacaaaaaaagaugaaugggcaacggacuauuacgaucuaucaauagcauacccaguacaagacccacaagcaguaguaggagcauucgauauauggggacaaggaacaaugguaacaguaaguagu

SEQ ID NO: 48029 - RNA, 432 nt, Artificial Sequence
  derived and/or modified sequence opt6 from anti-HIV_cap256-048-068882_VR-Chain
caaguacaauuaguagaaaguggaggaggaguaguacaaccaggaagaaguuuaagauuaagcugugcagcaaguggauuuacauuuaguacauaugcaaugcauuggguaagacaagcaccaggaaaaggauuagaauggguagcauuaauaaguuaugauggaacagauaaauauuaugcagauaguguaaaaggaagauuuacaauaaguagagauaauaguaaaaauacaguauauuuacaaaugaauagcuuaagaggaguggauacagcaguauauuauugugcaaaagauuuaggaggaggagaaguagaagaaugggcaacagauuauuaugauuggaguacagcauauccaguagaacauccaagagcaguaguaggaguauuugauauauggggacaaggaacaaaaguaacaguaaguagu

SEQ ID NO: 48030 - RNA, 432 nt, Artificial Sequence
  derived and/or modified sequence opt6 from anti-HIV_cap256-048-067764_VR-Chain
gaaguacaauuaguacaaaguggaggaggauuaguaaaaccaggaggaaguuuaagauuaaguugugcagcaaguggauuuacauuuaguacauauaguaugaauuggguaagacaagcaccaggaaaaggauuagaauggguagcaguaauaucaagugauggaaguaguaaaaauuaugcagauagcguaaaaggaagauuuacaauaaguagagauaauaguaaaaauacaguaaguuuacaaaugaauaguuuaagaccagaagauacagcaguauauuauugugcaaaagauguaggagcaaauaaagaugaugaaugggcaacagauuauuaugauuuaaguauagcauauccaguaccagauccaagggcaguaguaggagcauuugauauauggggacaaggaacaaugguaacaguaaguagu

SEQ ID NO: 48031 - RNA, 432 nt, Artificial Sequence
  derived and/or modified sequence opt6 from anti-HIV_cap256-048-066845_VR-Chain
caaguauuauuaguagaaaguggaggaggaguaguacaaccaggaggaaguuuaacauuaaguugugcagcaaguggauuuacauuuaguaauuauggaaugcauuggguaagacaagcaccaggaaaaggauuggaauggguagcauuuauaagauaugauggaaauaauaaauauuaugcagauaguguaaaaggaagauuuacaauaaguagagauaauaguaaagauacacuauauuuacaaauggauggauuaagaccagaagauacagcauuauauuauugugcaaaagauuuaggagaaagagaaugugaagaaugggcaaguaauuauuaugauuuuggaagagauuauccaugucaagauccaagaggaguaguaggaacauuugauauauggggacaaggaacaaugguaacaguaaguuca

SEQ ID NO: 48032 - RNA, 432 nt, Artificial Sequence
  derived and/or modified sequence opt6 from anti-HIV_cap256-048-065226_VR-Chain
gaaguacaauuaguagaaagcggaggaggauuagugaaaccaggaggaaguuugagauuaagcuguguagcaagcggauuuacauuuucaaauuauggaaugcacuggguaagacaagcaccaggaaaaggauuaguauggguagcaggaauaucauuugcaggaacaaauaaauauuaugcagcaaguguaaaaggacgauuuacaauaagcagagauaauaguaaaaauacacuauaucuacaaaugaauaguuuaagagcagaagauacagcacuauauuacugugcaaaagacaugagagaauaugaaugugaagaaugggcaucagacuauuaugauuucggaagagauuauccaugucaagacccaagaggaguaguaggaacauuugauauauggggacaaggaacaaugguaacaguaagcuca

SEQ ID NO: 48033 - RNA, 432 nt, Artificial Sequence
  derived and/or modified sequence opt6 from anti-HIV_cap256-048-063717_VR-Chain
caaguacaauuaguagaaaguggaggaggaguaguacaaccaggaagaaguuuaagauuaaguugugcagcaaguggauuuaguuuuaguaaucaugcaauggauuggguaagacaagcaccaggaaaaggauuagaauggguagcaguaauaaguagugauggaagugauaaaauauaugcagaaaguguaaaaggaagauuuacaauaaguagagauaauaguaaaaauacauuauauuuacaaaugaauagccuaagaguagaagauacagcaguauauuuuugugcaaaagauuuaggagcaaauaaagaugaugaaugggcaacagauuauuaugauuuaaguauagcauauccaguaccagacccaagagcaguaguaggagcauuugauauauggggacaaggaacaaugguaaguguaaguagu

SEQ ID NO: 48034 - RNA, 432 nt, Artificial Sequence
  derived and/or modified sequence opt6 from anti-HIV_cap256-048-063150_VR-Chain
gaaguacaauuaguagaaaguggaggaggaguaguacaaccaggaagaaguuuaagauuaaguugugcagcaaguggauuuacauuuaguaguuaugcaaugcauuggguaagacaagcaccaggaaaaggauuagaauggguagcacauauaagauaugauggaaguaauaaauauuauauagauaguguacaaggaagauuuacaauaaguagagauaauccaaaaaauacauuauauuuacaaaugaauagcuuaagaacagaagauacagcaguauauuauugugcaaaagauuuaggaggaggagaaguagaagaaugggcaacagauuauuaugauuggaguauagcauauccaguugaacauccaagagcaguaguaggaguauuugauauauggggacaaggaacaaaaguaacaguaaguagu

SEQ ID NO: 48035 - RNA, 432 nt, Artificial Sequence
  derived and/or modified sequence opt6 from anti-HIV_cap256-048-062431_VR-Chain
caaguacaauuaguagaaaguggaggaggaguaguacaaccaggaagaagcuuaagauuaaguugugcagcaaguggauuuacauuuaguaauuuugcaauggauuggguaagacaagcaccaggaaaaggauuagaauggguagcaguaauaaguagcgauggaaguaaaaaaaauuauggagauagcguaaaaggaagauuuacaauaaguagagauaauaguaaaaauacauuauuuuuacaaaugaauaguuuaagaccagaagauacagcauuauauuauugugcaaaagauuuaggaggauauaaaagugaugaaugggcaacagauuauuaugauuuaaguauagcauauccaguacaagauccaagaccgugguuagaauuauuauauauauggggacaaggagcaaugguaacaguaaguagu

SEQ ID NO: 48036 - RNA, 432 nt, Artificial Sequence
  derived and/or modified sequence opt6 from anti-HIV_cap256-048-060745_VR-Chain
caaguacaauuaguagaaagcggaggaaguguaguacaaccaggaagaaguuuaagauuaacauguacagcaaguggauuuacauuuagucauuaugcaauggauuggguaagacaagcaccaggaaaaggacuagaauggguagcaguaauaaguagugaugcaacaaauaaaaauuaugcagauaguguaaaaggaagauuuacaauaaguagagauaauaguaaaaauacaguauauuuacaaauggauaguuuaagagcagaagauacagcaguauauuauugugcaaaagauguaggagauuauaaagaugaugaaugggcaacagauuauuaugauuuuucaauagcauauccaguaccagauccaagagcaguaguaggagcauuugauuuuuggggacaaggaacaaugguaacaguaaguagu

SEQ ID NO: 48037 - RNA, 432 nt, Artificial Sequence
  derived and/or modified sequence opt6 from anti-HIV_cap256-048-060420_VR-Chain
caaguacaacuaguagaaagcggaggaggaguaguacaaccaggaagaagcuuaagauuaagcugugcagcaagcggauucacauuuucaagcuauggaauggcauggguaagacaagcaccaggaaaaggacuagaauggguuacaguaauaucauucgcaggaguaaaaaaauacuaugcagauagcguaaaaggaagauuuacaauaagcagagacaauaguaaaggaacacuauauuuacaaaugaauagcuuaagagcagaagauacagcaguauauuacugugcaaaagacguaggagauacaaaaaaagaugaaugggcaacagacuauuacgauuuaucaauagcauacccaguacaagacccacaagcaguaguaggagcauucgauauauggggacaaggaacaaugguaacaguaaguuca

SEQ ID NO: 48038 - RNA, 435 nt, Artificial Sequence
  derived and/or modified sequence opt6 from anti-HIV_cap256-048-060014_VR-Chain
caaguacaauuaguagaaaguggaggaggaguaguacaaccaggaagaaguuuaagauuaaguugugcagcaaguggauuuacauuuaguaauuacggaaugcauuggguaagacaagcaccaggaaaaggauuagaauggguagcauuaauaagucaugauggaaguaauaaaaauuuugcagauaguguaaaaggaagguuuacaauaaguagagauaauaguaaaaauacauuauauuuacaaaugaauaguuuaagaacagaagauacagcaauauauuauugugcaaaagauuuaggaggagaaagugaaauagaagaauggccaagugauuauuaugauuuuggaagagauuauccaguaccagauccaagaggaguaguaggaacauuugauuuuuggggacaaggaacaaugguaacaguaaguagu

SEQ ID NO: 48039 - RNA, 432 nt, Artificial Sequence
  derived and/or modified sequence opt6 from anti-HIV_cap256-048-059747_VR-Chain
caaguacaauuaguagaaaguggaggaggaguaguacaaccaggaagaaguuuaagauuaaguugugcagcaagcggauuuacauuuacacauuaugcaauggauuggguaagacaagcaccaggaaaaggauuagaauggguagcaguaauaaguagugauggaaguaguaaagauuaugcagauaguguaaaaggaagauuuacaauaaguagagauaauagcaaaaauacauuaaguuuacaaaugaauaguuuaagaccagaagauacagcaguauauuauugugcaaaagauuuaggagcaaguaaagaugaugaaugggcaacagauuauuaugauuuaaguauagcauauccaguacaugauccaagagcaguaguaggaggauuugauauauggggacaaggaacaaugguaacaguaaguagu

SEQ ID NO: 48040 - RNA, 432 nt, Artificial Sequence
  derived and/or modified sequence opt6 from anti-HIV_cap256-048-058393_VR-Chain
caaguacaauuaguagaaagcggaggaggaguaguacaaccaggaggaaguuuaagauuaagcugugcagcaagcggauucacauucaauacauauggaaugcacuggguaagacaagcaccaggaaaaggacuagaauggguaacauuuauaagauaugauggaucaaaugaauacuaugcagauagcguaaaaggaagauuuacaauaaguagggacaauaguaaaaacacacuauaucuacaaaugaauagcuuaagcguagaagauacagcaguauacuacugugcaaaagacuuaggaaaaaauaaagacgaugaaugggcaacagacuauuacgauauaucaauagcauacccaguaccagacccaagagcaguaguaggaguauucgauauauggggacaaggaacaguaguaacaguaagcagu

SEQ ID NO: 48041 - RNA, 432 nt, Artificial Sequence
  derived and/or modified sequence opt6 from anti-HIV_cap256-048-058159_VR-Chain
caaguacaauuaguagaaagcggaggaggaguaguacaaccaggaagaaguuuaagauuaaguugugcagcaagcggauuuacauuuaguaguuauccaaugcauuggguaagacaagcaccaggaaaaggauuagaauggguagcaguaauaaguuuugcaggaacaaauaaauauuaugcacauaguguaaaagggagauuuacaauaagcagagauaauaguaaaaauacauuauauuuacaaaugaauaguuuaagagcagaagauacagcauuauauuauugugcaagagauuuaagagaaagcgaaugugaagaaugggcaucagauuauuaugauuuuggaagagaauauccaugucaagauccaagaggaguaguaggaacauuugauauauggggaagaggaacaaugguaacaguaaguuca

SEQ ID NO: 48042 - RNA, 432 nt, Artificial Sequence
  derived and/or modified sequence opt6 from anti-HIV_cap256-048-057127_VR-Chain
gauguauauuuaguagaaaguggaggaggauuaguacaaccaggaggaaguuuaagauuaaguuguguagcaaguggaauaacauuuagcaguuauggaaugcauuggguaagacaagcaccaggaaaaggauuagaaugggcagcauuuauaagauaugauggaagaaauaaauauuaugcagauaguguaaaaggaagauuuacaauaaguagagauaauaguaaaaauacauuaaguuuacaaaugaauaauuuaagagcagaagauacagcaguauauuauugugcaaaagaaguaggagauaauaaagaugaugaaugggcaagugauuauuaugauuuaaguauagcauauccaguacaagauccaagagcaguaguaggaggauaugauauauggggacaaggaacaaugguaacaguaaguagu

SEQ ID NO: 48043 - RNA, 432 nt, Artificial Sequence
  derived and/or modified sequence opt6 from anti-HIV_cap256-048-056251_VR-Chain
gaaguacaauuaguagaaagugggggaggauuaguacaaccaggaagaaguuuaagauuaagcugugcaggaaguggauucacauuuaguaauuuuggauuucauuggguaagacaagcaccaggaaaaggauuagaauggguagcagcaauaaguuuugcaggauauaauaaauauuaugcagauaguguaaaaggaagauuuacaauaaguagagaaaauaguaauaauauguuauauuuacaaaugaguaguuuaagagcagaagauacagcaguauauuauugugcaaaagauuuaagagaaagcgaaugugaagaaugggcaucagauuauuaugauuuuggaaaagauuauccaugucaagauccaagaggaguaguaggaacauuugauguauggggacauggaaguuuaguaacaguaagcagu

SEQ ID NO: 48044 - RNA, 432 nt, Artificial Sequence
  derived and/or modified sequence opt6 from anti-HIV_cap256-048-055421_VR-Chain
caaguacaauuaguagaaaguggaggaggaguaguacaaccagcaagaaguuuaagauuaaguugugcagcaaguggauuuauauuuucaacauauggaaugcauuggguaagacaagcaccaggaaaaggauuagaauggguagcaguaauaaguagugauggaaguaguaaagauuaugcagauaguguaaaaggaagauuuacaauaaguagagacaauaguaaaaauacauuaaguuuacaaaugaauaguuuaagaccagaagauacagcaguauauuauugugcaaaagauuuaggagcaaguaaagaugaugaaugggcaacagauuauuaugauuuuaguauagcauauccaguacaagauccgagagcaguaguaggagcauuugauauauggggacaaggaacaaugguaacaguaaguagu

SEQ ID NO: 48045 - RNA, 432 nt, Artificial Sequence
  derived and/or modified sequence opt6 from anti-HIV_cap256-048-054989_VR-Chain
caaguacaauuaguagaaaguggaggaggaguaguacaaccaggaggaaguuuaagauuaaguugugcagcaaguggauuuacguuuaguacaaauggaaugcauuggguaagacaagcgccaggaaaaggauuagaauggguggcauuuauaagauaugauggaaguaauaaauauuaugcagauaguguaaaaggaagauuuacaauaaguagagauaauaguaaaaauacaguauauuuacaaaugaauaguuuaagaggaguagauacagcaguauauuauugugcaaaagauuuaggaggaggagaaguagaagaaugggcaacagauuauuaugauuggaguauagcauauccaguagaacauccaagagcaguaguaggaguauuugauauauggggacaaggaacaaaaguaacaguaaguagu

SEQ ID NO: 48046 - RNA, 435 nt, Artificial Sequence
  derived and/or modified sequence opt6 from anti-HIV_cap256-048-054759_VR-Chain
caaguacaauuaguagaaaguggaggaggaguaguacaaccaggaagaaguuuaagauuaaguugugcagcaaguggauuuaguuuuagcaaaaauggaaugcauuggguaagacaagcaccaggaaaaggauuagaauggguagcauuuguagcauuugaugaaagugauaaauauuaugcagauaguguaaaaggaagauuuacaauaaguagagauaauaguaaaaauacacuaaguuuacaaaugaauaguuuaagaguagaagauacagcaguauauuauugugcaaaagaaguaggagaaaauaaagaugaugaaugggcagcaccagauuauuaugauuuuaguauagcauauccaguacaagauccaagagcaguaguaggaggauuugauauauggggacaaggaacaaugguaacaguaaguagu

SEQ ID NO: 48047 - RNA, 432 nt, Artificial Sequence
  derived and/or modified sequence opt6 from anti-HIV_cap256-048-052573_VR-Chain
caaguaaaauuaguagaaaguggaggaggaguaguacaaccaggaagaaguuuaagauuaagcugugcagcaaguggauuuaguuuuaguaauuaugcaauggauuggguaagacaagcaccaggaaaaggauuagaauggguagcaguaguaaguagugauggaaguaauaaaaauuaugcagauagcguaaaaggaagauuuacaauaaguagagauaauaguaaaaauacaguauauuuacaaaugaauaguuuaagagcagaagauacagcaguauauuauugugcaaaagauuuaggagcaaauaaagaugaugaaugggcaacagauuauuaugauuggaguauagcauauccaguacaugauccaagagcaguaguaggaguauuugauauauggggacaaggaacauuaguaacaguaaguuca

SEQ ID NO: 48048 - RNA, 432 nt, Artificial Sequence
  derived and/or modified sequence opt6 from anti-HIV_cap256-048-051477_VR-Chain
caagaacaauuaguagaaaguggaggaggaguaguacaaccaggaagaaguuuaagauuaaguugugcagcaaguggauuuacauuuaguaauuaugcaaugcauuggguaagacaagcaccaggaaaaggauuagaauggguagcagcaaugagucaugauggaagugauaaauauuaugcagauaguguaaaaggaagauuuacaauaaguagagauaauaguaaaaauacauuauauaugcaaaugaauaguuuaagagcagaagauacagcaguauauuauugugcaaaagaucaaggagaaagcgaaaaagaagaaugggcaucagauuauuaugauuuaaguauagcauauccaauacaagauccaagagcaaugguaggagcauuugauauauggggacaaggaacaaugguaacaguaaguagu

SEQ ID NO: 48049 - RNA, 432 nt, Artificial Sequence
  derived and/or modified sequence opt6 from anti-HIV_cap256-048-051299_VR-Chain
caaguacaauuaguagaaagcggaggaggaguaguacaaccaggaagaaguuuaagauuaagcugugcagcaagcggauuuacauuuucaacauuuggaaugcacuggguaagacaagcaccaggaaaaggacuagaauggguagcauuaauaucacacgauggaaauaauaaauauuaugcagauaguuuaaaaggaagauuuacaauaagcagagaaaauaguaaaaauacauuauuucuacaaaugaacucauuaagagcagaagauacaucaguauauuacugugcaaaagacuuaggagauucagaaugugaagaaugggcaucagacuauuaugauuucggaaaagauuauccauguuuacacccaagaggaguaguaggaacauucgauuucuggggacauggaacaaugguaacaguaaguuca

SEQ ID NO: 48050 - RNA, 432 nt, Artificial Sequence
  derived and/or modified sequence opt6 from anti-HIV_cap256-048-050815_VR-Chain
caaguacaauuaguagaaaguggaggaggaguaguacaaccaggaggaaguuuaagacuaaguuguguaguaaguggauuuacauuuaguaguuauggaaugcauuggguaagacaagcaccaggaaaaggauuagaauggguaaguuuuauaagauuugauggaaauuaugaauauuauguagauagcguaaaaggaagauuuacaauaaguagagauaauaguaaaaauacaguauauuuacaaauggauaguuuaagagcagaagauacagcaguauauuauugugcaaaagauguaggagauuauaaagaugacgaaugggcaacagacuauuaugauuucaguauagcauauccaguaccagauccaagagcaguaguaggagcauuugauuuuuggggacaaggaacaaugguaacaguaaguagu

SEQ ID NO: 48051 - RNA, 432 nt, Artificial Sequence
  derived and/or modified sequence opt6 from anti-HIV_cap256-048-049884_VR-Chain
caaguacaauuaguagaaaguggaggaggaguaguacaaccaggaagaaguuuaagauuaaguugugcagcaaguggauuuaguuuuaauacauaugcaaugcauuggguaagacaagcaccaggaaaaggauuagaauggauggcauuaauaaguuaugauggaaguaauaaauauuauguagauaguguaaaaggaagauuuacaauaaguagagauaauaguaaaaauacauuauauuuacaaaugaauaguuuaagagcagaagauacagcaguauauuauugugcaaaagaucuaggagggaauaaagaugaugaaugggcaacagauuauuaugaucuaaguauagcauauccaguacaagauccaagaguaguaguaggaauauuugauauauggggacaaggaacaaugguaacagugaguagu

SEQ ID NO: 48052 - RNA, 432 nt, Artificial Sequence
  derived and/or modified sequence opt6 from anti-HIV_cap256-048-049170_VR-Chain
caaguacaauuaguagaaagugggggaggaguaguacaaccagggagaaguuuaagauuaaguugugcagcaaguggauuuauauuuaguaguuauggaaugcauuggguaagacaagcaccaggaaaaggauuagaauggguagcaguaauaaguggagauggaacaaaaaaagauuuugcagauaguguaaaaggaagauuuacaauaaguaaagauaauaguaaaaauaugguaaguuuacaaaugaauaguuuaagagcagaagaugcagcaguauauuauugugcaaaagauuuaggagaaagugauaaugaagaauggccaucagauuauuaugauuuuggaagagauuuuacaggacaaaauccaagagcaguaguaggaacauuugauuuauggggacaaggaacaaugguaacaguaaguagu

SEQ ID NO: 48053 - RNA, 435 nt, Artificial Sequence
  derived and/or modified sequence opt6 from anti-HIV_cap256-048-048531_VR-Chain
caaguacaauuaguagaaaguggaggaggaguaguacaaccaggaaggagucuaagauuaagcugugcagcaaguggauuuacauuuaguaguuauggauuacauuggguaagacaagcaccaggaaaaggauuagaauggguagcauuuauaaguuaugauggaaauaauaaacauuauguagauaguguaaaaggaagauuuacaauaaguagagauaauaguaaaaauacacuauauuuacaaaugaauaguuuaagagcagaagauacagcaguauauuauugugcaaaagauuuaggaggagaaucagaaauagaagaaugggcaacagauuauuaugauuuuaguauagcauauccaguaaaagaaaguagaggaguaguaggaauauuugauauguggggacaaggaacaaugguaacaguaaguagu

SEQ ID NO: 48054 - RNA, 432 nt, Artificial Sequence
  derived and/or modified sequence opt6 from anti-HIV_cap256-048-048259_VR-Chain
caaguacaauuaguagaaaguggaggaggaguaguacaaccaggaagaaguuuaagauuaaguugugcagcaaguggauuuacauuuaguacaugugcaaugcauuggguaagacaagcaccaggaaaaggauuagaauggguagcaguaauaaguuaugauggaaguaauaaauauuauguagauaguguaaaaggaagauuuacaauaaguagagauaauaguaaaaauacauuauauuuacaaaugaauaguuuaagagcagaagauacagcaguauauuauugugcaaaagaaguagauauaaauaaagaagaugaaugggcaagugauuauuaugauuuuagcauagcauauccaguacaagauccaagagcaguaguaggaggauuugauauauggggacaaggaacaaugguaacaguaaguagu

SEQ ID NO: 48055 - RNA, 432 nt, Artificial Sequence
  derived and/or modified sequence opt6 from anti-HIV_cap256-048-047313_VR-Chain
caaguacaauuaguagaaaguggaggaggaguaguacaaccaggaagaaguuuaagauuaaguugugcagcaaguggauuuacauuuaguacauuuggaaugcauuggguuagacaagcaccaggaaaaggacuagaauggguagcaguaauaagucaugauggaaauaauaaauauuaugcagauaguguaaaaggaagauuuacaauaagcagagauaauaguaaaaauacaguauauuuacaaaugaauaguuuaagagcagaagauacagcaguauauuacugugcaaaagauuuaggagcaaauaaagaugaugaaugggcaacagauuauuaugaucuaaguguagcauauccaguaccagauccaagagcaguaguaggagcauuugauguauggggacaaggaacaaugguaacaguaaguagu

SEQ ID NO: 48056 - RNA, 432 nt, Artificial Sequence
  derived and/or modified sequence opt6 from anti-HIV_cap256-048-046596_VR-Chain
caaguacaauuaguagaaaguggaggaggaguaguacaaccaggaggaagucuaagauuaagcugugcagcaagcggauuuacauuuaguaguuauggaaugcauuggguaagacaagcaccaggaaaaggauuagaauggguagcauuuaugagauuugauggaaguaauagauauuauggagauagcguaaaaggaagauuuacaauaaguagagauaauaguaaaaauacauuauauuuacaaaugaauaguuuaagaacagaagaugcagcauuauauuauugugcaaaagauaugagagaauuugaaugugaagaaugggcaagugauuauuaugauuuuggaagagauuauccaugucaagauccaagaggaguaguaggaauauuugauauauggggacaaggaacaaugguaacaguaaguagu

SEQ ID NO: 48057 - RNA, 432 nt, Artificial Sequence
  derived and/or modified sequence opt6 from anti-HIV_cap256-048-044781_VR-Chain
caaguacaauuaguagaaagcggaggaggaguaguacaaccaggaagaaguuuaagauuaaguugugcagcaaguggauuuacauuuacaagcuaugcaauacauuggguaagacaagcaccaggaaaaggauuagaauggguagcaguaauaaguuaugauggaaguaaaaaaaauuaugcagauagcguaaaaggaagauuuacaauaaguagagauaauagcaaaaauacacuauauguacaaaugaauaguuuaagagcagaagauacagcaguauauuauugugcaaaagaaguaggagaagauaaagaugaugaaugggcaagugauuauuaugauuuaaguauagcauauccaguacaugauccaagagcaguaguaggaggauuugauauauggggacaaggaacaaugguaacaguaaguagu

SEQ ID NO: 48058 - RNA, 432 nt, Artificial Sequence
  derived and/or modified sequence opt6 from anti-HIV_cap256-048-042599_VR-Chain
caaguacaauuaguagaaaguggaggaggaguaguacaaccgggaagaagucuaagauuaaguugugcagcaaguggauuuacauucaguaauuauggaaugcauuggguaagacaaacaccaggaaaaggauuagaauggguagcaguaauaaguuaugauggaaguaauaaauuuuaugcagauaguguaaaaggaagauuuacaauaaguagagauaauaguaaaaauacauuauauuuacaaaugaguaguuuaagagcagaugauacagcaguauauuauugugcaaaagaaguaggagaagauaaagaugaugaaugggcaagugauuauuaugauuuaaguauagcauauccaguacaugauccaagagcaguaguaggaggauuugauauauggggacaaggaacaaugguaacaguaaguuca

SEQ ID NO: 48059 - RNA, 432 nt, Artificial Sequence
  derived and/or modified sequence opt6 from anti-HIV_cap256-048-041276_VR-Chain
caaguacaauuaguagaaaguggaggaggaguaguacaaccaggaaggagcuuaagacuaagcugugcagcaagcagauucacauucucaagcuaugcaaugcacuggguaaggcaagcaccaggaaaaggacuagaauggguagcaauaauaucguacgauggaucaaacaaauacuaugcagauagcguaaaaggaagauuuacaauaagcagagacaauagcaaaaacacacuauuuuuacaaaugaauagucuaagagcagaagauacagcacuauauuacugugcaaaagacuuaggaggauacaaaagcgaugaaugggcaacagacuauuacgaucuaucaauagcauacccaauacaagacccaagagcaguaguaggagcauucgauauauggggacaaggaacaaugguaacaguaagcuca

SEQ ID NO: 48060 - RNA, 432 nt, Artificial Sequence
  derived and/or modified sequence opt6 from anti-HIV_cap256-048-040200_VR-Chain
caaguacaauuaguagaaaguggaggaggaguaguacaaccaggaagaaguuuaagauuaaguuguguagcaaguggauuuacauuuaguagcuuuggaaugcauuggguaaggcaagcaccaggaaaaggauuagaauggguagcaguaauaucacaugauggacauaauaaauauuaugcagauaguuuaaaaggaagauuuacaguaaguagagaaaauaguaaaaauacauuauuuuuacaaaugaauagcuuaagagcagaagauacaaguguauauuauugugcaaaagauuuaggagggggagaaugugaagaaugggcaagugauuauuaugauuuuggaagagauuauccauguuuaacaccaagaggaguaguaggaacauuugauauauggggacauggaacaacaguaacaguaaguagu

SEQ ID NO: 48061 - RNA, 432 nt, Artificial Sequence
  derived and/or modified sequence opt6 from anti-HIV_cap256-048-039061_VR-Chain
gaaguacaacuacuaggaagcggaggaggauuaguacaaccaggaggaagucuaagauuaacaugugcaguaagcggauuuacauucaguaguuuugcaaugagcuggguaagacaagcaccaggaaaaggauuagaauggguagcauuaauaucauaugauggaacagacaaauacuaugcagauagcguaaaaggaagauuuacaauaagcagagacaauagcaaaaacacacuauaucuacaaaugaauagcuuaagaguagaagauacagcaauauaucacugugcaaaagacuuaggaggaacaaaaagugaugaaugggcaacagacuauuacgauuuaucaauagcauauccaauacaagacccaggagcaguaguaggaguauucgauauauggggacaaggaacaaugguaacaguaaguuca

SEQ ID NO: 48062 - RNA, 432 nt, Artificial Sequence
  derived and/or modified sequence opt6 from anti-HIV_cap256-048-038515_VR-Chain
caaguacaauuaguagaaagcggaggaggaguaguacaaccaggaagaaguuuaagauuaagcugugcagcaagcggauucacauucucgacauaugcaaugcacuggguaagacaagcaccagggaaagggcuagaauggguaguaguaauaucauacgauggaucaaacaaauacuaugcagauagcguaaaaggaagauuuacaauaagcagagacaauagcaaaaacacacuauuucuacaaaugaauagcuuaagagcagaagauacagcauuauauuacugugcaaaagacguaggagaauacaaaagugaugaaugggcaacagacuauuacgaucuaucaauagcauacccaauacaagacccacgagcaaugguaggagcauucgauauauggggacaaggaacaaugguaacaguaagcuca

SEQ ID NO: 48063 - RNA, 432 nt, Artificial Sequence
  derived and/or modified sequence opt6 from anti-HIV_cap256-048-038255_VR-Chain
caaguacaauuaguagaaagcggaggaggaguaguacaaccgggaagaagccuacgacuaagcugugcagcaagcggauucacacuaucaagcuaugcaaugcacuggguaagacaagcaccaggaaaaggacuagaauggguagcaguaauaucauacgauggaucaaacaaauacuaugcagauagcguaaaaggaagauuuacaauaagcagagacaauagcaaaaacgcacuauaucuacaaaugaauagucuaagagcagaagauacagcacuauauuacugugcaaaagacuuaagagaauacgaaugcgaagaaugggcaucagacuauuacgauuucggaagagauuauccaugccaagacccaagaggaguaguaggaacauucgauauauggggacaaggaacaaugguaacaguaaguuca

SEQ ID NO: 48064 - RNA, 432 nt, Artificial Sequence
  derived and/or modified sequence opt6 from anti-HIV_cap256-048-038177_VR-Chain
caaguacaauuaguagaaucaggaggaggaguaguacaaccaggaagaaguuuaagauuaagcugugcagcaagcggauucacauucaauacauauggaauacacuggguaagacaagcaccaggaaaaggacuagaauggguagcacuaauaucauacgauggaacagacaaauacuaugcagauagcguaaaaggaagauuuacaauaagcagagacaauagcaaaaacacacuauaucuacaaaugaauagcuuaagaguagaagauacagcaauauaucacugugcaaaagacuuaggaggaacaaaaagcgaugaaugggcaacagacuauuacgauuuaucaauagcauacccaauacaagacccaggagcaguaguaggaguauucgauauauggggacaaggaacaaugguaacaguaagcuca

SEQ ID NO: 48065 - RNA, 432 nt, Artificial Sequence
  derived and/or modified sequence opt6 from anti-HIV_cap256-048-035513_VR-Chain
caaguacaauuaguagaaaguggaggaggaguaguacaaccaggaagaaguuuaagauuaaguugugcagcaaguggauuuacauuuaguaguuauggaauggcauggguaagacaagcaccaggaaaaggauuagaauggguaacaguaauaaguuuugcaggaguaaaaaaauauuaugcagauaguguaaaaggaagauuuacaauaaguagagauaauaguaaaggaacauuauauuuacagauggauggauuaagaccagaagauacagcauuauauuauugugcaaaagauuuaggagaaagagaaugugaagaaugggcaagugauuauuaugauuuuggaagagauuuuccaugucaagauccaagaggaguaguaggaacauuugauauauggggacaaggaacaaugguaacaguaaguagu

SEQ ID NO: 48066 - RNA, 432 nt, Artificial Sequence
  derived and/or modified sequence opt6 from anti-HIV_cap256-048-034112_VR-Chain
caaaugcaauuaguagaaaguggaggaggaguaguacaaccaggaagaaguuuaagauuaaguugugcagcaaguggauuuacauuuaauaguuaugcaaugcauuggguaagacaagcaccaggaaaaggauuagaauggguggcaguaauaaguuaugauggaucaaauaaauauuaugcagauaguguaaaaggaagauuuacaauaaguagagauaauaguaaaaauacaguauauuuacaaaugaauaguuuaagaggaguagauacagcaguauauuauugugcaaaagauuuaggaggaggagaaguagaagaaugggcaacagauuauuaugauuggaguauagcauauccaguagaacauccaagagcaguaguaggaguauuugauauauggggacaaggaacaaaaguaacaguaagcagu

SEQ ID NO: 48067 - RNA, 432 nt, Artificial Sequence
  derived and/or modified sequence opt6 from anti-HIV_cap256-048-033983_VR-Chain
caagugcaauuaguagaaagcggaggaggaguaguacaaccaggagaaaguuuaagauuaagcugugcagcaaguggauucacacuaucaagccacggaauacacuggguaagacaagcaccaggaaaaggacuagaauggguagcauuuauaucaagcgauggaucaaacaaaaacuauggagauagcguaaaaggaagauuuacaauaagcagagacaauagcaaaaacacacuauuuuuacaaaugaauaguuugagagcagaagauacagcacuauauuacugugcaaaagacguaggagaauacaaaagcgaugaaugggccacagacuauuacgaucuaucaauagcauacccaauacaagacccaagagcaaugguaggagcauucgauauauggggacaaggaacaaugguaacaguaagcuca

SEQ ID NO: 48068 - RNA, 432 nt, Artificial Sequence
  derived and/or modified sequence opt6 from anti-HIV_cap256-048-032688_VR-Chain
caaguacaauuaguagaaagcggaggaggaguaguacaaccaggaagaaguuuaagauuaagcugugcagcaagcggauucauauucaauaguuauggaaugcacuggguaagacaagcaccaggaaaaggacuagaauggguagcaguaguacauggagauggaggaaauaaauacuaugcagauaguguaaaaggaagauuuacaauaagcagagacaauaguaaaaacacgcuauauuuagaaaugaauagcuuaagagcagaagauacagcagaauauuacugugcaaaagacuuaggagaaagugauaaagaagaauggccaucagacuauuacgauuucggaagagauuucacaggacaaguaccaagagcaguaguaggagcauuugauauauggggacaaggaacaaugguaacaguaagcuca

SEQ ID NO: 48069 - RNA, 432 nt, Artificial Sequence
  derived and/or modified sequence opt6 from anti-HIV_cap256-048-031092_VR-Chain
caaguacaauuaguagaaagcggaggaggagugguacaaccaggaagaagucuaagacuaaguugugcagcaaguggauuuaguuuuuauaauuuugcaauggauuggguaagacaagcaccaggaaaaggacuagaauggguagcaguaauaagcagugauggaggaaauaaaaauuauguagauaguguaaaaggaagauuuacaauaagcagagauaauagcaaaaauacauuauauuuacaaaugaauaguuuaagagcagaagauacagcaguauauuauugugcaaaagauuuaggaggaacaaaagaugaugaaugggcaacagauuauuaugauauaucaauagcauauccaguacaagauccaagagcaguagcaggagcauuugauauauggggacaaggaacaaugguaacaguaaguuca

SEQ ID NO: 48070 - RNA, 435 nt, Artificial Sequence
  derived and/or modified sequence opt6 from anti-HIV_cap256-048-030464_VR-Chain
caaguacaauuaguagaaaguggaggaggauuaguaaaaccaggaggaaguuuaagauuaaguugugaagcaaguggauuuaguuuuacaaauuauuauaugaguuggauaaggcaagcaccaggaaaaggguuagaauggguagcaguaauaaguuuuaauggaagaaauaaauauuaugcagauuuuguaaaaggaagauuuacaauaaguagagauaauaguaaaaauacauuaaguuuacaaaugaauaguuuaagaguagaagauacagcaguauauuauugugcaaaagaaguaggagaaaauaaagaugaugaaugggcagcaccagauuauuaugauuuuaguauagcauauccaguacaagauccaagagcaguaguaggaggauuugauauauggggacaaggaacaaugguaacaguaaguagu

SEQ ID NO: 48071 - RNA, 432 nt, Artificial Sequence
  derived and/or modified sequence opt6 from anti-HIV_cap256-048-030289_VR-Chain
caaguacaauuaguagaaaguggaggaggaguaguacaaccaggaggaaguuuaagauuaaguugugcagcaaguggauuuacauuuucaaguuauggaaugcauuggguaagacaagcaccaggaaaaggauuagaauggguagcauuuauaagauaugauggaucaaauaaauauuaugcagauaguguaaaaggaagauuuacaauaagcagagauaauaguaaaaauacaguauauuuacaaaugaauaguuuaagaguagaagauacagcaguauauuauugugcaaaagauuuaggagcaaauaaagaugaugaaugggcaacagauuauuaugauuuaaguguagcauauccaguaccagauccaagagcaguaguaggagcauuugacguauggggacaaggaacaaugguaacaguaaguagu

SEQ ID NO: 48072 - RNA, 432 nt, Artificial Sequence
  derived and/or modified sequence opt6 from anti-HIV_cap256-048-030261_VR-Chain
caaguacaauuaguagaaagcggaggaggaguaguacaaccaggaggaaguuuaagauuaagcugugcagcaaguggauuuacauucucaacauuuggaaugcacuggguaagacaagcaccaggaaaaggacuagaauggguagcaguaauaucacaugauggaucaaauaaauauuaugcagauaguuuaaaaggaagauuuacaauaaguagagaaaauaguaaaaauacacuauauuuacaaaugaauaguuuaagauuggaagauacagcaguauaucacugugcaaaagauuuaggaggaaguaaaagcgaugaaugggcaacagacuauuaugauuuaucaguagcauauccaguacaagacccaagagcaguaguaggaguauuugauauauggggacaaggaacaaugguaacaguaaguuca

SEQ ID NO: 48073 - RNA, 432 nt, Artificial Sequence
  derived and/or modified sequence opt6 from anti-HIV_cap256-048-029362_VR-Chain
caaguacaauuaguagaaagcggaggaggaguaguacaaccaggaagaaguuuaagauuaagcugugcagcaagucaauuuacauuuucaaguuauggaaugcacuggguaagacaagcaccaggaaaaggauuagaauggguagcaggaauaucauuugcaggaacaaauaaauauuaugcagauagcguaaaaggaagauuuacaauaagcagagacaauaguaaaaauacacuauauuuacaaaugaauaguuuaagaacagaagaugcagcauuauauuacugugcaaaagacaugagagaauuugaaugugaagaaugggcaucagacuauuaugauuucggaagagauuacccaugucaagacccaagaggaguaguaggaauauuugauauauggggacaaggaacaaugguaacaguaaguagu

SEQ ID NO: 48074 - RNA, 432 nt, Artificial Sequence
  derived and/or modified sequence opt6 from anti-HIV_cap256-048-027638_VR-Chain
caaguacaauuaguagaaaguggaggaggaguaguacaaccaggaagaaguuuaagauuaaguuguguagcaaguggguuuauauuuucaaguuauggaauacauuggguaagacaagcaccaggaaaaggauuagaauggguagcaguaauaaguggagauggaacaaauaaauauugugcagauagcguaaaaggaagauuuacaauaaguagagauaauaguaaaaauacaguauuucuacaaaugaauaguuuaagagcagaagauacagcaguauuuuauugugcuaaagauuuaggagaaagugauaaagaagaauggccaagugauuauuaugauuuuggaagagauuuuacaggacaaguaccaagagcaguaguaggagcauuugauauauggggacaaggaacaaugguaacaguaagcagu

SEQ ID NO: 48075 - RNA, 432 nt, Artificial Sequence
  derived and/or modified sequence opt6 from anti-HIV_cap256-048-027613_VR-Chain
guacaacaauuaguagaaagcggaggagauguaguacaaccgggaacaaguuuaagauuaaguugugaagcaaguggauuaauauuaaguggauauggauuacauuggguaagacaagcaccaggaaaaggaauggaauggguagcaguaauaaguuaugauggaaguaauaaauauuaugcagauaguguaaaaggaagauuuacaauaaguagagacaauaguaaaaauacaguauauuuacaaaugaauaguuuaagaggaguagauacagcaguauauuauugugcaaaagauuuaggaggaggagaaguagaagaaugggcaacagauuauuaugauuggaguacagcauauccaguagaacauccaagagcgguaguaggaguauuugauauauggggacaaggaacaaaaguaacaguaaguagu

SEQ ID NO: 48076 - RNA, 432 nt, Artificial Sequence
  derived and/or modified sequence opt6 from anti-HIV_cap256-048-026627_VR-Chain
caaguacaauuacuaggaagcggaggaggaagcguacaaccaggaggaucauuaagacuaacaugugcaguaaguggauucacauucagcagcuuugcaaugagcuggguaagacaagcaccaggaaaaggacuagaauggguagcauuuauaucaagcgauggaacaaacaaaaacuauggagauagcguaaaaggaagauuuacaauaagcagagacaauaguaaaaacacacuauuucuacaaaugaauagcuuaagagcagaagauacagcacuauauuacugugcaaaagacuuaggaggauacaaaagcgaugaaugggcaacagacuauuacgaucuaucaauagcauacccaauacaagacccaagagcaguaguaggagcauucgauauauggggacaaggaacaaugguaacaguaaguuca

SEQ ID NO: 48077 - RNA, 432 nt, Artificial Sequence
  derived and/or modified sequence opt6 from anti-HIV_cap256-048-026239_VR-Chain
caaaugcaauuaguagaaaguggaggaggaguaguacaaccaggaagaaguuuaagauuaagcugugcagcaagcggauuuacauuuaauaguuaugcaaugcacuggguaagacaagcaccaggaaaaggauuagaauggguagcaguaauaaguuaugauggaucaaauaaauauuaugcagauaguguaaaaggaagauuuacaauaagcagagacaauaguaaaaauacacuauaucuacaaaugaauaguuuaagaacagaagaugcagcauuauauuacugugcaaaagauaugagagaauuugaaugcgaagaaugggcaucagacuauuaugauuucggaagagauuauccaugucaagacccaagaggaguaguaggaauauuugauauauggggacaaggcacaaugguaacaguaagcuca

SEQ ID NO: 48078 - RNA, 432 nt, Artificial Sequence
  derived and/or modified sequence opt6 from anti-HIV_cap256-048-025518_VR-Chain
caaguacaauuaguagaaagcggaggaggaguaguacaaccaggaagaaguuuaagauuaagcugugcaguaagcggauuuacauucagucaacaugcaaugcacuggguaagacaagcaccaggaaaaggacuagaauggguaacauuaauaucaaaugauggaacagaaaaauucuaugcagauagcguaaaaggaagauuuacaauaagcagagacaauagcaaaaauacacuauaucuacaaaugaauaguuuaagcguagaagauacagcaguauauuacugugcaaaagacuuaggaaaaaauaaagacgaugaaugggcaacagacuauuacgauauaucaauagcauauccaguaccagacccaagagcaguaguaggaguauucgauauauggggacaaggaacaguaguaacaguaaguuca

SEQ ID NO: 48079 - RNA, 432 nt, Artificial Sequence
  derived and/or modified sequence opt6 from anti-HIV_cap256-048-024854_VR-Chain
caaguacaauuaguagaaaguggaggaggaguaguacaaccaggaagaaguuuaacauuaagcugugcggcaaguggauuuacauuuaauaauuaugauaugcauuggguaagacaagcaccaggaaaaggauuagaauggguagcauuuacaagauaugauggaaguaaucaauauuaugcagauaguguaacaggaagauuuacaauaagcagagauaauaguaaaaauacaguauauuuacaaaugaauaguuuaagaggaguagauacagcaguauauuauugugcaaaagauuuaggaggaggagaaguagaagaaugggcaacagauuauuaugauuggagcauagcauauccaguagaacauccaagagcaguaguaggaguauuugauauauggggacaaggaacaaaaguaacaguaaguagu

SEQ ID NO: 48080 - RNA, 432 nt, Artificial Sequence
  derived and/or modified sequence opt6 from anti-HIV_cap256-048-024537_VR-Chain
caaguacaauuaguagaaaguggaggagcaguaguacaaccaggaagaaguuuaagauuaaguuguguagcaagcggauuuacauuuucaaguuaugcaaugcacuggguaagacaagcaccaggaaaaggacuagauuggguagcauuaauaucauaugauggaucaaauaaauauuuugcagauaguguaaaaggaagauuugcaauaaguagagacaauaguaaaaauacauuauauuuacaaaugaauaguuuaagaccagaagauacagcaguauauuacugugcaaaagauuuaggaggaggagaaugugaaacaugggcaagugacuauuaugauuucggaaaagauuauccauguuuagacccaagagauguaguaggaacauuugauauauggguacaaggaacauuaguaacaguaaguuca

SEQ ID NO: 48081 - RNA, 432 nt, Artificial Sequence
  derived and/or modified sequence opt6 from anti-HIV_cap256-048-021781_VR-Chain
caaguacaucuaguagaaaguggaggaggauuaguaaaaccaggaggaaguuuaagauuaaguugugaagcaaguggauuuaguuuuaguaauuaugcaauggauuggguaagacaagcaccaggaaaaggauuagaauggguagcauuuguaaguagugauggaaguaauaaaaauuaugcagauaguguaaaaggaagauuuacaauaagcagggauaauaguaaaaauacaguauauuuacaaaugaauaguuuaagaguagaagauacagcaguauauuauugugcaaaagauuuaggagcaaauaaagaugaugaaugggcaacagauuauuaugauuuaaguguagcauauccaguaccagauccaagagcaguaguaggagcauuugauguauggggacaaggaacaaugguaacaguaaguagu

SEQ ID NO: 48082 - RNA, 432 nt, Artificial Sequence
  derived and/or modified sequence opt6 from anti-HIV_cap256-048-021758_VR-Chain
caaguacaauuaguagaaaguggaggaggaguaguacaaccaggaagaaguuuaagauuaaguugugcagcaaguggauuuacauuuucaagauauggaaugcacugggucagacaagcaccaggaaaaggauuagaguggguagcaguaauaucauaugauggaucaaaagaauauuaugcagauaguguaaaaggaagauuuacaauaaguagagauaauaguaaagauacauuauauuuacaaaugucaaguuuaagaguagaagauacagcaguauauuauugugcaaaagaugugggagcaaauaaagaugaugaaugggcaacagauuauuaugaucuaucaauagcauauccaguaccagauccaagagcaguaguaggagcauuugauauauggggacaaggaacaaugguaacaguaaguuca

SEQ ID NO: 48083 - RNA, 432 nt, Artificial Sequence
  derived and/or modified sequence opt6 from anti-HIV_cap256-048-020988_VR-Chain
caaguacaauugguagaaagcggaggaggaguaguacaaccaggaagaaguuuaagauuaagcugugaagcaagcgcauucacauucucaaguuauggaaugcacuggguaagacaagcaccaggaaaaggacuagaauggguaacauucauaucauacucaggaaauaacaaauacuaugcagauagcguaaaaggaagauuuacaguaagcagagacaauaguaaaaacacacuauaucuacaaaugaauagcuuaacaucagaagauacagcaguauauuacugugcaaaagacuuaggaggaaguaaaacagaugaauggggaacagacuauuacgaauuuuggaacgcauauccaguacaagacccaagaguaguaguaggagcauucgauauauggggacauggaacaaugguaacaguaagcuca

SEQ ID NO: 48084 - RNA, 435 nt, Artificial Sequence
  derived and/or modified sequence opt6 from anti-HIV_cap256-048-020663_VR-Chain
caaguacaauuaguagaaaguggaggaggaguaguacaaccaggaaugaguuuaagauuaaguugugcagcaaguggauuuacauuuaguaauuuuggaaugcauuggguaagacaagcaccaggaaaaggauuagaauggguagcaguaauaagucaugauggaaauaauaaauauuauccagauaguguacaaggaagauuuacaauaagcagagaaaauaguaaaaauacauuauauuuacaaaugaauaguuuaaaaccagaagauacagcaguauauuuuugugcaaaagauuuaggaggagaaagugaaguagaagaaugggcaagugauuauuaugauuuuggaagggauauaccaggaccagauccaagaggaguaguaggaacauuagauauauggggacauggaacaaugguaacaguaaguagu

SEQ ID NO: 48085 - RNA, 432 nt, Artificial Sequence
  derived and/or modified sequence opt6 from anti-HIV_cap256-048-020590_VR-Chain
caaguacaauuaguagaaaguggaggaggaguaguacaaccaggaggaguaccaagacuagcaugugcagcaaguggauuuacauuuucaaguuaugcaaugcauuggguaagacaagcaccaggaaaaggauuagaauggguaacaguaauaagcuaugauggaaguaauaaauauuaugcagauaguguaaaaggaagauuuacaauaaguagagauaauaguaaaaauacauuauauuuacaaaugaauaguuuaagagcagaagauacagcaguauauuauugugcaaaagauuuaggaggaacaaaagaugaugaaugggcaacagauuauuaugauauaaguauagcauauccaguacaagauccaagagcaguagcaggagcauuugauauauggggacaaggaacaaugguaacaguaaguagu

SEQ ID NO: 48086 - RNA, 432 nt, Artificial Sequence
  derived and/or modified sequence opt6 from anti-HIV_cap256-048-019765_VR-Chain
caaguacaauuaguagaaagcggaggaggaguaguacaaccaggaagaaguuuaagacuaagcugugcagcaaguggauuuauauucacaaauuaugcaauggacuggguaagacaagcaccaggaaaaggacuagaauggguagcaguaauaucaagugauggaucaaauaaaaacuaugcagauagcguaaaaggaagauuuacaauaagcagagacaauagcaaaaacacaguaucacuacaaaugaauagcuuaagagcagaagauacagcaguauauuacugugcaaaagacuuaggagauaguaaaaaagaugaaugggcaacagacuauuacgaucuaucaauagcauauccaguaccagacccaagagcaguaguaggagcauucgauauauggggacaaggaacaauggugacaguaagcuca

SEQ ID NO: 48087 - RNA, 432 nt, Artificial Sequence
  derived and/or modified sequence opt6 from anti-HIV_cap256-048-019254_VR-Chain
caaguacaauuaguagaaaguggaggaggaguaguacaaccaggaagaagucuaagauuaagcugugcagcaagcggauucacaagcucaacauaugcaaugcacuggguaagacaagcaccaggaaaaggacuagaauggguagcauuaauaucauaugauggaacagacaaauacuaugcagauagcguaaaaggaagauuuacaauaagcagagacaauagcaaaaacacacuauaucuacaaaugaauagcuuaagaguagaagauacagcaguauaucacugugcaaaagacuuaggaggaaauaaaccagaugaaugggcaacagacuauuacgaucuaaguauagcauacccaguacaagauccaagagcaguaguaggaguauucgauauauggggacaaggaacaauaauaacaguaagcuca

SEQ ID NO: 48088 - RNA, 432 nt, Artificial Sequence
  derived and/or modified sequence opt6 from anti-HIV_cap256-048-018073_VR-Chain
caaguacaauuaguagaaaguggaggaggaguaguacaaccaggaagaaguuuaagauuaaguugugcagcaaguggauuuagcuuaaguagcuaugcaauggauuggguaagacaagcaccaggaaaaggauuagaauggguagcaguaauaaguagugauggaacaaauaaauauuaugcagauaguguaaaaggaagauuuacaauaacgagagauaauaguaaaaauacauuauauuuacaaaugaauaguuuaagaguagaagauacagcauuauauuauugugcaaaagauaugggagaaagugaaaaagaagaaugggcaagcgauuauuaugauuuuggaagagauauaccaggacaagauccaagaggagaaguaggaaguuuugauauaugggggcaaggaacaaugguaacaguaaguagu

SEQ ID NO: 48089 - RNA, 432 nt, Artificial Sequence
  derived and/or modified sequence opt6 from anti-HIV_cap256-048-016775_VR-Chain
gaaguacaauuaguagaauuuggaggaggauuaguacaaccaggaagaagucuaagauuaaguugugcagcaagugcauuuacauuuagucauuauggaauacauuggguaagacaagcaccaggaaaaggauuagaauggguagcaguaauaagucaugauggaaguacaaaagauuaugcagauaguguaaaaggaagauuuacaauaaguagagauaauagcaaaaauacaauguauuuacaaaugaauaguuuaagagcagaagauacagcaguauauuauugugcaagagauuuaggagaaagugaaacagaagaaugggcaacagauuauuaugauuuuaguauagcauauccaguacaaaauccaagaggaguaauaggaguauuagauauauggggauuaggaacaaugguaacaguaaguagu

SEQ ID NO: 48090 - RNA, 432 nt, Artificial Sequence
  derived and/or modified sequence opt6 from anti-HIV_cap256-048-016069_VR-Chain
caaguacaauuaguagaaaguggaggaggaguaguacaaccaggaagaaguuuaagauuaaguugugcagcaaguggauuuacauuuaguaaauaugcaaugcauuggguaagacaagcaccaggaaaaggauuagaauggguagcauuuguagcauuugaugaaagugcaaaauuuuaugcagauagcguaaaaggaagauuuacaauaaguagagauaauaguaaaaauacauuaaguuuacaaaugaauaguuuaagagcagaagauacagcaguauauuauugugcaaaagaaguaggagaaaauaaagaugaugaaugggcaagugauuauuaugauuuaaguauagcauauccaguacaugauccaagagcaguaguaggaggauuugauguauggggacaaggaacaaugguaacaguaaguagu

SEQ ID NO: 48091 - RNA, 432 nt, Artificial Sequence
  derived and/or modified sequence opt6 from anti-HIV_cap256-048-015867_VR-Chain
caaguacaauuaguagaaagcggaggaggaguaguacaaccaggaagaaguuuaagauuaagcuguagcgcaucaggauuuucauucacaaauuaugcaauggauuggguaagacaagcaccaggaaaaggacuagaauggguagcaguaauaucaagugauggaucaaauaaaaauuaugcagauagcguaaaaggaagauuuacaauaagcagagacaauagcaaaaacacacuauuuuuacaaaugaauagcuuaagaccagaagauacagcaguauauuucugugcaaaagaccuaggagcaaauaaagacgaugaaugggcaacagacuauuacgauuuaucaauagcauauccaguacaugacccaagagcaguaguaggaauauucgauuuauggggacaaggaacaaugguaacaguaaguuca

SEQ ID NO: 48092 - RNA, 432 nt, Artificial Sequence
  derived and/or modified sequence opt6 from anti-HIV_cap256-048-015673_VR-Chain
caaguacacuuaguagaaagcggaggaggaguaguacaaccaggaagaaguuuaagauuaagcugugcagcaagcggauucacauucucgaacuuugcaaugggauggguaagacaagcaccaggaaaaggacuagaauggguagcauuuauaucaagcgauggaacaaacaaaaacuauggagauagcguaaaaggaagauuuacaauaaguagagacaauaguaaaaacacacuauuuuuacaaaugaauagcuuaagagcagaagauacagcacuauauuacugugcaaaagacuuaggaggauacaaaagcgaugaaugggcaacagacuauuacgaucuaucaauagcauacccaauacaagacccaagagcaguaguaggagcauucgauauauggggacaaggaacaaugguaacaguaaguuca

SEQ ID NO: 48093 - RNA, 432 nt, Artificial Sequence
  derived and/or modified sequence opt6 from anti-HIV_cap256-048-015156_VR-Chain
caaguacaauuaguagaaucaggaggaggaguaguacaaccaggaagaaguuuaagacuaaguugugcagcaaguggauuuacauuuagcguauaugcacuacauuggguaagacaaacaccaggaaaaggauuagaauggguagcauuaauaagcuaugauggaacaaauaaauauuauguagauaguguaaaaggaagauuuacaauaaguagagauaauaguaaaaauacauuauauuuacaaaugaauaguuuaacagcagaagauacagcaguauauuauugugcaaaagauuuaggaggaaguaaaaaugaugaaugggcaacagauuauuaugauuuaucaauagcauauccaauacaagauccaagagcaguagcaggaauauuugauguauggggaagaggaacaaugguaacaguaaguagu

SEQ ID NO: 48094 - RNA, 432 nt, Artificial Sequence
  derived and/or modified sequence opt6 from anti-HIV_cap256-048-014521_VR-Chain
gaaguacaauuaguagaaagcggaggaggauuaguacaaccaggaagaagucuaagauuaagcugugcagcaagcggauucauauucucaagcuauggaauacacuggguaagacaaggaccaggaaaaggacuagaauggguagcauuaauaucaggagauggaaauaacaaauacuaugcagauagcguacaaggaagauuuaguauaagcagagacaauagcaaaaacacacuauauuuacaaaugaauagcuuaagagcagaagauacagcaguauauuacugugcaaaagacuuaggagaaagcgauaaagaggaauggccaucagacuauuacgauuucggaagagauuucacaggacaagacccaagagcaguaguaggaguauucgauauauggggacaaggaacaacaguaauaguaagcuca

SEQ ID NO: 48095 - RNA, 432 nt, Artificial Sequence
  derived and/or modified sequence opt6 from anti-HIV_cap256-048-014475_VR-Chain
caaguacaauuaguagaaagcggaggaggaguagugcaaccaggaagaaguuuaagauuaagcugugcagcaaguggauucacauuuaauacauuuggaaugcacuggguaagacaagcaccaggaaaaggacucgaauggguagcaguaauaagucacgauggaaauaauaaauacuaugcagauagcuuaaaaggaagauuuacaauaaguagagaaaauaguaaaaacacacuauuucuacaaaugaauagcuuaagagcagaagauacaucaguauauuacugugcaaaagacuuaggacauggagaaugcgaagaaugggcaucagacuauuacgauuucggaaaagauuacccaugcuuaacaccaagaggagucgcaggaacauucgauauauggggacauggaacaacaguaacaguaagcuca

SEQ ID NO: 48096 - RNA, 432 nt, Artificial Sequence
  derived and/or modified sequence opt6 from anti-HIV_cap256-048-013798_VR-Chain
caaguacaauuaguagaaaguggaggaggaguaguacaaccaggaagaaguuuaagauuaaguugugcagcaaguggauuuacauuuaauaauuauggaacacauuggguaagacaagcaccaggaaaaggauuagaauggguagcaguaauaagugauucaggaucaaauaaauauuaugcagauagcguaaaaggaagauuuacaauaaguagagauaauaguaaaaauacacuauauuuacaaaugaauaguuuaagagcagaagauacagcaguauauuuuugugcaaaagauuuaggaggaagagaaacagaagaaugggcaucagauuauuaugauuuuggaagagauuuuccaggacaagaucaaagagcaguagcaggaguauuugauauguggggacaaggaacaaugguaacaguaaguagu

SEQ ID NO: 48097 - RNA, 432 nt, Artificial Sequence
  derived and/or modified sequence opt6 from anti-HIV_cap256-048-013271_VR-Chain
gaaguacaauuaguagaaagcggaggaggaguaguaagaccaggaggaagcuuaagauuaaguugugcagcaaguggauuuauauuuaguagcuauggaauacauuggguaagacaagcaccaggaaaaggauuagaauggguagcaguaauaaguggagauggaacaaauaaauauugugcagacagcguaaaaggaagauuuacaauaaguagagauaauaguaaaaauacauuauauuuacaaauaaauaguuuaagaguagaagauacagcaguauauuauugugcaaaagauuuaggaaaaaauaaagaugaugaaugggcgacagauuauuaugauuuaaguauagcauauccaguaccagauccaagagcaguaguaggaguauuugauauauggggacaaggaacaguaguaacaguaagcuca

SEQ ID NO: 48098 - RNA, 432 nt, Artificial Sequence
  derived and/or modified sequence opt6 from anti-HIV_cap256-048-013180_VR-Chain
caaguacaauuaguagaaaguggaggaggaguaguacaaccaggaagaaguuuaagauuaaguugugcagcaaguggauuuacauuuaguaaaaauggaaugcauuggguaagacaagcaccaggaaaaggauuagaauggguagcauuuguagcauuugauggaagugauaaauauuaugcagauaguguaaaaggaagauuuguaauaaguagagauaauagcaaaaauacauuaaguuuacaaaugaauaguuuaagagcagaagauacagcaguauauuauugugcaaaagaaguaggagaagauaaagaugaugaaugggcaagugauuauuaugauuuaagcauagcauauccaguacaugauccaagagcaguaguaggaggauuugauauauggggacaaggaacaaugguaacaguaaguagu

SEQ ID NO: 48099 - RNA, 432 nt, Artificial Sequence
  derived and/or modified sequence opt6 from anti-HIV_cap256-048-012148_VR-Chain
caaguacaauuaguagaaaguggaggaggaguaguacaaccaggaagaaguuuaagauuaaguugugcagcaaguggauuuacauuuacacauuaugcaauggauuggguaagacaagcaccaggaaaaggguuagaauggguagcaguaauaaguagcgauggcaguaguaaaaauuaugcagauaguguaagaggaagauuuacaauaaguagagauaauaguaaaaauacauuaaguuuauuaaugaauggauuaagaccagaagauacagcaguauauuauugugcaaaagauguaggagauguaaaaaaugaugaaugggcaacagauuauuaugauuuaaguauagcauauccaguacaagauccaagagcaguaguaggagcauuugauuuuuggggacaaggaacgaugguaacaguaagcgca

SEQ ID NO: 48100 - RNA, 432 nt, Artificial Sequence
  derived and/or modified sequence opt6 from anti-HIV_cap256-048-011870_VR-Chain
caaguacaauuaguagaaaguggaggaggaguaguacaaccaggaagaaguuuaagauuaaguugugcaguaaguggauuuacauuuaguuuuuauggaaugcauuggguaagacaagcaccaggaaaaggauuagaauggguagcaguaauaaguuaugauggaaauaauaaauauuauguagauaguguaaaaggaagauuuauaauaaguagggauaauaguaaaaauacauuauaucuacaaaugaauaguuuaagaguagaagauacagcaguauauuauugugcaagagauuugggagaaagagaaaaugaagaaugggcaacagauuauuaugauuuuaguauagcauauccaauagaaggaccaagaggaguagugggaguauuugauauauggggaaggggaacaaugguaacaguaaguuca

SEQ ID NO: 48101 - RNA, 432 nt, Artificial Sequence
  derived and/or modified sequence opt6 from anti-HIV_cap256-048-011530_VR-Chain
caaguacauuuaguagaaaguggaggaggaguaguacaaccaggaagaagucuaagauuaaguugugcagcaaguggauuuaguuuuaggaauuaugcaauggauuggguaagacaagcaccaggaaaaggauuagaauggguagcaguaauaucaagcgauggaagugauaaacauuaugcagauaguguaagaggaagauuuacaauaaguagagauaauaguaaaaauacauuauauuuacaaaugaauaguuuaagaguagaagauacagcaguauauuauugugcaaaagaucuaggagcaaauaaaaaugaugaaugggcaacagauuauuaugauuuuucaauagcauauccaguaccagauccaagagcaguaguaggagcauuugacauauggggacaaggaacaaugguaacaguaucauca

SEQ ID NO: 48102 - RNA, 432 nt, Artificial Sequence
  derived and/or modified sequence opt6 from anti-HIV_cap256-048-010968_VR-Chain
caaguacaauuaguagaaagcggaggaggaguaguacaaccaggaagaaguuuaagauuaaguugugcagcaagcggauucauauucucaaguuauggaaugcacuggguaagacaagcaccaggaaaaggacuagaauggguagcauuaauaucaggagauggaucaaauaaauacuaugcagauagcguaaaaggaagauuuacaauaagcagagacaauagcaaaaacacacuauaucuacaaaugaauaguuuaagagcagaagauagugcauuauauuucugugcaaaagacuuaggagaaagugauaaagaagaauggccaucagacuauuacgauuucggaagagauuuuacaggacaaguaccaagagcaguaguaggaauauucgauauguggggacaaggaacaaugguaacaguaagcuca

SEQ ID NO: 48103 - RNA, 426 nt, Artificial Sequence
  derived and/or modified sequence opt6 from anti-HIV_cap256-048-010224_VR-Chain
gaaguacauuuaguagaaaguggaggagauuuagugcaaccaggaggaaguuuaagauuaaguuguguagugagugaauuuacauuuaguaguuauggaaugcauuggguaaggcaagcaccaggaaaaggauuagaauggguagcauuuauaagauaugauggaaguaauaaauauuaugcagauaguguaaaaggaagauuuacaauaagcagagauaauaguaaaguauauuuagaaaugaauaguuuaagagcagaagauacagcaguauauuauugugcaaaagaaguaggagaaaauaaagaugaugaaugggcaagugauuauuaugauuuaaguauagcauauccaauacaugauccaagagcaguaguaggaggauuugauauauggggacaaggaacaaugguaacaguaaguagu

SEQ ID NO: 48104 - RNA, 432 nt, Artificial Sequence
  derived and/or modified sequence opt6 from anti-HIV_cap256-048-009749_VR-Chain
caaguacaauuaguagaaagcggaggaggaguaguacaaccaggaagaaguuuaagauuaagcuguggagcaagcggauucacauucucaaguuaugcaaugcacuggguaagacaagcaccaggaagaggacuagaauggguagcauuuacaucaagugauggaucgaacaaaaacuauggagauagcguaaaaggaagauuuacaauaaguagagacaauagcaaaaacacacuauuucuacaaaugaauagcuuaagagcagaagauacagcacuauauuacugugcaaaagacguaggagaauacaaaagcgaugaaugggcaacagacuauuacgaucuaucaauagcauacccaauacaagacccaagagcaaugguaggagcauucgauauauggggacaaggaacaaugguaacaguaagcuca

SEQ ID NO: 48105 - RNA, 432 nt, Artificial Sequence
  derived and/or modified sequence opt6 from anti-HIV_cap256-048-009623_VR-Chain
caaguacaauuaguagaaagcggaggaggaguaguacaaccaggaagaaguuuaagauuaaguugugcagcaaguggauuuaguuuuagcaaauacggaaugcauuggguaagacaagcaccaggaaaaggauuagaauggguagcauuuguagcauuugaugaaggagauaaauauuauguagacaguguaaaaggaagauuuacaauaaguagagauaauaguaaaaauacacuaucauuacaaaugaauaguuuaagagcagaagacacagcaguauauuauugugcaaaagaaguaggagaaaauaaagaugaugaaugggcaagugauuauuaugauuuaagcauagcauauccaauacaugauccaagggcaguaguaggaggauuugauauauggggacaaggaacaaugguaacaguaaguagu

SEQ ID NO: 48106 - RNA, 432 nt, Artificial Sequence
  derived and/or modified sequence opt6 from anti-HIV_cap256-048-008234_VR-Chain
caaguacaauuaguagaaaguggaggaggaguaguacaaccaggaagaaguuuaagauuaagcugugcagcaaguggauuuacauuuacaaauuaugcaauggacuggguaagacaagcaccaggaaaaggauuagaauggguagcaguaauaaguagcgauggaaguaauaaaaauuaugcagauaguguaaaaggaagauuuacaauaaguagagauaauaguaaaaauacaguauauuuacaaaugaguagcuuaagaccagaagauacagcaguauauuauugugcaaaagauguaggagauacaaaaagugaugaaugggcaacagauuauuaugauuuaaguauagcauauccaguacaagauccaagagcaguaguaggagcauuugauauauggggacaaggaacaaugguaacaguaaguagu

SEQ ID NO: 48107 - RNA, 432 nt, Artificial Sequence
  derived and/or modified sequence opt6 from anti-HIV_cap256-048-008149_VR-Chain
caaguacaauuaguagaaaguggaggaggaguaguacaaccaggaagaaguuuaagauuaaguugugcagcaucaggauuuacauuuaguguauauacaaugcauuggguaagacaagcaccaggaaaaggauuagaauggguagcaguaauaaguuaugauggaagaaauaaauauuaugcagauaguguaaaaggaagauuuacaauaaguagagauaauagcaaaaauacaguauauuuacaaaugaauaguuuaagaguagaagauacagcaguauauuauugugcaaaagauuuaggagcaaauaaagaugaugaaugggcaacagauuauuaugauuuaaguguagcauauccaguaccagauccaagagcaguaguaggagcauuugauguauggggacaaggaacaaugguaacaguaaguagu

SEQ ID NO: 48108 - RNA, 432 nt, Artificial Sequence
  derived and/or modified sequence opt6 from anti-HIV_cap256-048-007301_VR-Chain
caaguacaauuaguagaaaguggaggaggaguaguacaaccaggaagaaguuuaagauuaaguugugcagcaaguggauuuaguuucaauuauuaugcaauggauuggguaagacaagcaccaggaaaaggauuagaauggguagcagugauaaguagugauggaagaaauaaaaauuaugcagauagcguaaaaggaagauuuacaauaaguagagauaauaguaaaaauacauuauauuuacaaaugaauaguuuaaguguagaagauacagcaguauauuauugugcaaaagauuuagggaaaaauaaagaugaugaaugggcaacagauuauuaugauauaaguauagcguauccaguaccagauccaagagcaguaguaggaguauuugauauauggggacaaggaacaguaguaacaguaaguagc

SEQ ID NO: 48109 - RNA, 432 nt, Artificial Sequence
  derived and/or modified sequence opt6 from anti-HIV_cap256-048-007174_VR-Chain
caaguacaauuaguagaaaguggaggaggaguaguacaaccaggaagaaguuuaagacuaagcugugcagcaaguggauuuacauuuaauaguuauggaauggcauggguaagacaagcaccaggaaaaggauuagaauggguagcauuaauaaguuaugauggaaguaauaaauauuaugcagauagcguaagaggaagauuuacaauaaguagagauaauaguaaagauacauuauauuuacaaauggauggauuaagaccagaagauacagcauuauauuauugugcaaaagauuuaggagaaagugaaugugaagaaugggcaagugauuauuaugauuuuggaagagauuauccauguuuagcaccaagaggagugccaggaacauuugauauauggggacaaggaacaaugguaacaguaaguagu

SEQ ID NO: 48110 - RNA, 432 nt, Artificial Sequence
  derived and/or modified sequence opt6 from anti-HIV_cap256-048-007079_VR-Chain
caaguacaauuagcagaaagcggaggaggaguaguacaaccaggaagaaguuuaagauuaagcugugcagcaaguggauuuacauuuaguauauauggaaugcauuggguaagacaagcaccaggaaaaggauuagaauggguagcauuuauauuaagugauggaacagauaaauauagugcagauagcguaaaaggaagauuuacaauaaguagagauaauaguaaaaauacacuauauuuacaaaugaauaguuuaagagcagaagauacagcaguauauuauugugcaaaagauuuaggaaaagcaaaagaugaugaaugggcaacagauuauuaugauuuuaguauagcauauccaguacaugauccaagaggaguagcaggaauauuugauauauggggacaaggaacaaugguaacaguaaguagu

SEQ ID NO: 48111 - RNA, 432 nt, Artificial Sequence
  derived and/or modified sequence opt6 from anti-HIV_cap256-048-007033_VR-Chain
caaguacaauuaguagaaaguggaggaggaguaguacaaccaggaagaaguuuaagauuaaguugugcagcaaguggauuuacauuuaguaauuuuggauuucauuggguaagacaagcaccaggaaaaggauuagaauggguagcagcaauaaguuuugcaggaaauaauaaauauuaugcagauaguguaaaaggaagauuuacaauaaguagagaaaauaguaaaaauauauuauauuuacaaaugaauaguuuaagaggagaagauacagcaguauauuauugugcaaaagauuuaagagaauuugaaugugaagaaugggcaagugauuauuaugauuuuggaagagauuauccaugucaagauccaagaggaguaguaggaacauuugauguauggggacauggaaguuuaguaacaguaaguagu

SEQ ID NO: 48112 - RNA, 432 nt, Artificial Sequence
  derived and/or modified sequence opt6 from anti-HIV_cap256-048-006128_VR-Chain
caaguacaauuaguagaaagcggaggaggaguaguacaaccaggaagaucauuaagauuaagcugugcagcaagcggauuuacauuuagcacauaugcaaugcacuggguaagacaagcaccaggaaaaggacuagaauggguagcauuaauaucauaugauggaacagauaaauauuaugcagauaguguaaaaggaagauuuacaauaagcagagacaauaguaaaaauacauuauauuuacaaaugaauaguuuaagaguagaagauacagcaguauaucacugugcaaaagauuuaggaggaaguaaaagugaugaaugggcaacagacuauuaugauuggucaauagcauauccaguacaugacccaagagcaguagugggaguauuugauauauggggacaaggaacauuaguaacaguaagcuca

SEQ ID NO: 48113 - RNA, 432 nt, Artificial Sequence
  derived and/or modified sequence opt6 from anti-HIV_cap256-048-005999_VR-Chain
caaguacaauuaguagaaaguggaggaggaguaguacaaccaggaagaaguuuaagauuaaguugugcagcaaguggauuuacauuuacacauuuugcaauggauuggguaagacaagcaccaggaaaaggacuagaauggguagcaguaauuaguagugauggaucaaguaaaaauuaugcagauagcguaaaaggaagauuuacaauaaguagagauaauaguaaaaauacaguaaguuuacaaaugaauaguuuaagaccagaagauacagcaguauauuauugugcaaaagauuuaggagcaaauaaagaugaugaaugggcaacagauuauuaugauuuaaguauagcauauccaguaccagauccaagagcaguaguaggagcauuugauauauggggacaaggaacaaugguaacaguaaguagu

SEQ ID NO: 48114 - RNA, 432 nt, Artificial Sequence
  derived and/or modified sequence opt6 from anti-HIV_cap256-048-005394_VR-Chain
caaguacaauuaguagaaagcggaggaggaguaguacaaccaggaagaaguuuaagauuaagcugugcagcaagccaauucacauucucaaguuauggaaugcacuggguaagacaagcaccaggaaaaggauuagaauggguagcagcaauaucauucgcaggaacaaacaaauacuaugcagauagcgugaaaggaagauucacaauaaguagagacaauagcaaaaacgcacuauauuuacaaaugaauagcuuaagagcagaagauacagcacuauauuacugugcaaaagacuuaagagaauuugaaugcgaagaaugggcaucagacuauuacgauuucggaagagauuacccaugccaagacccaagaggaguaguaggaacauucgauauauggggacaaggaacaaugguaacaguaagcuca

SEQ ID NO: 48115 - RNA, 432 nt, Artificial Sequence
  derived and/or modified sequence opt6 from anti-HIV_cap256-048-004226_VR-Chain
caaguacaauuaguagaaaguggaggaggaguaguacaaccaggaagaaguuuaagauuaaguugugcagcaaguggauuuacauuuaauaaacauggaaugcauuggguaagacaagcaccaggaaaaggauuagaauggguagcauuuguagcauuugauggaagugauaaauauuaugcagauaguguaaaaggaagauuuacaauaaguagagauaauagcaaaaauacauuaagucuacaaaugaauaauuugagagcagaagauacagcaguauauuauugugcaaaagaaguaggagauaauaaagaugaugaaugggcaagugauuauuaugauuuaaguauagcauauccaguacaagauccaagagcaguaguaggaggauaugauauauggggacaaggaacaaugguaacaguaagcagu

SEQ ID NO: 48116 - RNA, 432 nt, Artificial Sequence
  derived and/or modified sequence opt6 from anti-HIV_cap256-048-004097_VR-Chain
caaguacaauuaguagaaaguggaggaggaguaguacaaccaggaagaaguuuaagauuaaguugugcagcaaguggauuuacauuuagugcauauacaguacauuggguaagacaagcaccaggaagaggauuagaauggguaaguguaauaucauaugaugauagaaauaaauauuaugcacauaguguaaaaggaagauuuacaauaaguagagauaauaguaaaaauacauuauauuuacaaaugaauaguuuaagaagagaagauacagcaguauauuauugugcaaaagauuuaggagcaaauaaagaugaugaaugggcaacagauuauuaugauuuaaguauagcauauccaguaccagauccaagagcaguaguaggagcauuugauauauggggacaaggaacaaugguaacaguaaguuca

SEQ ID NO: 48117 - RNA, 432 nt, Artificial Sequence
  derived and/or modified sequence opt6 from anti-HIV_cap256-048-003289_VR-Chain
caaguacaauuaguagaaaguggaggaggaguaguacaaccaggaagaagucuaagauuaaguugugcagcaaguggauuuacauuuaguaaauauggaaugcauuggguaagacaagcaccaggaaaaggauuagaauggguagcauuuguagcauuugauggaucaaguaaaaauuaugcagauaguguaaaaggaagauuuacaauaaguagagauaauaguaaaaauacaguaucauuacaaaugaauaguuuaagaccagaagauacagcaguauauuauugugcaaaagauuuaggagcaaauaaagaugaugaaugggcaacagauuauuaugauuuaucaauagcauauccaguaccagauccaagagcaguaguaggagcauuugauauauggggacaaggaacaaugguaacaguaaguagu

SEQ ID NO: 48118 - RNA, 432 nt, Artificial Sequence
  derived and/or modified sequence opt6 from anti-HIV_cap256-048-002601_VR-Chain
caaguacaauuaguagaaagcggaggaggaguaguacaaccaggaagaaguuuaagauuaagcugugcagcaagcggauuuucauucaauaauuaugcaauggacuggguaagacaagcaccaggaaaaggacuagaauggguagcaguaauaucaagugauggaagaaauaaaaauuaugcagaaagcguaaaaggaagauuuacaauaagcagagacaauagcaaaaacacaguauauuuacaaaugaauagcuuaagagcagaagauacagcaguauauuauugugcaaaagacguaggagauacaaaaaaagaugaaugggcaacagacuauuacgauuuaaguauagcauauccaguacaagacccacaagcaguaguaggagcauucgauauauggggacaaggaacaaugguaacaguaaguuca

SEQ ID NO: 48119 - RNA, 432 nt, Artificial Sequence
  derived and/or modified sequence opt6 from anti-HIV_cap256-048-002129_VR-Chain
caaguacaauuaguggaaaguggaggaggaguaguacaaccaggaagaaguuuaagauuaaguugugcagcaaguggauuuacauuuaguacauaugcaaugcauuggguaagacaagcaccaggaaaaggauuagaauggguagcauuaauaaguuaugauggaacagauaaauauuaugcagauaguguaaaaggaagauuuauaauaaguagagauaauaguagaaguacauuauauuuacaaaugaauaguuuaagauuagaagauacagcaguauaucauugugcaaaagauuuaggaggaaguaaaagcgaugaaugggcaacagauuauuaugauuuaaguguagcauauccaguacaagauccaagagcaguaguaggaguauuugauauauggggacaaggaacaaugguaacaguaaguagu

SEQ ID NO: 48120 - RNA, 432 nt, Artificial Sequence
  derived and/or modified sequence opt6 from anti-HIV_cap256-048-001875_VR-Chain
caaguacaauuaguagaaaguggaggaggaguaguacaaccaggaggaaguuuaagauuaaguugugcaacaagcggauuaacauuuaguaauuauggaaugcauuggguaagacaagcaccaggaagaggacuagaauggguagcauuuacaagauaugauggaacauauaauuauuaugcagauaguguaaaaggaagauuuacaauaaguagggauaauaguaaaggaacauuauaucuacaaauggauggauuaagaccagaagauacagcauuauauuauugugcaaaagauuuaggagaaagagaaugugaagaaugggcaagugauuauuaugauuuuggaagagauuuuccaugucaagauccaagaggaguaguaggaacauuugauauauggggacaaggaacaaugguaacaguaagcagu

SEQ ID NO: 48121 - RNA, 432 nt, Artificial Sequence
  derived and/or modified sequence opt6 from anti-HIV_cap256-048-001302_VR-Chain
caaguacaauuaguagaaaguggaggaggaguaguacaaccaggaagaaguuuaagauuaagcugugcagcaaguggauuuacauuuaguuauaguggaaugcauuggguaagacaagcaccaggaaaaggaauggaauggguagcaguaauaaguuaugauggaaguaauaaauauuaugcagauaguguaaaaggaagauuuacaauaaguagagauaauagcaaaaauacaguauauuuacaaaugaauagcuuaagaggaguagauacagcaguauauuauugugcaaaagauuuaggaggaggagaaguagaagaaugggcaacagauuauuaugauuggucaauagcauauccaguagaacauccaagagcaguaguaggaguauuugauauauggggacaaggaacaaaaguaacaguaaguagu

SEQ ID NO: 48122 - RNA, 432 nt, Artificial Sequence
  derived and/or modified sequence opt6 from anti-HIV_cap256-048-001203_VR-Chain
caaguacaauuaguagaaagcggaggaggaguaguacaaccaggaagaaguuuaagauuaaguugugcagcaaguggauuuacauucucaaguuaugcaaugcauuggguaagacaagcaccaggaaaaggacuagaauggguagcaauaauaucauaugauggaacaauaaaauauuaugcagauagcguaaaaggaagauuuacaauaaguagagacaauaguaaaaauacaguaucauuacaaaugaauaguuuaagaccagaagauacagcaguauauuacugugcaaaagauguaggagcaaauaaagaugaugaaugggcaacagacuauuaugauuuaucaauagcauauccaguaccggauccaagagcaguaguaggagcauuugauauauggggacaaggaacaaugguaacaguaaguuca

SEQ ID NO: 48123 - RNA, 432 nt, Artificial Sequence
  derived and/or modified sequence opt6 from anti-HIV_cap256-048-000383_VR-Chain
caaguacaauuaguagaaagcggaggaggaguaguacaaccaggaagaaguuuaagauuaaguuguacagcaucaggauuuacauuuaaucauuaugcaauggauuggguaagacaagcaccaggaaaaggauuagaauggguagcaguaauaaguagugauggaagugauaaaacauaugcagauaguguaaaaggaagauuuacaauaaguagagacaauaguaaaaauacaguauauuuacaaaugaauaguuuaagagcagaagauacagcaguauauuauugugcaaaagauguaggaggaaguaaagaugaugaaugggcaacagauuauuaugaucuaaguauagcauauccaguaccugauccaagagcaguaguaggagcauuugauuuuuggggaccaggaacaaugguaacaguaaguagu

SEQ ID NO: 48124 - RNA, 432 nt, Artificial Sequence
  derived and/or modified sequence opt6 from anti-HIV_cap256-038-261791_VR-Chain
caaguacaauuaguagaauuuggaggaggaguaguacaaccgggaggaaguuuaagauuaagcugugcagcauuuggauuuacaauaaguaguuauggaaugcauuggguaagacaagcaccaggaaaaggacuacaauggguagcauuuauaagauaugaugaaaguaguaaauuuuaugcagauaguguaaaaggaagauuuacaauaaguagagauaauagcgaaaauacauuauauuuacaaaugaauaguuuaagagcagaagauacagcaguauauuauugugcaaaagauuuaggagaaagugaaaaugaagaaugggcaacagauuauuaugauuuuaguauagcauauccaggacaagauccaagaggaguaguaggaauauuugauauauggggacaaggaacaaugguaacaguaaguagu

SEQ ID NO: 48125 - RNA, 432 nt, Artificial Sequence
  derived and/or modified sequence opt6 from anti-HIV_cap256-038-241540_VR-Chain
caaguacaauuaguagaaaguggaggaggaguaguacaaccaggaagaaguuuaagauuaaguugugcagcaaguggauuuacauuuaguaauucagcaaugcauuggguaagacaagcaccaggaaaaggauuagaauggguagcauuaauaaguuauguaggagggaauauauauuaugcagauaguguaaaaggaagauuuacaguaagcagagauaauaguaaaaaaacauuauauuuacaaaugaauaguuuaagaguagaagauacagcaguauauuauuguguaaaagauguaggagaaagugaaaaugaagaaugggcaagugauuauuaugauuuuggaagagauuauccaggacaagauacaagagcaguaguaggagcauuugauauaugggggcaaggaacaauggugacaguaaguuca

SEQ ID NO: 48126 - RNA, 432 nt, Artificial Sequence
  derived and/or modified sequence opt6 from anti-HIV_cap256-038-235677_VR-Chain
uuaguacaauuaguagaaaguggaggaggaguaguacaaccaggaggaaguuuaagauuaagcugugcagcaaguggauuuagauuuaguagcuauggaaugcauuggguaagacaagcaccaggaaaaggauuagaauggguggcauuuauaagauaugauggaaguuuuaaagauuaugcagauaguguaagaggaagauuuacaauaaguagagaaaauaguaaaaauacauuauauuuacaaaugaauaguuuaagaacagaugauacagcaguauauuauugugcaaaagauuuaggagaaagugaaacagaagaauggccaagugauuauuaugauuuuggaagagauuauccaggacaagauccaagaggaguaguaggaacauuugauauauggggacauggaacaaugguaacaguaaguuca

SEQ ID NO: 48127 - RNA, 435 nt, Artificial Sequence
  derived and/or modified sequence opt6 from anti-HIV_cap256-038-234314_VR-Chain
gaaguacaauuauuagaaaguggaggaggauuaguacaaccaggaggaaguuuaagauuaaguugugcagcaaguggauuuacauuuagcagguaugcaaugaguuggguaagacaagcaccaggaaaaggauuagaauggguagcaguaauaucauaugauggaucaaauaaauauuaugcagauaguguaaaaggaagauuuacaauaaguagagauaauagcaaaaauacauuauauuuacaaaugaauagucuaagagcaguagauacagcaguauauuauugugcaaaagauuuaggagaaggagaaaaugaagaaugggcaacagauuauuaugauuuuaguuauugguuaccauguccaaaauaucauggagcaugguuagaauuauuauauauauggggacaaggaacaaugguaacaguaaguagu

SEQ ID NO: 48128 - RNA, 432 nt, Artificial Sequence
  derived and/or modified sequence opt6 from anti-HIV_cap256-038-234273_VR-Chain
gaaguacaauuaguagaaaguggaggaggacuaauacaaccaggaggaaguuuaagauuaagcugugcagcaaguggauucacaguuucaacaaauuucaugaguuggguaagacaagcaccaggaaaaggacuagaauggguagcaguaauaucauacgauggaaauaacaaauacuaugcagauagcguaaaaggaagauuuacaauaagcagagaaaauagcaaaaacacacuauaucuacaaaugaauagcuuaagaacagacgauacagcaguauauuacugugcaaaagacuuaggagaaagcgaaacagaagaauggccaucagacuauuacgauuucggaagagauuacccaggacaagacccaagaggaguaguaggaacauucgauauauggggacauggaacaaugguaacaguaagcuca

SEQ ID NO: 48129 - RNA, 432 nt, Artificial Sequence
  derived and/or modified sequence opt6 from anti-HIV_cap256-038-223164_VR-Chain
gaaguacaauuaguagaaaguggaggaggauuaguaagaccaggaggaaguuuaagauugagcugugcagcaaguggauuuucauuaggaagcuauuggaugacauggguaagacaagcaccaggaaaaggacuagaauggguagcaguaauaaguuaugauggaaguaauaaauauuaugcagauaguguaaaaggaagauuuacaauaagcagagauaauaguaaaaauacauuauauuuacaaaugaauaguuuaagagcagaagauacagcauuauauuauugugcaaaagauuuaggagaaagugaaaaugaagaaugggcaucagauuauuaugauuuuggaagagauuauccaggacaagacccaagaggaguaguaggaacauuugauauauggggacaaggaacaaugguaacaguaaguagu

SEQ ID NO: 48130 - RNA, 432 nt, Artificial Sequence
  derived and/or modified sequence opt6 from anti-HIV_cap256-038-220289_VR-Chain
gaaguacaauuaguagaaagcggaggaggauuaguacaaccaggaggaagccuaagacuaagcuguacagcaaguggauucacauucucaagcuaugaaaugaacuggguaagacaagcaccaggaaaaggaccagaauggguggcaguaauaaguuacgauggaaauaacaaauacuaugcagauagcguaaaaggaagauuuacaauaagcagagaaaauagcaaaaacacacuauaucuacaaaugaauaguuuaagaacagacgauacagcaguauauuacugugcaaaagacuuaggagaaagcgaaacagaagaauggccaucagacuauuacgauuucggaagagauuacccaggacaagacccaagaggaguaguaggaacauucgauauauggggacauggaacaaugguaacaguaagcuca

SEQ ID NO: 48131 - RNA, 432 nt, Artificial Sequence
  derived and/or modified sequence opt6 from anti-HIV_cap256-038-220020_VR-Chain
caaguacaauuaguagaaagcggaggaggaguaguacaaccaggaagaaguuuaagauuaaguugugcagcaaguggauuuacauuuaguagaaaugcaaugcauuggguaagacaagcaccaggaaaaggauuagaauggguagcauuaauaucauaugauggaaguaauaaauauuauguagauaguguaaaaggaagauuuacaauaaguagagauaauaguaaaaauacacuauauuuacaaaugaauaguuuaagagcagaugauacagcaguauauuauugugcaaaagauuuaggagaaagugaaacagaagaauggggaacagauuauuaugauuuuaguacaggauauccaguacaagauccaagaggaguaguaggagcauuugauauauggggacaaggaacaaugguaaguguaaguagu

SEQ ID NO: 48132 - RNA, 432 nt, Artificial Sequence
  derived and/or modified sequence opt6 from anti-HIV_cap256-038-216853_VR-Chain
caaguacaauuaguagaaaguggaggaggaguaguacaaccaggaagaaguuuaagauuaagcugugcagcaagcggguuuacauuuucaaguuaugcaaugcauuggguaagacaagcaccaggaaaaggauuagaauggguagcaguaauaaguuaugauggaaguaauaaauauuaugcagauaguguaaaaggaagauuuacaauaaguagagauaauaguaaaaauacauuauauguacaaaugaauaguuuaagagcagaagauacagcaguauauuauugugcaagagaucuaggagaaagugaaacagaagaauggccaagugauuauuaugauuuuggaagagauuauccaggacaagauccaagaggaguaguaggaacauuugauauauggggacauggaacaaugguaacaguaaguagu

SEQ ID NO: 48133 - RNA, 432 nt, Artificial Sequence
  derived and/or modified sequence opt6 from anti-HIV_cap256-038-213466_VR-Chain
gaaguacaauuaguagaaaguggaggaggauuaguacaaccaggaagaaguuuaagaguaaguugugcagcaaguggauuuacauuugaagauuaugcaaugcauuggguaagacaagcaccaggaaaaggauuagaauggguagcaguaauaagugaugauggaaauaauaaauauuaugcagauaguguaaaaggaagauuuacaauaagcagagauaauaguaaaaauacauuauaucuacaaaugaauaguuuaagaguagaagauacagcaguauauuauuguguaaaagauguaggagaaagugaaaaugaagaaugggcaagugauuauuaugauuuuggaagagauuauccaggacaagauacaagagcaguaguaggagcauuugauauauggggacaaggaacaaugguaacaguaaguagu

SEQ ID NO: 48134 - RNA, 432 nt, Artificial Sequence
  derived and/or modified sequence opt6 from anti-HIV_cap256-038-213212_VR-Chain
caaguacaauuaguagaaaguggaggaggaguaguacaaccaggaggaaguuuaagauuaaguugugcagcaaguggauuuauauuuagugauuauggaaugcauuggguaagacaagcaccaggaaaaggauuagaauggguagcaaguauauggcaugauggaucaaaaaaauauuaugcagauaguguaaaaggaagauuuacaauaaguagagaaaauaguaaaaauacauuauauuuacaaaugaauaguuuaagagcagaagauacagcuguauaucauugugcaaaagauuuaggagaaagugaaauagaagaauggacaucagacuauuaugauuuuggaagagauuauccaggacaagacccaagaggaguauuuggaacauuugauauauggggacauggaacaaugguaacaguaaguuca

SEQ ID NO: 48135 - RNA, 432 nt, Artificial Sequence
  derived and/or modified sequence opt6 from anti-HIV_cap256-038-213120_VR-Chain
caaguacacuuaguagaaagcggaggaggauuaguaaaaccaggaggaagccuaagauuaagcugugcagcaaguggauucacauucucagacuauuacaugauauggauaagacaagcaccaggaaaaggacuagaauggguagcaguaauaucaagcgauggaucaaacaaaaacuaugcagauaguguaaaaggaagauuuacaauaaguagagacaauagcaaaaacacacuauaucuacaaaugaauaguuuaagagcagaagauacagcaguauauuacugugcaaaagacuuaggagaaagcgaaaacgaagaaugggcaacagacuauuacgauuucgcaacaggauacccgguacaagacccaagagcaguaguaggagcauucgauauauggggacaaggaacaaugguaacaguaagccca

SEQ ID NO: 48136 - RNA, 432 nt, Artificial Sequence
  derived and/or modified sequence opt6 from anti-HIV_cap256-038-212592_VR-Chain
uuaguacaauuaguagaaaguggaggaggaguaguacaaccaggaaaaaguuuaagauuaagcugugcagcaagcggauuuacauuuaguaguuaugcaaugcacuggauaagacaagcaccaggaaaaggacuagaauggguagcaguaauaagugaugauggaaguauaaaaaauuaugcagauaguguaaaaggaagauuuacaauaagcagagacacaaguaaaaaauuaauguaucuacaaaugaauaguuuaagugcaaaugauacagcaguauauuauugugcaaaagauuuaggagaaagagaaaaugaagaaugggcaagugacuauuaugauuucggaagagauuauccaggacaagacccaagaggaguaguaggaaguauagauacauggggacauggaacaaugguaacaguaaguuca

SEQ ID NO: 48137 - RNA, 432 nt, Artificial Sequence
  derived and/or modified sequence opt6 from anti-HIV_cap256-038-211790_VR-Chain
gaauuacaauuaguagaaagcggaggaggauuagugcaaccaggaggaaguuuaagacuaagcuguguaguaagcggauuuacaguaucaacaaauuauauaagcuggguaagacaagcaccaggaaaaggacuagaauggguagcaguaauaaguuaugauggaagcaauaaauauuaugcagauagcguaaaaggaagauuuacaauaaguagagacaauaguaaaaauacauuauauuuacaaaugaauagucuaagagcagaagauacagcauuauauuauugugcaaaagauuuaggagaaagugaaaaugaagaaugggcaagugacuauuaugauuucggaagagauuauccaggacaagacccgagaggaguaguaggaacauuugauauauggggacaaggaacaaugguaacaguaaguuca

SEQ ID NO: 48138 - RNA, 432 nt, Artificial Sequence
  derived and/or modified sequence opt6 from anti-HIV_cap256-038-209916_VR-Chain
caaguacaauuaguagaaagcggaggaggaguaguacaaccaggaggaaguuuaagauuaagcugugcagcaaguggauuuacauuuaguaguuuuggaaugcauuggguaaggcaagcaccaggaaaaggauuagaaugggugagcuuuauaagaaaugauggaggaauaagguauagugcagauaguguaagaggaagauuuacaauaaguagagauaauaguaaaaauacauuauauuuacaaaugaauaguuuaagaacagaugauacagcaguauauuauugugcaaaagauuuaggagaaagugaaacagaagaauggccaagugauuauuaugauuuuggaagagauuauccaggacaagauccaagaggaguaguaggaacauuugauauauggggacauggaacaaugguaacaguaaguagu

SEQ ID NO: 48139 - RNA, 432 nt, Artificial Sequence
  derived and/or modified sequence opt6 from anti-HIV_cap256-038-207938_VR-Chain
caaguacaauuaguagaaaguggaggaggaguaguacauccaggaagaaguuuaagauuaaguugugcagcaaguggauuuacauuuaguaguuauggaaugcauuggguaagacaagcaccaggaaaaggauuagaauggguagcaguaauaagucaugauggaaguaauaaauauuaugcagauaguguaaaaggaagauuuacaauaaguagagauaauaguaaaaauacauuauauuuacaaaugaauaguuuaagagcagaagauacagcaguauauuauugugcaaaagauuuaggagaaagugaaaaugaagaaugggcaagugauuauuaugauuuuggaagagauuauccaggacaagauccaagaggaguaguaggaguauuugauauauggggacaaggaacaaugguaacaguaaguagu

SEQ ID NO: 48140 - RNA, 432 nt, Artificial Sequence
  derived and/or modified sequence opt6 from anti-HIV_cap256-038-202245_VR-Chain
caaguacacuuaguagaaagcggaggaggaguaguacaaccaggaagaaguuuaagauuaagcuguacaguaagcggauucacauucggaagcuaugcauuacacuggguaagacaagcaccaggaaaaggauuagaaugguuaaguguaauaaguuacgauggaaauaacaaauacuaugcagauaguguaaaaggaagauuuacaauaagcagagaaaauaguaaaaacacauuauaucuacaaaugaauaguuuaagagcagaagauacagcaguauaucacugugcaaaagacuuaggagaaagcgaaaaagaagaaugggcaucagacuauuacgauuucggaagagauuacccaggacaagacccaagaggaguaguaggaacauucgauauauggggacauggaacaaugguaacaguaagcuca

SEQ ID NO: 48141 - RNA, 432 nt, Artificial Sequence
  derived and/or modified sequence opt6 from anti-HIV_cap256-038-197721_VR-Chain
caaguacaauuaguagaaaguggaggaggaguaguacaaccaggaaaaaguuuaagauuaagcugugcaggaaguggauuuauauuuaguaauuauccaaugcauuggguaagacaagcaccaggaaaaggauuagaauggauggcagauguaaguuaugauggaaguaauaaagauuaugcagauaguguaaaaggaagauuuacaauaaguagagauaauaguaaaaauacauuauauuuacaaaugaauaguuuaagagcagaagauacagcaguauauuauuguguaaaagauguaggagaaagcgaaaaugaagaaugggcaucggauuauuaugauuuuggaagagauuauccaggacaagauacaagagcaguaguaggagcauuugauauauggggacaaggaacaaugguaacaguaaguagu

SEQ ID NO: 48142 - RNA, 432 nt, Artificial Sequence
  derived and/or modified sequence opt6 from anti-HIV_cap256-038-196679_VR-Chain
gaaguacaauuauuagaaaguggaggaggauuaguacaaccaggaggaaguuuaagauuaaguugugcagcaaguggauuuacauuuaguaguuaugcaaugaguuggguaagacaagcaccaggaaaaggauuagaauggguagcaguaauaaguuaugauggaggaaauaaauauuaugcagauaguguaaaaggaagauuuacaauaaguagagauaauaguaaaaauacauuauauuuacaaaugaauagucuaagagcagaagauacagcauuauauuauugugcaaaagauuuaggagaaagugaaaaugaagaaugggcaagugauuauuaugauuuuggaagagauuauccaggacaagauaguagaggaguaguaggaacauuugauguauggggacaaggaacaaugguaacaguaaguagu

SEQ ID NO: 48143 - RNA, 438 nt, Artificial Sequence
  derived and/or modified sequence opt6 from anti-HIV_cap256-038-196118_VR-Chain
caaguacaauuaguagaaagcggaggaggaguaguacaaccaggaggaaguuuaagauuaaguugugcagcaaguggauuuacauuuaguacauauggaaugcauuggguaagacaagcaccaggaaaaggauuagaauggguaacauuuauaagaaaugauggaacaaauaaauauuaugcagauaguguaaaaggaagauuuacaauaaguagggauaauacaaaaaauacauuauauuuacaaauguauaguuuaagagcagaagauacagcaguauauuauugugcaaaagauuuaggagaaagugaaaaugaagaugaagaaugggcaagugauuauuaugauuucggaagagauuauccaggacaagacaguagaggaguaguaggaacauuugauauguggggacaaggaacaaugguaacaguaaguagu

SEQ ID NO: 48144 - RNA, 429 nt, Artificial Sequence
  derived and/or modified sequence opt6 from anti-HIV_cap256-038-195382_VR-Chain
caaguacauuuaguagaaaguggaggaggaguaguacaaccaggaagaaguuuaagauuaaguugugcagcaaguggauuuacauuuagcaauuauccaguacauuggguaagacaagcaccaggaaaaggauuagaauggguagcaguaauaaguuuugauggaauaaauaauuaugcaggaaguguaaaaggaagauuuauaauaagcagggauaauagcaaaaauacauuauauuuacaaaugaauaguuuaagagcagaagauacagcaguauauuauuguguaaaagauuuaggagaaucagaaaaagaagaauggccaagcgauuauuaugauuuuggaagagauuauccaggacaagauaguagaggaguaguaggaguauuugauauauggggacaagggacaaugguaacaguaucaagu

SEQ ID NO: 48145 - RNA, 432 nt, Artificial Sequence
  derived and/or modified sequence opt6 from anti-HIV_cap256-038-180001_VR-Chain
gaaguacaauuaguagaaagcggaggaggauuaguacaaccaggaagaaguuuaagauuaagcuguacagcaagcggauuuacauuuggagauuaugcaaugaguugguuuagacaagcaccaggaaaaggauuagaauggguagcagauauaaguuaugauggaaguaauaaauauuaugcagauaguguaaaaggaagauugacaauaagcagagauaauaguaaaaauacauuauauuuacaaaugaauaguuuaagagcagaagauacagcgguauauuauuguguaaaagauuuaggagaaagugaaaaagaagaauggccaagugauuauuaugauuuuggaagagauuauccaggacaagauaguagaggaguaguaggaguauuugauauauggggacaaggaacaaugguaacaguaaguagu

SEQ ID NO: 48146 - RNA, 432 nt, Artificial Sequence
  derived and/or modified sequence opt6 from anti-HIV_cap256-038-178021_VR-Chain
caaguaaaauuaguagaaaguggaggaggaguaguacaaccaggaggaaguuuaagauuaagcugugcagcagcaggauuuauauuuucaaauaguggaaugcauuggguaagacaagcaccagauaaaggauuagaauggguagcauuuguaccauaugauggaaguaauaaauauuaugcagauaguguaaaaggaagauuuacaauaaguagagauaauaguaaaaauacauuaaguuuacaaaugaauaguuuaagaacagaagauacagcaguauauuauugugcaaaagauuuaggagaaagcgaaacagaagaauggccaagugauuauuaugauuuuggaagagauuauccaggacaagauccaagaggaguaguaggaacauuugauauauggggacacggaacaaugguaacaguaaguagu

SEQ ID NO: 48147 - RNA, 432 nt, Artificial Sequence
  derived and/or modified sequence opt6 from anti-HIV_cap256-038-177104_VR-Chain
gaaguacaauuauuagaaagcggaggaggauuaguacaaccaggaggaaguuuaagauuaaguugugcagcaaguggauuuacauuuaguaguuaugcaaugaauuggguaagacaagcaccaggaaaaggauuagaauggguagcaguaauaaguuaugauggaggagauaaauauuaugcagauaguguaaaaggaagauuuacaauaaguagagauaauaguaaaaauacauuauauuuacaaaugaauaguuuaagaguagaagauacagcaguauauuauuguguaaaagauguaggagaaagugaaaaugaagaaugggcgagugauuauuaugauuuuggaagagauuauccaggacaagauacaagagcaguaguaggagcauuugauauauggggacaaggaacaaugguaacaguaaguagu

SEQ ID NO: 48148 - RNA, 432 nt, Artificial Sequence
  derived and/or modified sequence opt6 from anti-HIV_cap256-038-171261_VR-Chain
caaguacaauuaguagaaaguggaggaggaguaguacaaccaggaagaaguuuaagauuaaguugugcagcaaguggauuuacauuuaguaguuaugcaauguauuggguaagacaagcaccaggaaaaggacuagaauggguagcaguaauaucaagugauggaagugauaaaaauuaugcagauaguguaaaaggaagauuuacaauaaguagagauaauagcaauaauacacuauauuuacaaaugaauaguuuaagagcagaagauacagcaguauauuauugugcaagagauuuaggagaaagugaaaaugaagaauggccaagugauuauuaugauuuuggaagagauuauccaggacaagauccaagaggaguaauaggaacguuugauguauggggacaaggaacaaugguaacaguaaguagu

SEQ ID NO: 48149 - RNA, 432 nt, Artificial Sequence
  derived and/or modified sequence opt6 from anti-HIV_cap256-038-169090_VR-Chain
caaguacaauuaguagaaagcggaggaggaguaguacaaccaggaagaaguuuaagauuaagcugugcagcaagcagauuuacauuuaaaacauauacaaugcauuggguaagacaagcaccaggaaaaggauuagaauggguagcauuaauaaguuaugauggaaguaauaaauauuaugcagauaguguaaaaggaagauuaacaauaaguagagacaauaguaaaaauacauuauaucuacaaaugaauagucuaagagcagaagauacggcaguauauuauuguguaaaagauuuaggagaaagugaaaaagaagaauggccaagugauuauuaugauuuuggaagagauuauccaggacaagacaguagaggaguaguaggaguauuugauauauggggacaaggaacaaugguaacaguaaguagu

SEQ ID NO: 48150 - RNA, 432 nt, Artificial Sequence
  derived and/or modified sequence opt6 from anti-HIV_cap256-038-168705_VR-Chain
gaaguacaauuaguagaaaguggaggaggauuaguaaaaccgggaggaaguuuaagauuaagcugugcagcaagcggauuuacauucaguaguuauaguaugaacuggguaagaagagcaccaggaaaaggacuagaauggguagcauuaauaaguuaugaugaaaauaaaaaauauuaugcggauagcguaaaaggaagauuuacaauaagcagagaaaauaguaaaaauacacuauauuuacaaaugaauaguuuaagagcggaagauacagcaguauauuacugugcaaaagacuuaggagaaagagaaaaugaagaaugggcaucagacuauuaugauuucggaagagauuauccaggacaagacccaagaggaguaguaggaaguauagauacauggggacauggaacaaugguaacaguaaguagu

SEQ ID NO: 48151 - RNA, 432 nt, Artificial Sequence
  derived and/or modified sequence opt6 from anti-HIV_cap256-038-167685_VR-Chain
caaguacaauuaguagaaaguggaggaggaguaguacaaccaggaagaaguuuaagauuaagcugugcagcaaguggaauaacauucucaaguuaugcaauacacuggguaagacaagcaccaggaaaaggacuagaauggguagcaguaauaucauaugauggaucaaauaaauauuaugcagauaguguaaaaggaagauuuacaauaaguagagacaauaguaaaaacacacuauauuuacaaaugaauaguuuaagagcagaagauacagcaguauauuacugugcaaaagacuuaggagaaagugaaaaugaagaaugggcaacagacuauuaugauuucucaauaggauauccaggacaagacccaagaggaguaguaggagcauuugauauauggggacaaggaacaaugguaacaguaaguuua

SEQ ID NO: 48152 - RNA, 432 nt, Artificial Sequence
  derived and/or modified sequence opt6 from anti-HIV_cap256-038-158775_VR-Chain
caaguacaauuaguagaaaguggaggaggaguaguacaaccaggaggaaguuuaagauuaaguugugcagcaaguggauuuacauuuaguacauauggaaugcauuggguaagacaagcaccaggaaaaggauuagaauggguagcauuuauaagagauaauggaaguaauaaauauuaugcagauaguguaaaaggaagauuuacaauaagcagagauaauaguaaaaauacauuauauuuacaaaugaauaguuuaagagcagaagauacagcauuauauuauugugcaaaagauuuaggagaaagugaaaaugaagaaugggcaagugauuauuaugauuuuggaagagauuauccaggacaagauaguagaggaguaguaggaacauuugauguauggggacaaggaacaaugguaacaguaaguagu

SEQ ID NO: 48153 - RNA, 432 nt, Artificial Sequence
  derived and/or modified sequence opt6 from anti-HIV_cap256-038-157318_VR-Chain
cauguacaauuaguagaaaguggaggaggaguaguacaaccaggaagaaguuuaagauuaaguugugcagcaaguggaauaacauuuaguacauaugauaugcauuggguaagacaagcaccaggaaaaggauuagaauggguagcaguaauaaguaaugauggaaguaauaaauauuaugcagauaguguaaaaggaagauuuacaauaaguagagauaauaguaaaaauacauuauaucuacaaaugaauagcuuaagagcagaagauacagcauuauauuauugugcaaaagauuuaggagaaagugaaaaagaagaaugggcaagugauuauuaugauuuuggaagagauuauccaggacaagauccaagaggaguaguagcaacauuugauauauggggacaaggaacaaugguaacaguaaguagu

SEQ ID NO: 48154 - RNA, 432 nt, Artificial Sequence
  derived and/or modified sequence opt6 from anti-HIV_cap256-038-153058_VR-Chain
caaguacaauuaguagaaagcggaggaggaguaguacaaccaggaagaaguuuaagauuaagcugugcagcaaguggauuuacauuuaguacauaugcaaugcauuggguaagacaagcaccaggaaaaggauuagaauggguagcaguaauaucauaugauggaagucauucauauuaugcaggaaguguaaaaggaagauuuacaacaaguagagauaauaguaaaaauacauuaaauuuacaaaugaauaguuuaagaccagaagauacagcacuauauuauugugcaaaagauuuaggagaaagugaaaaugaagaaugggcaagugauuauuaugauuucggaagagauuauccaggacaagauaguagaggaguaguaggaacauuugauguauggggacaaggaacaaugguaacaguaaguagc

SEQ ID NO: 48155 - RNA, 432 nt, Artificial Sequence
  derived and/or modified sequence opt6 from anti-HIV_cap256-038-150027_VR-Chain
uuaguacaauuaguagaaaguggaggaggaguaguacaaccaggaggaaguuuaagauuaaguugugcagcaaguggauuuagguuuaguaguuauggaaugcauuggguaagacaagcaccaggaaaaggauuagaauggguagcauuuauaagguaugauggaaguuuuaaagauuaugcagauaguguaagaggaagauuuacaauaaguagagauaauaguaaaaauacaguauauguacaaaugaauaguuuaagagcagaagauacagcaguauauuauugugcaaaagauuuaggagaaagugaaaaugaagaaugggcaacagauuauuaugauuuugcaacaggauauccaguacaagauccaagagcaguaguaggagcauuugauauauggggacaaggaacaaugguaacaguaagucca

SEQ ID NO: 48156 - RNA, 432 nt, Artificial Sequence
  derived and/or modified sequence opt6 from anti-HIV_cap256-038-146372_VR-Chain
caaguacaauuaguagaaagcggaggaggaguaguacaaccaggaagaaguuuaagacuaaguugugcagcaagcggauuuacauucaguaguuuuggaaugcacuggguaagacaaucaccaggaaaaggauuagaauggguagcaguaauaucauaugauggaaauaacaaauacuaugcagauagcguaaaaggaagauuuacaauaagcagagaaaauagcaaaaacacacuauauuuacaaaugaauagcuuaagaacagacgauacagcaguauauuauugugcaaaagacuuaggagaaagugaaacagaagaaugggcaacagacuauuacgauuucgcaacaggauauccaguacaagacccaagagcaguaguaggagcauucgauauauggggacaaggaacaaugguaacaguaagccca

SEQ ID NO: 48157 - RNA, 432 nt, Artificial Sequence
  derived and/or modified sequence opt6 from anti-HIV_cap256-038-141868_VR-Chain
gaauuaagauuaguagaaagcggaggaaaucuaguacaaccaggaggaaguuuaacauuaaguuguguagcaagcggauucacauucgauagcuauggaaugagcuggguaagacaagcaccaggaaaaggacuagaauggguagcauuaauaaguuacgaugaaaauaaaaaauacuaugcagauaguguaaaaggaagauuuacaauaaguagagaaaauagcaaaaacacacuauaucuacaaaugaauagcuuaagagcagaagauacagcaguauauuacugugcaaaagacuuaggagaaagagaaaaugaagaaugggcaagugacuauuacgauuucggaagagauuauccaggacaagacccaagaggaguaguaggaaguauagauacauggggacauggaacaaugguaacaguaagcagu

SEQ ID NO: 48158 - RNA, 432 nt, Artificial Sequence
  derived and/or modified sequence opt6 from anti-HIV_cap256-038-141616_VR-Chain
gaaguacaauuauuagaaaguggaggaggauuaguacaaccaggaggaaguuuaagauuaaguugugcagcaaguggauuuacauuuaguaguuaugcaaugagcuggguaagacaagcgccaggaaaaggauuagaauggguagcaguaauaaguaaagauggaagugauaauaguuauguagauaguguaaaaggaagauuuacaauaagcagagauaauagcaaaaauacauuauauuuacaaaugaauaguuuaagagcagaagauacagcaguauauuauugugcaagagauuuaggagaaagugaaaaugaagaauggccaagugauuauuaugauuuuggaagagauuauccaggacaagauccaagaggaguaauaggaacauuugauguauggggacaaggaacaaugguaacaguaaguagu

SEQ ID NO: 48159 - RNA, 432 nt, Artificial Sequence
  derived and/or modified sequence opt6 from anti-HIV_cap256-038-127989_VR-Chain
caagcacaauuaguagaaaguggaggaggaguaguacaaccaggaagaaguuuaagauuaaguugugcagcaaguggauuuacauuuaguaauuuugcaaugcauuggguaagacaagcaccaggaaaaggacuagaauggguagcaguaaugagugaugauggaaguaauaaauauuaugcagauaguguaaaaggaagauuuacaauaaguagagauaauagcgaaaauacauuauauuuacaaaugaauagcuuaagagcagaagauacggcaguauauuauugugcaaaagauuuaggagaaagugaaacagaagaaugggcaacagauuauuaugauuuuggaacaggauauccaggacaagauccaagagcaaugauaggaacauuugauauauggggaagaggaacaaugguaacaguaaguagu

SEQ ID NO: 48160 - RNA, 432 nt, Artificial Sequence
  derived and/or modified sequence opt6 from anti-HIV_cap256-038-118109_VR-Chain
caaguacaauuaguagaaaguggaggaggaguaguacaaccaggaggaaguuuaagauuaagcuguacagcaaguggauuuacauuuagugcauaugauaugcauuggauaagacaagcaccaggaaaaggacuaggauggguagcauuuauaacaaaugaaggaaguaguaaaaauuauguagauaguguaaaaggaagauuuacaauaaguagagauaauaguaaaaauacauuauauuuacaaaugaauaguuuaagagcagaagauacagcaguauauuauugugcaaaagauuuaggagaaagcgaaaaugaagaaugggcaacagauuauuaugauuuuaguauagcauauccaggacaagauccaagaggaguaguaggaauauuugauauauggggacaaggaacaaugguaacaguaaguagu

SEQ ID NO: 48161 - RNA, 432 nt, Artificial Sequence
  derived and/or modified sequence opt6 from anti-HIV_cap256-038-112226_VR-Chain
gaaguacaauuaguagaaaguggaggaggauuaguacaaccaggaggaagccuaagauuaaguugugcagcaaguggauuuacauuuaguaguuauuggaugacauggguaagacaagcaccaggaaaaggauuagaauggguagcaguaauaagugaugauggaaauaauaaauauuaugcagauaguguaaaaggaagauuuacaauaagcagagauaauaguaaaaauacauuauauuuacaaaugaauaguuuaaggguagaagauacagcaguauauuauuguguaaaagauguaggagaaagugaaaaugaagaaugggcaagugauuauuaugauuuuggaagagauuauccaggacaagauacaagagcaguaguaggagcauuugauauauggggacaaggaacaaugguaacaguaagcagu

SEQ ID NO: 48162 - RNA, 432 nt, Artificial Sequence
  derived and/or modified sequence opt6 from anti-HIV_cap256-038-105918_VR-Chain
gaaguacaauuacuagaaagcggaggaggauuaguacaaccaggaggaagccuaagauuaagcugugcagcaagcggauucacauucaauauacauccaaugcacuggguaagacaagcaccaggaaaaggacuagaauggguagcaguaauaucauacgauggaaauaacaaauacuaugcagauagcguaaaaggaagauuuacaauaagcagagaaaauaguaaaaacacacuauaucuacaaaugaauagcuuaagaacagacgauacagcaguauauuacugugcaaaagacuuaggagaaagcgaaacagaagaauggccaucagacuauuacgauuuuggaagagauuacccaggacaagacccaagaggaguaguaggaacauucgauauauggggacauggaacaaugguaacaguaagcuca

SEQ ID NO: 48163 - RNA, 432 nt, Artificial Sequence
  derived and/or modified sequence opt6 from anti-HIV_cap256-038-104487_VR-Chain
uuagugcaauuaguagaaaguggaggaggaguaguacaaccaggaaaaaguuuaagauuaaguugugcagcaagcggauucacauuuaguaguuaugcaaugcauuggauaagacaagcaccaggaaaaggauuagaauggguagcaguaauaagugaugauggaaguauaaaaaauuaugcagauaguguaaaaggaagauuuacaauaaguagagauaauaguaaaaauacauuauaucuacaaaugaauaguuuaagagcagaagauacagcaguauauuauugugcaaaagauuuaggagaaagugaaaaugaagaaugggcaacagauuauuauggauuuagcauaggauauccaggacaagauccaagaggaguaguaggaauauuugauauaugggcacaaggaacaaugguaacaguaaguagu

SEQ ID NO: 48164 - RNA, 432 nt, Artificial Sequence
  derived and/or modified sequence opt6 from anti-HIV_cap256-038-102308_VR-Chain
caaguacaauuaguagaaaguggaggaggaguaguacaaccaggaggaagucuaagauuaaguugugcagcacuagauuuuccauuuaguaguuuuggaaugcauuggguaagacaaacaccaggaagaggauuagaauggguagcaauaauauggagugauggaaguaauagauauuauguagauaguguaaaaggaagauuuacaauaagcagagauaauaguaaaaauacauuauauuuacaaaugaauaguuuaagaccagaugauacagcaguauauuauuguguaaaagauuuaggagaaagugaaaaugaagaaugggcaacagauuauuaugauuuuaguguaggauauccaggacaaggaccaagaggaguaguaggaauauuugauauauggggacaaggaacaaugguaacaguaaguagu

SEQ ID NO: 48165 - RNA, 432 nt, Artificial Sequence
  derived and/or modified sequence opt6 from anti-HIV_cap256-038-091115_VR-Chain
caaguacaauuaguagaaagcggaggaggaguaguacaaccaggaagaaguuuaagauuaagcugugcaguaaguggauucacauucucaagcuauggauuacacuggguaagacaagcaccaggaaaaggacuagaauggguagcaguaauaucauacgauggaucaaacaaauacuaugcagauaguguaaaaggaagauuuacaauaagcagagacaauagcaaaaacacacuauauuuacaaauaaauagcuuaagagcagaagauacagcgguauauuacugugcaaaagacuuaggagaaagugaaaaugaagaaugggcaacagacuauuacgauuucucaauaggauacccaggacaagacccaagagcaguaguaggagcauucgauauauggggacaaggaacaaugguaacaguaaguuca

SEQ ID NO: 48166 - RNA, 432 nt, Artificial Sequence
  derived and/or modified sequence opt6 from anti-HIV_cap256-038-090262_VR-Chain
caaguacaauuaguagaaaguggaggaggaguaguacaagcaggaggaaguuuaagauuaagcugugcagcaagcggauucacauuuaauaauuauggaaugcacuggguaagacaagcaccaggaaaaggacuagaaugggcagcauuuauaagauaugauggaucaaauaaauauuaugcagauaguguaagagggagauuuacaauaaguagagacaauaguaaaaauacauuauaucuacaaaugaauaguuuaagagcagaagauacagcaguauauuacuguguaaaagacguaggagaaagugaaaaugaagaaugggcaucagacuauuacgauuucggaagagauuauccaggacaagacacgagagcaguaguaggagcauuugauauauggggacaaggaacaaugguaacaguaaguuca

SEQ ID NO: 48167 - RNA, 432 nt, Artificial Sequence
  derived and/or modified sequence opt6 from anti-HIV_cap256-038-083260_VR-Chain
caaguacaauuaguagaaaguggaggaggauuaguaaaaccaggagggagcuuaagauuaaguugugcagcaaguggauuuacauuuagugauuauuauaugacauggauaagacaagcaccaggaaaaggauuagaauggguagcaguaauaaguuaugauggaggaaauaaauauuaugcagauaguguaaaaggaagauuuacaauaagcagagauaauaguaaaaauacauuauauuuacaaaugaauaguuuaagagcagaagauacagcauuauauuauugugcaaaagauuuaggagaaagugaaaaugaagaaugggcaagugauuauuaugauuuuggaagagauuauccgggacaagauaguagaggaguaguaggaacauuugauguauggggacaaggaacaaugguaacagugaguagu

SEQ ID NO: 48168 - RNA, 432 nt, Artificial Sequence
  derived and/or modified sequence opt6 from anti-HIV_cap256-038-080981_VR-Chain
caaguacaauuaguagaaaguggaggaggaguaguacaaccaggaagaaguuuaagauuaaguugugcagcaaguggauuuacauuuaguaguuauggaaugcauuggguaagacaagcaccaggaaaaggaauggaauggguagcaguaauaaguuaugauggaaguaauaaauauuaugcagauaguguaaaaggaagauuuacaauaaguagagauaauaguaaaaauacauuauauuuacaaaugaauaguuuaagagcaguagauacagcaguauauuauugugcaaaagauuuaggagaaggagaaaaugaagaaugggcaacagauuauuaugauuuuaguauaggauauccaggacaagauccaagaggaguaguaggagcauuugauauauggggacaaggaacaaugguaacaguaaguuca

SEQ ID NO: 48169 - RNA, 432 nt, Artificial Sequence
  derived and/or modified sequence opt6 from anti-HIV_cap256-038-080873_VR-Chain
uuaguacaauuaguagaaaguggaggaggaguaguacaaccgggaggaaguuuaagauuaaguugugcagcaaguggauuuagauuuaguaguuauggaaugcauuggguaagacaagcaccaggaaaaggauuagaauggguagcauuuauaagauaugauggaaguuuuaaagauuaugcagauagcguaagaggaagauuuacaauaaguagagauaauaguaaaaauacaguauauuuacaaaugaauagcuuaagggcagaagauacagcaguauauuauuguguaaaagauuuaggagaaagugaaaaagaagaauggccaagugauuauuaugauuuuggaagagauuauccaggacaagauaguagaggaguaguaggaguauuugauauauggggacaaggaacaaugguaacaguaaguagu

SEQ ID NO: 48170 - RNA, 432 nt, Artificial Sequence
  derived and/or modified sequence opt6 from anti-HIV_cap256-038-074413_VR-Chain
caaguacaauuaguagaaaguggaggaggaguaguacaaccgggaggaaguuuaagauuaagcugugcagcaaguggauuuacauuuaguacauauggaaugcauuggguaagacaaccaccaggaaaaggauuagaauggguagcauuuauaagauaugauggaaguaauacauauuaugcagauaguguaaaaggaagauuuacaauaaguagagauaauagcaaaaauacauuauauuuacaaaugaauagcuuaagagcagaagauacagcaguauauuauugugcaaaagauuuaggagaaagugaaaaugaagaaugggcaucagauuauuaugauuuuggaagagauuauccaggacaagauccaagaggaguaguaggaguauuugauauauggggacaaggaacaaugguaacaguaaguagu

SEQ ID NO: 48171 - RNA, 432 nt, Artificial Sequence
  derived and/or modified sequence opt6 from anti-HIV_cap256-038-073153_VR-Chain
caaguacaauuaguagaaaguggaggaggaguaguacaaccaggaagaaguuuaagauuaaguugugcagcaaguggauuuacauuuucaaguuauggaaugcauuggguaagacaagcaccaggaaaaggacuagaauggguagcauuaauaaguuaugauggaacaaauaaauauuaugcagauaguguaaaaggaagauuuacaauaaguagagauaauaguaaaaauacauuauucuuacaaaugaauaguuuaagagcagaagauacggcauuauauuauugugcaaaagauuuaggagaaagugaaaaugaagaaugggcaagugauuauuaugauuuuggaagagauuauccaggacaagauccaagaggaguaguaggaacauuugauauauggggacaaggaacaaugguaacaguaaguuca

SEQ ID NO: 48172 - RNA, 432 nt, Artificial Sequence
  derived and/or modified sequence opt6 from anti-HIV_cap256-038-064227_VR-Chain
gaaguacaaguaguagaaagcggaggaggauuaguacaaccaggaggaaguuuaagauuaagcugugcagcaaguggauuuacauuuaguaauuauuggaugaguuggguaagacaagcaccaggaaaaggauuagaauggguagcaguaaugaguuuuucaggaucaggaaguuauuaugcagauagcguaaaaggaagauuuacaauaaguagcgaugauaguaugaauacaguauauuuacaaaugaauaguuuaagagcagaagauacagcaguauauuauugugcaaaagauuuaggagaaagagaaaaugaagaaugggcaagugauuauuaugauuuuggaagagauuauccaggacaagauccaagaggaguaguaggaaguauagauacauggggacauggaacaaugguaacaguaaguagu

SEQ ID NO: 48173 - RNA, 432 nt, Artificial Sequence
  derived and/or modified sequence opt6 from anti-HIV_cap256-038-061640_VR-Chain
caaguacaauuaguagaaaguggaggaggaguaguacaaccaggaagaaguuuaagauuaaguuguacagcaagccgauuuaguuuuaauaauuaugcaaugcauuggguaagacaagcaccaggaaaaggauuagaauggguagcaauaauaaguaaagauggaagugauaauaguuauguagauaguguaaaaggaagauuuacaauaaguagagauaauaguaaaaauacauuauauuuacaaaugaauaguuuaagagcagaagauacagcaguauauuauugugcaagagauuuaggggaaagugaaaaugaagaauggccaagugauuauuaugauuuuggaagagauuauccaggacaagauccaaggggaguaauaggaacauuugauguauggggacaaggaacaaugguaacaguaaguagu

SEQ ID NO: 48174 - RNA, 414 nt, Artificial Sequence
  derived and/or modified sequence opt6 from anti-HIV_cap256-038-059482_VR-Chain
agaggaguacaaugccaaguacaauuaguagaaucaggaggaggaguaguacaaccaggauucacauucucaagcuauguaaugcacuggguaagacaagcaccaggaaaaggacuagaauggguagcagauauaucauacgauggaucaaacaaauacuaugcagauagcguaaaaggaagacuaacaauaagcagagacaauagcaaaaacacacuauaucuacaaaugaauagcuuaagagcagaagauacagcaguauauuacuguguaaaagacuuaggagaaagugaaaaagaagaauggccaucagacuauuacgauuucgcaacaggauacccaguacaagacccaagagcaguaguaggagcauucgauauauggggacaaggaacaaugguaacaguaagucca

SEQ ID NO: 48175 - RNA, 432 nt, Artificial Sequence
  derived and/or modified sequence opt6 from anti-HIV_cap256-038-054000_VR-Chain
gaaguacaauuaguagaaaguggaggaaguguaguaagaccaggaggaaguuugagauuaaguugugcagcaaguggauuuacauuugaugauagcggaaugaguuggguaagacaaggaccaggaaaaggauuagaauggguagcaguaauaaguuaugauggaggaaauaaauauuaugcagauaguguaaaaggaagauuuacaauaaguagagauaauaguaaaaauacauuauauuuacaaaugaauaguuuaagagcagaagauacagcauuauauuauugugcaaaagauuuaggagaaagugaaaaugaagaaugggcaagugauuauuaugauuuuggaagagauuauccgggacaagauaguagaggaguaguaggaacauuugauguauggggacaaggaacaaugguaacaguaaguagu

SEQ ID NO: 48176 - RNA, 432 nt, Artificial Sequence
  derived and/or modified sequence opt6 from anti-HIV_cap256-038-050554_VR-Chain
gaaguacaauuacuagaaagcggaggagaucuaguacaaaguggaggaucauuaagauuaagcuguguagcaagcggauucacauucagcacacaugcaaugacauggguaagacaagcaccaggaaaaggacuagaauggguagcaguaauaucaagugauggaucaaauaaaaacuuugcagauagcguaaaaggaagauuuacaauaaguagagacaauagcaaaaauacacuauaucuacaaaugaauagcuuaagaccagaagauacagcaguauauuacugugcaaaagacuuaggagaaagugaaaacgaagaaugggcaacagacuauuacgauuucucaacaggauacccaguacaagacccaagagcaguaguaggagcauucgauauauggggacaaggaacaaugguaacaguaaguuca

SEQ ID NO: 48177 - RNA, 432 nt, Artificial Sequence
  derived and/or modified sequence opt6 from anti-HIV_cap256-038-044256_VR-Chain
caaguacaauuaguagaaaguggaggaggaguaguacaaccaggaagaaguuuaagauuaaguugugcagcaaguggauuuacauuuaguagcuaugcaaugcauuggguaagacaagcaccaggaaaaggauuagaauggguagcaguaauaaguuaugauggaucaaacaaauaucaugcaggaaguguaaaaggaagauuuauaauaaguagagauaauaguaaaaauacauuauaucuacaaaugaauagcuuaagagcagaagauacagcauuauauuauugugcaaaagauuuaggagaaagugaaaaugaagaaugggcaagugauuauuaugauuuuggaagagauuauccaggacaagauccaagaggaguaguaggaacauuugauauauggggacaaggaacgaugguaacaguaaguuca

SEQ ID NO: 48178 - RNA, 432 nt, Artificial Sequence
  derived and/or modified sequence opt6 from anti-HIV_cap256-038-040944_VR-Chain
caaguacaauuaguagaaagcggaggaggaguaguacaaccaggaagaaguuuaagauuaaguugugcagcaaguggauuuacauuuaguaauuaugcaauggauuggguaagacaagcaccaggaaaaggauuagaauggguagcaguaauaaguuaugauggaaguaacaaauauuaugcagauaguguaaaaggaagauuuacaauaaguagagauaauaguaaaaauacauuauauuuacaaaugaauaguuuaagagcagaagauacagcaguauauuauugugcaaaagauuuaggagaaagugaaaaugaagaaugggcaacagauuauuaugauuuuaguacaggauauccaggacaagauccaagagcaguaguaggagcauuugauauauggggacaaggaacaaugguaacaguaagcagu

SEQ ID NO: 48179 - RNA, 432 nt, Artificial Sequence
  derived and/or modified sequence opt6 from anti-HIV_cap256-038-040090_VR-Chain
caaguacaauuaguagaaaguggaggaggaguaguacaaccaggaagaaguuuaagauuaaguugugcagcaaguggauuuaguuuuaguaauuacgcaauggauuggguaagacaagcaccaggaaaaggauuagaauggguagcaguaauaaguagugauggaaguaauaaaaauuaugcagauaguguaaaaggaagauuuacaauaagcagagauaauaguaaaaauacauuauauuuacaaauggauaguuuaagagcagaugauacagcaguauauuauugugcaaaagauuuaggagaaagugaaaaugaagaaugggcaacagauuauuaugauuuuaguauaggauauccaguacaagauccaagaggaguaguaggaauauuugauauauggggacaaggaacaaugguaacaguaaguagu

SEQ ID NO: 48180 - RNA, 432 nt, Artificial Sequence
  derived and/or modified sequence opt6 from anti-HIV_cap256-038-032874_VR-Chain
caaguacaauuaguagaaaguggaggaggaguaguacaaccaggaggaagucuaagauuaaguugugcagcaaguggauuuacauuuaguaguuauggaaugcauuggguaagacaagcgccaggaaaaggauuagaauggguagcauuuauaagauaugauggaaauaauaaauauuaugcagauaguguaaaaggaagauuuacaauaaguagagaaaauaguaaaaauacauuauauuuacaaaugaauaguuuaagagcagaagauacagcaguauaucauugugcaaaagauuuaggagaaagugaaaaagaagaaugggcaagugauuauuaugauuuuggaagagauuauccaggacaagauccaagaggaguaguaggaacauuugauauauggggacauggaacaaugguaacaguaaguagu

SEQ ID NO: 48181 - RNA, 432 nt, Artificial Sequence
  derived and/or modified sequence opt6 from anti-HIV_cap256-038-025899_VR-Chain
caaguacaauuaguagaaagcggaggaggaguaguacaaccaggaaggaguuuaagauuaaguuguguagcaagcggauuuacauuuaguaauuaugcaauguacuggguaagacaagcaccaggaaaaggacuagaauggguaacaauaauaaguuuugauggaucaaaucaauauuaugcagauaguguaaaaggaagauuuacaauaagcagagaaaauaguaaaaauacacuauauuuacaaaugaauagccuaagagcagaagauacagcaguauauuacugugcaaaagacuuaggagaaagagaaaaugaagaaugggcaucagacuauuacgauuucggaagagauuacccaggacaagacccaagaggaguaguaggaaguauagauacauggggacauggaacaaugguaacaguaaguagu

SEQ ID NO: 48182 - RNA, 432 nt, Artificial Sequence
  derived and/or modified sequence opt6 from anti-HIV_cap256-038-024581_VR-Chain
cauauacaauuaguagaaaguggaggaggaguaguacaaccaggaggaaguuuaagauuaagcugugcagcaagcggauucccauuuaguaguuuuggaaugcauuggguaagacaaacaccaggaagaggauuagaauggguagcaauaauauggagcgauggaagucauaaagaauauacagauaguguaaaaggaagauuuacaauaaguagagauaauaguagaaguacaauggauuuacaaaugaauaauuuaagaccagaagauacagcaguauauuauugugcaaaagauuuaggagaaagagaaaaugaagaaugggcaagugauuauuaugauuuuggaagagauuauccaggacaagauccaagaggaguaguaggaaguauagauacauggggacauggaacaaugguaacaguaaguuca

SEQ ID NO: 48183 - RNA, 432 nt, Artificial Sequence
  derived and/or modified sequence opt6 from anti-HIV_cap256-038-013345_VR-Chain
caaguacaauuaguagaaaguggaggaggaguaguacaaccgggaagaaguuuaagauuaaguugugcaguaaguggauuuacauuuaguaguuauggaaugcauuggguaagacaagcaccaggaaaaggauuagaauggguagcagcaauaaguuaugauggaaguaauaaauauuauguagauaguguaaaaggaagauuuacaauaaguagagauaauaguaaaaauacauuauauuuacaaaugaauaguuuaagagcagaagauacagcaguauauuauugugcaagagauuuaggagaaagagaaauagaagaaugggcaacagauuauuaugauuuuaguauaggauauccaggacaagauccaagaggaguaguaggaguauuugauauauggggacaaggaacaaugguaacaguaaguagu

SEQ ID NO: 48184 - RNA, 438 nt, Artificial Sequence
  derived and/or modified sequence opt6 from anti-HIV_cap256-038-011559_VR-Chain
caagugcaauuaguagaaaguggaggaggaguaguacaaccaggaagaaguuuaagauuaaguugugaagcaagcggauuuacauuuaguagcuauggaauggauuggguaagacaagcaccaggaaaaggauuagaauggguagcauuaauaagucaugauggaaguaauaaacauuaugcagauaguguaaaaggaagauuuacaauaaguagagauaauaguagaaauacauuauauuuacaaaugaauaguuuaagagcagaagauacagcauuauauuauugugcaaaagauuuaggagaaagugaaaaugaagaugaagaaugggcaagugauuauuaugauuuuggaagggauuauccaggacaagauaguagaggaguaguaggaacauuugauauguggggacaaggaacaaugguaacaguaaguagu

SEQ ID NO: 48185 - RNA, 432 nt, Artificial Sequence
  derived and/or modified sequence opt6 from anti-HIV_cap256-038-009634_VR-Chain
caaguacaauuaguagaaagcggaggagggguaguacaaccaggaagaucauuaagauuaagcugugcagcaagcggauucacauucacaucauuuggaaugcacuggguaagacaagcaccaggaaaaggacuagaauggguagcaguaauaagcuacgauggaaauaacaaauacuaugcagauagcguaaaaggaagauuuacaauaagcagagaaaauagcaaaaacacacuauauuuacaaaugaauagcuuaagagcagaagauacagcaguauaucacugugcaaaagacuuaggagaaagcgaaauagaagaauggacaagcgacuauuacgauuucggaagagauuacccaggacaagacccaagaggaguauuuggaacauucgauauauggggacauggaacaaugguaacaguaagcuca

SEQ ID NO: 48186 - RNA, 432 nt, Artificial Sequence
  derived and/or modified sequence opt6 from anti-HIV_cap256-038-006730_VR-Chain
caaguacaauuaguagaaaguggaggaggaguaguacaaccaggaagaaguuuaagauuaaguugugcagcaaguggguuuacauuuaguaguuuuggaaugcauuggguaagacaagcaccaggaaaaggauuagaauggguagcaguaauaaguaaagauggaagugauaauaguuauguagauaguguaaaaggaagauuuacaauaaguagagauaauaguaaaaauacauuauauuuacaaaugaauagcuuaagagcagaagauacagcaguauauuauugugcaagagauuuaggagaaagugaaaaugaagaauggccaagugauuauuaugauuuuggaagagauuauccaggacaagauccaagaggaguaauaggaacauuugauguauggggacaaggaacaaugguaacaguaaguagu

SEQ ID NO: 48187 - RNA, 432 nt, Artificial Sequence
  derived and/or modified sequence opt6 from anti-HIV_cap256-038-004887_VR-Chain
caaguacaauuaguagaaaguggaggaggagugguacaaccaggaagaaguuuaagauuaaguugugcagcaaguggauuuaguuuuaguacaaguggaaugcauuggguaagacaagcaccaggaaaaggaauggaauggguagcaguaauaagcuaugauggaaguaauaaauauuaugcagauagcguaaaaggaagauuuacaauaaguagagauaauaguaaaaauacauuauauuuacaaaugaauaguuugagagcgguagauacagcaguauauuauugugcaaaagauuuaggagaaggagaaaaugaagaaugggcaacagauuauuaugauuuuaguauaggauauccaguacaaaauccaagaggauuaguaggagcauuugauauauggggacaaggaacaaugguaacaguaagcagc

SEQ ID NO: 48188 - RNA, 432 nt, Artificial Sequence
  derived and/or modified sequence opt6 from anti-HIV_cap256-038-004840_VR-Chain
caaguacaauuaguagaaagcggaggaggaguaguacaaccaggaagaucauuaagauuaagcugugcagcaagcggauucacauucagcaguuuuggaaugcacuggguaagacaaucaccaggaaaaggacuagaguggguagcaguaauaucauacgauggaaauaacaaauacuaugcagauagcguaaaaggaagauuuacaauaagcagagaaaauagcaaaaacacacuauaucuacaaaugaauaguuuaagaacagacgauacagcaguauauuacugugcaaaagacuuaggagaaagcgaaacagaagaauggccaucagacuauuacgauuucggaagagauuacccaggacaagacccaagaggaguaguaggaacauucgauauauggggacauggaacaaugguaacaguaaguuca

SEQ ID NO: 48189 - RNA, 432 nt, Artificial Sequence
  derived and/or modified sequence opt6 from anti-HIV_cap256-038-002181_VR-Chain
gaaguacaauuaguagaaaguggaggaggauuaguacaaccaggaagaagucuaagauuaaguugugcagcaaguggauuuacauuugaagauuaugcaaugcauuggguaagacaagcaccaggaaaaggauuagaauggguagcaguaauaaguuaugauggaaguaauaaauauuauguagauaguguaaaaggaagauuuacaauaaguagagauaauaguaaaaauacauuauaucuacaaaugaauaguuuaagagcagaagauacagcaguauauuauugugcaaaagauuuaggagaaagugaaaaugaagaaugggcaacagauuauuaugauuuuaguauaggauauccaggacaagauccaagaggaguaguaggaauauuugauauauggggacaaggaacaaugguaacaguaagcagu

SEQ ID NO: 48190 - RNA, 432 nt, Artificial Sequence
  derived and/or modified sequence opt6 from anti-HIV_cap256-038-001902_VR-Chain
caaguacaauuaguagaaaguggaggaggaguaguacaaccaggaagaaguuuaagauuaagcugugcagcaaguggauuuacauuuaguaguuuuggaaugcauuggguaagacaagcaccaggaaaaggacuagaauggguagcaguaauaaguuaugauggaaauaauaaauauuaugcagauaguguaaaaggaagauuuacaauaaguagagaaaauagcgaaaauacauuauauuuacaaaugaauaguuuaagagcagaugauacagcaguauauuauugugcaaaagauuuaggagaaagugaaaaugaagaaugggcaagugauuauuaugauuuuggaagggauuauccaggacaagacacaagaggaguaguaggaacauuugauauauggggacauggaacaaugguaacaguaaguuca

SEQ ID NO: 48191 - RNA, 432 nt, Artificial Sequence
  derived and/or modified sequence opt6 from anti-HIV_cap256-038-000976_VR-Chain
caaguacaauuaguagaaaguggaggaggaguaguacaaccaggaagaaguuuaagauuaaguugugcagcaaguggauuuacauuuaguaguuuuggaaugcauuggguaagacaagcaccaggaaaaggauuagaauggguggcaguaauaagugaugauggaaauaauaaauauuaugcagauaguguaaaaggaagauuuacaauaaguagagauaauaguaaaaauacacuauauuuacaaaugaauaguuuaagaguagaagauacagcaguauauuauuguguaaaagauguaggagaaagugaaaaugaagaaugggcaagugauuauuaugauuuuggaagagauuauccaggacaagauacaagagcaguaguaggagcauuugauauauggggacaaggaacaaugguaacaguaaguagu

SEQ ID NO: 48192 - RNA, 432 nt, Artificial Sequence
  derived and/or modified sequence opt6 from anti-HIV_cap256-038-000384_VR-Chain
caagugcaauuaguagaaaguggaggaggaguaguacaaccaggaaaaaguuuaagauuaaguugugcagcaaguggauuuacauuuaguaguuauguaaugcauuggguaagacaagcaccaggaaaaggauuagaauggguggcagauauaaguuaugauggaaguaauaaauauuaugcagauaguguaaaaggaagauuaacaauaaguagagauaauaguaaaaauacacuauaucuacaaaugaauagcuuaagagcagaagauacagcaguguauuauuguguaaaagauuuaggagaaagugaaaaagaagaauggccaagugauuauuaugauuuuggaagagauuauccaggacaagauaguagaggaguaguaggaguauuugauauauggggacaaggaacaaugguaacaguaaguagu

SEQ ID NO: 48193 - RNA, 321 nt, Artificial Sequence
  derived and/or modified sequence opt6 from anti-HIV_206-314431_VR-Chain
caauuuguauuaacacaaccaccaagcguaagcgcagcaccaggacaaaacguaacaauaagcuguagcggaccaccaagccauauagaaaaaaaugacguaagcugguaccaaagauuaccaggaauggcaccaaaaaugguaauauaugaaucaagaagaagaccacuaggaauaccaguaagauucacagcaucaagaucaggaucaagcgcaacauuaguaauaacaggacuacaaacagcagacgaagcagauuacuauugcggaacaugggacggaagaaugaacuuuggaacaggaacaacaguaacaguacua

SEQ ID NO: 48194 - RNA, 321 nt, Artificial Sequence
  derived and/or modified sequence opt6 from anti-HIV_206-247594_VR-Chain
caaucaauauuaacacaaccaccaucaguaucagcagcaccaggacaaaacguaacaauaucauguucaggaccaccaucacauauagaaaaaaaugacguaucaugguaccaaagauucccaggaauggcacccaaaaugauaauauaugaaucaaaaagaagaccauucggaguaccaggaagauucucagcaucaagaucaggaaaaucagcaacauuagcaauaacaggacuacaaacaggagacgaagcagacuacuacugcggaacaugggacggaagaaugaacuuuggaacaggaacaacaguaacaguacua

SEQ ID NO: 48195 - RNA, 321 nt, Artificial Sequence
  derived and/or modified sequence opt6 from anti-HIV_206-116890_VR-Chain
caaucaguacuaacacaaccaccaucaguaucagcagcaccaggacaaaacguaacaauaucaugcucaggaccaccaucacacauagaaaaaaacgacguaucaugguaccaacacuuaccaggagaagcaccaaaaaugauaauauacgaaucauggagaagaccagcaggaauaccagcaagauucucagcaucaagaucaggaaaaucaggaacacuagcaauaacaggacuacaaacaggagacgaagcagacuacuacugcggaacauggaacggaagaaugaacuucggaacaggaacaacaguaacaguacua

SEQ ID NO: 48196 - RNA, 333 nt, Artificial Sequence
  derived and/or modified sequence opt6 from anti-HIV_206-072383_VR-Chain
caaucaguacuaacacaaccaccaucaguaucagcagcaccaggacaaagaguaauaauaucaugcucaggaaacaauucaacaauaggaaacaacuucguaucaugguaccaacaaguaccaggaacagcaccaaaacuacuaauauacgaaacaaacagaagaccaucaggaauaccagacagauucucaggaucaaaaucaggaacaucagcaacauuagcaauaucaggauuacaaacaggagacgaagcagacuucuacugcacaguauggggaguaagaaaaggaguagcagcaguauucggaacaggaacaagacuaacaguacua

SEQ ID NO: 48197 - RNA, 333 nt, Artificial Sequence
  derived and/or modified sequence opt6 from anti-HIV_206-037527_VR-Chain
caaucaguauuaacacaaccaccaagcguaagcgcagcaccaggacaaaaaguaauaauaagcuguagcggaaacaauagcacaauaggaaaaauauuaguaagcugguaccaacaaguaccaggaacagcaccaaaauuaguaauauaugaaacaaacagaagaccaagcggaauaccagacagauucucaggaucaaaaucaggaacaagcgcaacacuagcaauaacaggacuacaaacaggagacgaagcagauuacuuuugcaaaguauggggaguaagaaaaggaguagcagcaguauuuggaacaggaacaaaaguaacaguacua

SEQ ID NO: 48198 - RNA, 333 nt, Artificial Sequence
  derived and/or modified sequence opt6 from anti-HIV_206-009095_VR-Chain
caaucaguacuaacacaaccaccaucaguaucagcagcaccagcacaaagaguaauaauaucaugcucaggagacaauucaacaauaggaaacaacuucguaucaugguaccaacaaguaccaggagcagcaccaaaacuacuaauauacgaaacaaacagaagaccaucaggaauaccagacagauucucaggaucaaaaucaggaacaacagcaacacuagcaauaucaggacuacaaacaggagacgaagcagacuaccacugcacaguauggggaguaagaaaaggaguagcagcaguauucggaacaggaacaaaaguaacaguacua

SEQ ID NO: 48199 - RNA, 321 nt, Artificial Sequence
  derived and/or modified sequence opt6 from anti-HIV_176-503620_VR-Chain
caaagcguauuaacacaaccaccaagcguaagcacagcaccaggacaaacaguaacaguaagcuguagcggaggaacaagcaauacaggaaacaauuucguaagcugguaccaacacuuaccaggaacagcaccaaaacuauuaauauaugaaaauaacaaaagaccauuaggaguaccagacagauucucaggagcaaaaucaggaacaagcgcaacauuagcauuaacaggacuacaaacaggagacgaaggagauuacuauugcgcaacauggagcggaucauuaaacauaggaacaggaacaaaaguaagcguacua

SEQ ID NO: 48200 - RNA, 321 nt, Artificial Sequence
  derived and/or modified sequence opt6 from anti-HIV_176-478726_VR-Chain
caaucaguacuaacacaaccaccaucaguaucagcagcaccaggacaaaacguaaacauaucauguucaggaccaccaucacauauagaaagaaaugacguaucaugguaccaacacuuaccaggagcagcaccaaaaaugauaauauaugaaucauggagaagaccagcaggaauaccagacagauucucagcaucaagaucaggagcaucagcaacauuagcaauaacaggacuacaaacaggagacgaagcagauuacuacugcggaacauggaacggaagaaugaacuuuggaacaggaacaacaguaacaguacua

SEQ ID NO: 48201 - RNA, 321 nt, Artificial Sequence
  derived and/or modified sequence opt6 from anti-HIV_176-245056_VR-Chain
caaucaguauuaacacaaccaccaucaguaucagcagcaccaggacaaaacguaacaauaucauguucaggaccaccaucacauauagaaaaaaacggaguaucaugguaccaacaauuuccaggaauggcaccaaaaaugguaauauaugaaucaaaaagaagaccauucggaguaccagcaagauucucagcaucaagaucaggaaaaucagcaacauuagcaauaacaggacuacaaacaggagacgaagcagauuacuacugcggaacaugggacggaagaaugaacuuuggaacaggaacaacaguaacaguacua

SEQ ID NO: 48202 - RNA, 321 nt, Artificial Sequence
  derived and/or modified sequence opt6 from anti-HIV_176-164413_VR-Chain
caaucaguacuaacacaaccaccaucaguaucagcagcaccaggacaaaaaguaacaauaucaugcucaggaggaacaucaaacauaggaaacaacuacguaucaugguaccaaagacuaccaggaacagcaccaaaacuacuaauauacgaaaacaacaaaagaccaucaggaauaccagacagauucucaggaccaaaaucaggaacaucagcaacacuagcaauaacaggacuacaaccaggagacgaagcagacuacuacugcgcaacauggucaggaucacuaaacuucggaacaggaacaaaaguaacaguacua

SEQ ID NO: 48203 - RNA, 333 nt, Artificial Sequence
  derived and/or modified sequence opt6 from anti-HIV_176-094308_VR-Chain
caaucaguauuaacacaaccaccaagcguaagugcagcaccaggacaaaaaguaauaauaaguuguagcggaaacaauagcacaauaggaaacaauuucguaaguugguaccaacaaguaccaggaacagcaccaaaacuauuaguauaugaaacauacagaagaccaagcggaauaccagacagaagcucaggaucaaaaucaggaacaacagcaacacaagcaauaagcggacuacaaacaggagacgaagcagauuaccauugcacaguauggggaguaagaaaaggaguagcagcaguauuuggaacaggaacaaaaguaacaguacua

SEQ ID NO: 48204 - RNA, 333 nt, Artificial Sequence
  derived and/or modified sequence opt6 from anti-HIV_176-065321_VR-Chain
caaucaguauuaacccaaccaccaagcguaagcgcagcaccaggaagaagaguaauaauaagcuguagcggaaacaauagcacaauaggaaacaauuucguaagcugguaccaacaaguaccaggaacagcaccaaaacuauuaguauaugaaacaaacagaagaccaaguggaauaccagacagauucucaggaucaaaaucaggaacaagcgcaacauuagcaauaagcggacuacaaacaggagacgaagcagauuacuauugcacaguauggggaguaagaaaaggaguagcagcaguauuuggaacaggaacaaaaguaacaguacua

SEQ ID NO: 48205 - RNA, 324 nt, Artificial Sequence
  derived and/or modified sequence opt6 from anti-HIV_119-099719_VR-Chain
caaucaguacuaacacaaccaccaucaguaucagcagcaccaggacaaaaaguaacaauaucaugcucaggaucaaacucauacauaggaaacaaauacauaucaugguaccaacaauucccaggaacagcaccaaaacuacuaauauacgaaaacaacaaaagaccaucaggaguaccagacagauucucagcaucaaaaucagcaacaucagcaacacuagcaauaacaggacuacacacaggagacgaagcagacuacuacugcgaaacaugcgacggaucaggaggaguauucggaacaggaacaaaaguaacaguacua

SEQ ID NO: 48206 - RNA, 327 nt, Artificial Sequence
  derived and/or modified sequence opt6 from anti-HIV_119-099536_VR-Chain
gaacuaacacaaccaccaucaguaucagcagcaucaggacaaaacguaaacauaucaugcucaggaggaucaucaaacauaggaucaaacuacguaucaugguaccaacaauucccaggaacagcaccaaaacuauuaauauacgaaacaaauaaaagaccaucaggaauaccagacagauucucaggaucaaaaucaggagcaucagcaacacuagcaauaacaggacuacaaacaggagacgaagcagacuacuacugcgcaacaugggcagacucacuaaacucagcaagaguauucggaacaggaacaaaaguaacaguacua

SEQ ID NO: 48207 - RNA, 333 nt, Artificial Sequence
  derived and/or modified sequence opt6 from anti-HIV_119-098907_VR-Chain
caaucaguacuaacacaaccaccaucaguaucagcaacaccaggacaaaaaguaacaauaucaugcucaggaucaaacucaaacauaggagacaaauacguaucaugguaccaacacuucccaggaacagcaccaaaacuauuaguauaugaaacauacagaagaccaucaggaauaccagacagauucucaggaucaaaaucaggaacaucagcaacacuagcaauaacaggacuacaaacaggagacgaagcagacuacuacugcacaauauggggaguaagaaaaggaguaggagcaguauucggaacaggaacaaaaguaauaguacua

SEQ ID NO: 48208 - RNA, 324 nt, Artificial Sequence
  derived and/or modified sequence opt6 from anti-HIV_119-098555_VR-Chain
caaucaguacuaacacaaccaccaucaguaucagcagcaccaggacaaaacguaacaauaucaugcucaggaucagcaucaaacauaggaaaaaacuucguaucaugguaccaacaacuaccaggaacagcaccaaaacuacuaauauacggaucaaacaacagaccaucaggaguaccagacagauucucaggaucaaaaucaggaacaucagcaucacuagcaauaacaggacuacaaacaggagacgaagcagacuacuacugcgaaacaugggacggaucaggagcaguauucggaacaggaacaaaaguaacaguacua

SEQ ID NO: 48209 - RNA, 324 nt, Artificial Sequence
  derived and/or modified sequence opt6 from anti-HIV_119-097828_VR-Chain
caaucaguacuaacacaaccaccaucaguaucagcagcaccaggacaaaaaguaacaauaucaugcucaggaucaucaucaaacauaggaaaaaacuacguaucaugguaccaauuacuaccaggaacagcaccaagacuaguaauauacgaaaacgacgaaagaccaucaggaacaccagacagauucucaggaucaaaaucaggaacaucagcaacacuagcaauaacaggacuacacacaggagacgaagcagacuacuacugcgaaacaugggacggaucaggaggaguauucggaacaggaacaaaaguaacaguacua

SEQ ID NO: 48210 - RNA, 324 nt, Artificial Sequence
  derived and/or modified sequence opt6 from anti-HIV_119-096480_VR-Chain
caaucaguacuaacacaaccaccaucaguaucaggagcaccaggacaaagaauaacaauaucaugcucaggaucaacaucaaacauaggacaaaacuacguaucaugguaccaacaacuaccaggaacagcaccaaaacuacuaauaucagacaacaacagaagaccaucauggacuccagacagauucucaggaucaaaaucaggaacaucagcaacacuagcaauaacaggacuacaaacaggagacgaagcagacuacuacugcgaaacaugggacggaucaggaggaguauucggaccaggaacaagaguaacaguacua

SEQ ID NO: 48211 - RNA, 324 nt, Artificial Sequence
  derived and/or modified sequence opt6 from anti-HIV_119-095664_VR-Chain
caaucaguacuaacacaaccaccaucaguaucagcagcaccaggacaaaaaguaacaauaucaugcucaggaggagcagcaaacauaggaaaaaacucaguaucaugguaccaacaacuaccaggaacagcaccaaaacuacuaauauacgacaacaacagaagaccaucaggaacaccagacagauucucaggaucaaaaucaggaacaucagcaacacuagcaauaaguggacuacaaacaggagacgaagcagacuacuacugcgaaacauggcacggaucaggaggaguauucggaacaggaacaaaaguaacaguacua

SEQ ID NO: 48212 - RNA, 321 nt, Artificial Sequence
  derived and/or modified sequence opt6 from anti-HIV_119-095212_VR-Chain
caaucaguauuaacacaaccaccaucaguaucagcagcaccaggacaaaaaguaacaauaucaugcucaggaucaacaucaaacauaggaaaaucagacguauucugguaccaacaacuaccaggaacagcaccaaaacuacuaauaucagaaacaucaagacgaccaucaggaauaccagacagauucucaggagcaaaaucaggaacaucagcaacacuagcaauaacaggacuacaaacaggagacgaagcagacuacuucugcucaacauggucaggaucacuaaacuucggaacaggaacaagaguaacaguacua

SEQ ID NO: 48213 - RNA, 333 nt, Artificial Sequence
  derived and/or modified sequence opt6 from anti-HIV_119-094773_VR-Chain
caaucaguacuaacacaaucaccaacaguaucagcagcaccaggacaaacaguaacaauaucaugcucaggaggaacaucaaauguaggaaaaaacuucguaucaugguaccaacaauucccaagaacagcaccaaaacuacuaauauacgaaaacaacaaaagaccaucaggaauaccagacagauucucaggaucaaaaucaggaaccucagcaacacuaguaauaacaggacuacaaacaggagacgaagcagacuucuacugcggaacaugggacggaagccuaagaacaggaggaguaauaggaacaggaacaagaguaacaguacua

SEQ ID NO: 48214 - RNA, 324 nt, Artificial Sequence
  derived and/or modified sequence opt6 from anti-HIV_119-094508_VR-Chain
caaucaguacuaacacaaccaccaucaguaucagcaacaccaggacaaagaguaacaguaucaugcucaggaucaucaucaaacauaggaaaccacuacguaucaugguaccaacaaguaccaggaacagcaccaaaacuauuaauaucagaaaacucaagaagaccaucaggaacaccagacagauucucaggaagcaaaagcggaacaucagcaacauuagcaauaacaggacuacaaacaggagacgaagcagacuacuacugcgaaacaugggacggaucaggaggaguauucggaacaggaacaaaaguaacaguauua

SEQ ID NO: 48215 - RNA, 324 nt, Artificial Sequence
  derived and/or modified sequence opt6 from anti-HIV_119-093795_VR-Chain
caaucaguauuaacacaaccaccaucaguaucagcagcaccaggacaaaaaguaacaauaucaugcucaggaucaucaucaaacauaggaaacaacuacguaucaugguaccaauaccuaccaggaacagcaccaaaacuacuaauaucagaaaacaacagaagaccaucaggaacaccagacagauucucaggaucaaaaucaggaacaucagcaacacuagcaauaacaggacuacaaacaggagacgaagcagacuacuacugcgaaacaugggacggaucaggaggaguauucggaacaggaacaaaaguaacaguccua

SEQ ID NO: 48216 - RNA, 321 nt, Artificial Sequence
  derived and/or modified sequence opt6 from anti-HIV_119-093732_VR-Chain
caaagcguauuaacacaaccaccaagcguaagcgcagcagcaggacaaaacguaaacauaagcuguagcggaagaaaaagcaauguaggaggaaauuacguaagcugguaccaacaauuuccaggaacagcaccaaaacuauuaauauaugaagauaacaaaagaccaagcuggauaccagacagauucacagcaucaagaucaggaacaagcgcaacauuaggaauaacaggacuacaaacaggagacgaagcagauuacuuuugcucaacauggagcggaucauuaaacuuuggaacaggaacaagaguaacaguacua

SEQ ID NO: 48217 - RNA, 333 nt, Artificial Sequence
  derived and/or modified sequence opt6 from anti-HIV_119-092903_VR-Chain
caaucaguacuaacacaaccaccaucaguaucagcagcaccaagacaaaaaguaacaauaucaugcucaggaucaucaucaaacauaggaaaccacuacguaucaugguaccaacaacuaccaggaacagcaccaaaacuacuaauauacgaaaacaacaaaagaccaucaggaauaccagacagauucucaggaucaaaaucaggaacaucagcaacacuagcaauaacaggacuacaaacaggagacgaagcagacuacuacugcgcaaccugggcaccaagacuaaacucagcaagaguauucggaaacggaacaaugguaacaguacua

SEQ ID NO: 48218 - RNA, 333 nt, Artificial Sequence
  derived and/or modified sequence opt6 from anti-HIV_119-092284_VR-Chain
caaagcgucuuaacacaaccaccaagcguaagcggagcaccaggacaaagaguaacaauaagcuguacaggaagcucaagcaauauaggaggauaugacguacacugguaccaacaaguaccaggaacagcaccaaaacuauuacuauaugaaaaugacagaagaccaagcggaauaccagacagauucucaggaucaaaaucaggaacaagugcaacauuaguaauaacaggacuacaaacaggagacgaagcagauuucuauugcggaacaugggacggaucauuaagaacaggaggaguaauaggaacaggaacaagaguaacaguacua

SEQ ID NO: 48219 - RNA, 333 nt, Artificial Sequence
  derived and/or modified sequence opt6 from anti-HIV_119-091586_VR-Chain
caaucaguauuaacacaaccaccaaguaugagcgcagcaccaggacaaagaguaacaauaagcuguagcggaacaucaagcgauauaggaagaaauuacguaagcugguaccaacaauuuccaggagcagcaccaaaaguauuaauauaugaaaauagcaauagaccaagcggaauaccagacagauucucaggaucaaaaucaggaacaagcgcaacauuagcaauaagcggacuacaaacaggagacgaagcagauuacuguugcgcaguauggggaguaagaagaggagcaggagcaguauuuggagcaggaacaaaaguaacaguacua

SEQ ID NO: 48220 - RNA, 333 nt, Artificial Sequence
  derived and/or modified sequence opt6 from anti-HIV_119-091023_VR-Chain
caaucaguauuaacacaaccaccaagcguaagcgcagcaccaggacaaagaguaacaauaagcuguagcggaagcacaaguaauauaggaaacaauuucguaaguugguaccaucacguaccaggaacagcaccaaaacuauuaauauaugacaauguaaaaagaccaacaaauguaccagacagauucucaggaucaaaaucaggaacaagcgcaacauuagcaauaagcggacuacaaacaggagacgaagcagauuacuggugugcaguauggggaguaagaagaggagcaggagcaguauuuggagcaggaacaaaaguaacaguacua

SEQ ID NO: 48221 - RNA, 333 nt, Artificial Sequence
  derived and/or modified sequence opt6 from anti-HIV_119-090334_VR-Chain
caaaguguauuaacacaaccaccaagcguaagcggagcaccaggacaaagaguaacaauaagcuguacaggaagcgcaagcaauauaggagacucagacguacacugguaccaacaauuaccaggaacagcaccaaaauuauuaauauuugacaaugacaaaagaccaagcggaauaccagacagauucucaggaucaaaaucaggaacaagcgcaacauuagcaauaacaggacuacaaaguggagacgaagcagauuacuauugcgcaguauggggaguaagacaaggagcaggagcaguauuuggaacaggaacaaaaguaacaguauua

SEQ ID NO: 48222 - RNA, 333 nt, Artificial Sequence
  derived and/or modified sequence opt6 from anti-HIV_119-088694_VR-Chain
caaucaguauuaacacaaccaccaagcguaagcgcagcaccaggacaaaaaguaacaauaagcuguucaggaagcaguagcaauauaccaauaaauggaguaagcugguaccaacaauuuccaggaacagcaccaaaacuauuaguauaugaaacauacagaagaccaagcggaauaccagacagauucucaggaucaaaaucaggaacaucagcaacauuagcaauaacaggacuacaaacaggagacgaagcagauuacuauugcacaguauggggaguaagaaaaggaguaggagcaguauuuggaacaggaacaaaaguaacaguacua

SEQ ID NO: 48223 - RNA, 333 nt, Artificial Sequence
  derived and/or modified sequence opt6 from anti-HIV_119-088499_VR-Chain
caaucaguacuaacacaaccaccaucaguaucagcagcaccaggacaaaaaguaacaauaucaugcucaggaucaaacucauacauaggaaacaaauacguaucaugguaccaacaauucccaggaacagcaccaaaacuacuaauauacgaaacaaacaaaagaccaucaggaauaccagacagauucucaggaucaaaaucaggaacaucagcaacacuagcaauaacaggauuacaaacaggagacgaagcagacuacuacugcgcaacaugggcaccaagacuaaacucagcacgaguauucggaaacggaacaaugguaacaguacua

SEQ ID NO: 48224 - RNA, 333 nt, Artificial Sequence
  derived and/or modified sequence opt6 from anti-HIV_119-088298_VR-Chain
caaagcgucuuaacacaaccaccaagcguaagcgcagcaccaaaagaaaaaguaacaauaagcuguagcggaggaacaaguaauauaggaagaaauuacguaagcugguaccaacaaguaccaggaacagcaccaaaacuauuaauauaugaaaauaacaaaagaccaagcggaauaccagacagauucucaggaucaaaaucaggaacaagugcaacauuaguaauaacaggacuacaaacaggagacgaagcagauuucuauugcggaacauggggaggaucauuaagaacaggaggaguauuaggaacaggaacaagaguaacaguacua

SEQ ID NO: 48225 - RNA, 324 nt, Artificial Sequence
  derived and/or modified sequence opt6 from anti-HIV_119-087488_VR-Chain
caaucaguauuaacacaaccaccaucaguaucagcagcaccaggacaaaaaguaacaauauucugcucaggaagauacucaaacauagaaucaaacuacguaucaugguaccaacaacuaccaggaacagcaccaaaacuauuaauacacgaaaacaacagaagaccaucaggaacaccagacagauucucaggaucaaaaagcggaacaucagcaacacuagcaauaacaggauuacacacaggagacgaagcagacuacuacugcgaaacaugggacggaucaggaggaguauuuggaacaggaacaaaaguaacaguacua

SEQ ID NO: 48226 - RNA, 333 nt, Artificial Sequence
  derived and/or modified sequence opt6 from anti-HIV_119-087423_VR-Chain
caaucaguauuaacacaaccaccaagcguaagcgcagcaccaggacaaaaaguaacaauaaguuguagcgcaagcucaagcaauauaggaaacaauuacguaagcugguaccaacaauuaccagcaacagcaccaaaacuauuaauauaugacacagacaaaagaccaagcggaauaccagacagauucucaggaucaaaaucaggaacaagcgcaacauuagcaauaacaggacuacaaacaggagacgaagcagauuacuauugcacaguauggggaguaagaaaaggaguaggagcaguauuuggcacaggaacaaaaguaacaguacua

SEQ ID NO: 48227 - RNA, 324 nt, Artificial Sequence
  derived and/or modified sequence opt6 from anti-HIV_119-087371_VR-Chain
caaucaguauuaacacaaccaccaagcuuaagcgcagcaccaggacaaagaguaacaauaagcuguagcggaggagcaagcaauauaggaaaaaauagcguaagcugguacguacaaguaccaggaacagcaccaaaacuauuaauauaugaaaauaaccaaagaccaagcggaauaucagacagauucaguggaucaaaaucaggaucaagcgcaacauuaggaauaacaggacuacaaacagcagacgaagcagauuacuauugcgaaacaugggacggaagcggaggaguauucggaacaggaacaaaaguaacaguauua

SEQ ID NO: 48228 - RNA, 321 nt, Artificial Sequence
  derived and/or modified sequence opt6 from anti-HIV_119-087279_VR-Chain
caaucaguacuaacacaaccaccaucaguaucagcagcaccaggacaaaaaguaacaauauccugcucaggaucaucaucaaacauaggaaaaaacuacguaucaugguaccaacaauucccaggaacagcaccaaaacuacuaauguacgaaaacaacaaaagaccaucaggaguaccagacagauucucaggaucaaaaucaggaacaucagcaacacuagacauaucaggacuacaaacaggagacgaagcagacuacuacugcucaacauggucaggaucacuaaacuucggaacaggaacaagaguaacaguacua

SEQ ID NO: 48229 - RNA, 324 nt, Artificial Sequence
  derived and/or modified sequence opt6 from anti-HIV_119-087146_VR-Chain
caaucaguacuaacacaaccaccaucaguaucagcagcaccaggacaaaaaguaacaauaucaugcucaggaucaucaucaaacauaggaaaaaacucaguaucaugguaccaacaauucccaggaacagcaccaaaacuacuaauauacgaaaacaacaaaagaccaucaggaauaccagacagauucucaggaucaaaaucaggaacaucagcaacacuagcaauaacaggacuacacacaggagacgaagcagacuacuacugcgaaacaugggacggaucaggaggaguauucggaacaggaacaaaaguaacaguacua

SEQ ID NO: 48230 - RNA, 324 nt, Artificial Sequence
  derived and/or modified sequence opt6 from anti-HIV_119-087048_VR-Chain
caauucguacuaacacaaccaccaucaguaucagcagcaccaagacaaaaaguaauaauaucaugcucaggaucaagcucaaacauaggaaaaaacuacguaucaugguaccaacaacuaccaggaacagcaccaaaacuacuaauauacgacaacgacaaaagaccaucaggaauaucagacagauucagcgcaaguaaaagcggaacaucagcaacacuagcaauaacaggacuacacacaggagacgaagcagacuacuacugcgaaacaugggacggaucaggaggaguauucggaacaggaacaaaagucacaguacua

SEQ ID NO: 48231 - RNA, 321 nt, Artificial Sequence
  derived and/or modified sequence opt6 from anti-HIV_119-085802_VR-Chain
caaucaauacuaacacaaccaccaucaguaucagcagcaccaggacaaagaguaacaauaccauguuucggaggacauucaaauauaggaucaaauuacguaucaugguaccaacacuuaccaggaacagcaccaaaacuauuaauauuugaaaauaacaaaagaccaucaggaauaccagacagauucucaggagcaaaaucaggaacaucagcaacauuagcaauaacaggacuacaaacaggagacgaagcagacuacuucugcgcaacauggucaggaggacuaaacuucggaacaggaacaaaaguaacaguacua

SEQ ID NO: 48232 - RNA, 324 nt, Artificial Sequence
  derived and/or modified sequence opt6 from anti-HIV_119-085784_VR-Chain
caaucauucuuaacacaaccaccaucaguaucagcagcaccaggacaaaaaguaacaauaucaugcucaggaucaaacucaaacauaggaaacaacuauguaucaugguaccaauaccuaccaggaacagcaccaaaacuauuaauauacgaaaacgacagaagaccaucaggaacaccagacagauucucaggaucaaaaucaggaacaucagcaacacuagcaauaacaggauuacaaacaggagacgaagcagacuacuacugcgaaacaugggacggaucaggaggaguauucggaacaggaacaaaaguaacaguacua

SEQ ID NO: 48233 - RNA, 333 nt, Artificial Sequence
  derived and/or modified sequence opt6 from anti-HIV_119-085370_VR-Chain
caaucaguacuaacacaaccaccaucaguaucagcagcaccaggacaaacaguaacaauaucaugcucaggaucaucaucaaacauaggaaacacauacguaucaugguaccaacaccuaccaggaacagcaccaaaauuacuaauauacgacaacaacauaagaccaucaggaauaccagacagauucucagcaucaaaaucaggaacaucagcaacauuagcaauaacaggacuacaaacaggagacgaagcagacuacuacugcgcaaccugggcaccaucacuaaacucagcaagaguauucggaucaggaacaagaguagcaguacua

SEQ ID NO: 48234 - RNA, 321 nt, Artificial Sequence
  derived and/or modified sequence opt6 from anti-HIV_119-085276_VR-Chain
caaucaauacuaacacaaccaccaucaguauccgcagcaccaggacaaagaguaacaauaucaugcucaggaucaucaucaaacauaggaaacaacuacguaucaugguaccaacacguaccaggaacagcaccaaaacuauuaauauacgaaaacaacagaagaccaucaggaacaccagacagauucucaggagcaaaaucaggaacaucagcaacacuagcaauaacaggacuacaaacaggagacgaagcagacuacuucugcucaacauggucaggaucacuaaacuucggaacaggaacaaaaguaacaguacua

SEQ ID NO: 48235 - RNA, 333 nt, Artificial Sequence
  derived and/or modified sequence opt6 from anti-HIV_119-084885_VR-Chain
caaucaguauuaacacaaccaccaagcguaagugcagcaccaggagaaaaaguaacaauaagcuguaguggaagcucaagcaaaauaggaaacaauuucguaagcugguaccaacaaguaccaggaacagcaccaaaacuauuaguauaugaaucauacagaagaccaagcggaauaccagacagauucucaggaucaaaaucaggcacaagcgcaacauuagcaauaacaggacuacaaacaggagacgaagcagauuacuauugcacaguauggggaguaagaaaaggaguaggagcaguauuuggaacaggaacaaaaguaacaguacua

SEQ ID NO: 48236 - RNA, 333 nt, Artificial Sequence
  derived and/or modified sequence opt6 from anti-HIV_119-084874_VR-Chain
caaucaguauuaacacaaccaccaagcguaagcggagcaccaagacaaagaguaacaauaagcuguagcggaagcgcaagcaauauaggaaaaaauagcguaagcugguaccaacaaguaccaggaacagcaccaaaacuauuaauauaugaaaauaacaaaagaccaagcggaauaccagacagauucucaggaucaaaaucaggaacaagcgcaacauuaguaauaacaggacuacaaacaggagacgaagcagauuucuauugcggaacaugggacggaagcuuaagaacaggaggaguaauaggaacaggaacaagaguaacaguacua

SEQ ID NO: 48237 - RNA, 333 nt, Artificial Sequence
  derived and/or modified sequence opt6 from anti-HIV_119-084691_VR-Chain
caaucaguauuaacacaaccaccaagcguaagcgcagcaccaggacaaaaaguaguaauaagcuguagcggaagcucaagcauaauagaaaaaaauagcauaagcugguaccaacaaggaccaggagcagcaccaaaacuauuaauauaugaaaaugacaaaagaccaagcggaauaccagacagauucucaggaucaaaaucagcaacaagcgcaacauuagcaauaguaggacuacaaacaggagacgaagcagauuacuguugcgcaguauggggaguaagaagaggagcaggagcaguauuuggagcaggaacaaaaguaacaguacua

SEQ ID NO: 48238 - RNA, 324 nt, Artificial Sequence
  derived and/or modified sequence opt6 from anti-HIV_119-083793_VR-Chain
caaucaguacuaacacaaccaccaucaguaucagcagcaccaggacaaaaaguaacaauaucaugcucaggaucaucaucaaacauaggcaaaaacucaguaucaugguaccaacaauuaccagcaacagcaccaaaacuacuaauauacgaaucaaacaaaagaccaucaggaauaccagacagauucucaggaucaaaaucaggaacaucagcaacacuagcaauaacaggacuacaaacaggagacgaagcagacuacuacugcgcaacaugggacggaagaguaucaguaauaggaacaggaacaaaaguaacaguacua

SEQ ID NO: 48239 - RNA, 324 nt, Artificial Sequence
  derived and/or modified sequence opt6 from anti-HIV_119-083163_VR-Chain
caaaguguacuaacacaaccaccaucaguaucaggagcaccaggacaaagaguaauaauaucaugcacaggaucaaguucaaacauauggggauacgauguacaaugguaucaacaacuaccaggaacagcaccaaaauuacuauuauacgaaaacgauagaagaccaucaggaacaccagauagauuuagcggaagcaaaagcggaacaucagcaacauuagcaauaacaggauuacacacaggagaugaagcagacuauuacugugaaacaugggauggaucaggaggaguauuuggaacaggaacaaaaguaacaguauua

SEQ ID NO: 48240 - RNA, 333 nt, Artificial Sequence
  derived and/or modified sequence opt6 from anti-HIV_119-082331_VR-Chain
caaucaguauuaacacaaccaccaagcauaagcgcagcaccaggacaaaaaguaacaauaagcuguagcggaggaucaagcaauauaggagcaaauuacguaagcugguaccaacacuuaccaggaacagcaccaaaacuauuaauauaugaaacaaacaaaagaccaaguggaauaccagacagauucucaggaucacaaucaggaacaagugcaacauuaguaauaacaggacuacaaacaggagacgaagcagauuucuauugcggaacauggggaggaagccuaagagcaggaggaguaauaggaacaggaacaagaguaacaguacua

SEQ ID NO: 48241 - RNA, 324 nt, Artificial Sequence
  derived and/or modified sequence opt6 from anti-HIV_119-082070_VR-Chain
caaagcguacuaacacaaccaccaucaguaucagcagcaccaggacaaaaaguaguaauaucaugcucaggaucaagcucaauaauagaaaaaaacucaauaucaugguaucaacaaggaccaggagcagcaccaaaauuacuaauauacgaaaacgauagaaggccaucaggaacaccagauagauuuagcggaaguaaaagcggaacaucagcaacacuagcaauaacaggauuacaaacaggagaugaagcagacuauuacugugaaacaugggauggaucaggaggaguauuuggaacaggaacaaaaguaacaguacua

SEQ ID NO: 48242 - RNA, 333 nt, Artificial Sequence
  derived and/or modified sequence opt6 from anti-HIV_119-081512_VR-Chain
caaucaguauuaacacaaccaccaaguguaagcgcagcaccaggacaaaacguaacauuuagcuguagcggaagcaauagcaauauaggagacaauuacguaagcugguaccaacaaauaccaggaacagcaccaaaauuaguaauauaugacaauaacaaaagaccaagcggaauaccagacagauucucaggaucaaaaucaggaacaagcgcaacauuaguaauaacaggacuacaaacaggagacgaagcagauuucuauugcggaacaugggacggaagccuaagaacaggaggaguaauaggaacaggaacaagaguaacaguacua

SEQ ID NO: 48243 - RNA, 333 nt, Artificial Sequence
  derived and/or modified sequence opt6 from anti-HIV_119-080816_VR-Chain
caacuaguacuaacacaaccaccaucagcaucaggaacaccaggacaaagaguaacaauaucaugcucaggaucaucaucaaacauaggaucaaacuucguaucaugguaccaacaaagaccaggaacagcaccaaaacuacuaauauacgaaacaaacaaaagaccaucaggaauaccagacagauucucaggaucaaaaucaggaacaucagcaacacuagcaauaacaggacuacaaacaggagacgaagcagacuacuacugcgcaacaugggcaccaagacuaaacucagcaagaguauucggaaacggaacaaugguaacaguacua

SEQ ID NO: 48244 - RNA, 333 nt, Artificial Sequence
  derived and/or modified sequence opt6 from anti-HIV_119-079302_VR-Chain
caaucaguacuaacacaaccaccaucaguaucagcagcaccaggacaaaaaguaacaauaucaugcucaggaucaucaucauacauaggaaacaaauacguaucaugguaccaacaauucccaggaacagcaccaaaacuauuaauauacgaaaacaacaaaagacuaucaggaauaccagaccgauucucagcaucaaaaucagcaacaucagcaacacuagcaauaagcggacuacaaacaggagacgaagcagacuucuacugcggaacaugggacggaucacuaagaacaggaggaguaauaggaacaggaacaagaguaacaguacua

SEQ ID NO: 48245 - RNA, 327 nt, Artificial Sequence
  derived and/or modified sequence opt6 from anti-HIV_119-079292_VR-Chain
caaucaguacuaacacaaccaccaagcguaucagcagcaccaggacaaaaaguaacaauaucaugcucaggaucaaacucaaacauaggaaacaacuacguaucaugguaccaacaacuaccaggaacagcaccaaaacuacuaauauacgacaacaacaaaagaccaucaggaauaccagacagauucucaggaucaaaaucaggaacaucagcaacacuaggaauaacaggacuacaaacaggagacgaagcaaacuacuacugcggaacaugggacacaucacuaucaggaguauucggaacaggaacagaaguaauaguacua

SEQ ID NO: 48246 - RNA, 321 nt, Artificial Sequence
  derived and/or modified sequence opt6 from anti-HIV_119-079289_VR-Chain
caaucagcacuaacacaaccaccaucaguaucagcagcaccaggacaaagaguaacaauaucaugcucaggaaacaacucaaacauaggaaacaacuucguaucaugguaccaacuacuaccaggaacagcaccaaaacuacuaauauacgaaaacaacaaaagaucaucaggaauaccagacagauucucaggaucaaaaucaggaacaucagcaacacuaggaauaacaggacuacaaacaggagacgaagcagacuacuucugcucaacauggucaggaucacuaaacuucggaacaggaacaagaguaacaguacua

SEQ ID NO: 48247 - RNA, 324 nt, Artificial Sequence
  derived and/or modified sequence opt6 from anti-HIV_119-078935_VR-Chain
caaucaguauuaacacaaccaccaaguguaagugcagcaccaggacaaagaguaacaauaagcuguagcggaacaucagcaaauauagaaaacuauuacguaagcugguaccaacaauuaccaggaacagcaccaaaacuaauaauauaugacgauaacaaaagaccaagcggaauaccacaaagauucucaggaucaaaaucaggaacaagcgcaacauuaggaauaacaggacuacaaacaggagacgaagcagaauacuauugcgaaacaugggacggaagcggaggaguauucggaacaggaacaaaaguaacaguauua

SEQ ID NO: 48248 - RNA, 324 nt, Artificial Sequence
  derived and/or modified sequence opt6 from anti-HIV_119-078702_VR-Chain
caaucaguacuaacacaaccaccaucaguaucagcagcaccaggacaaaaaguaacaauaucaugcucaggaucaucaucaguauucggaaaaaacuacguaucaugguaccaacaccuaccaggaacagcaccaaaacuacuaauauacgaaaacacaaaaagaccaucaggaauaccagacagauucucaggaucaaaaucaggaacaucagcaacacuagcaauaacaggacuacaaacaggagacgaagcagacuacuacugcgaaacaugggacggaucaggaggaguauucggaucaggaacaaaaguaacaguacua

SEQ ID NO: 48249 - RNA, 324 nt, Artificial Sequence
  derived and/or modified sequence opt6 from anti-HIV_119-078593_VR-Chain
caaucauuccuaacacaaccaccaucaguaucagcagcaccaggacaaaaaguaacaauaagcugcucaggaucaaacucaaacauaggaaacaacuacguaucaugguaccaacaaguaccaggaacagcaccaaaacuacuaauauacgaaaacaacaaaagaccaucaggaauaccagacagauucucaggaucaaaaucaggaacaucagcaacacuaguaauaacaggacuacacacaggagacgaagcagacuacuacugcgaaacaugggacggaucaggaggaguauucggaacaggaucaaacguaacacuacua

SEQ ID NO: 48250 - RNA, 333 nt, Artificial Sequence
  derived and/or modified sequence opt6 from anti-HIV_119-077708_VR-Chain
caaucaguauuaacacaaccaccaaguuuaagcgcagcaccaggacaaaaaguaacaauaagcuguagcggaacaacaagcaauauaggaaacaauuacguaagcugguaccaacaccuaccaggaacagcaccaaaacuauuaauauaugaaaauacaaaaagaccaagcggaauaccagacagauucucaggaucaaaaucaggaacaagcgcaacauuaggaauaacaggacuacaaacaggagacgaagcagauuacuauugcacaguauggggaguaagaaaaggaguaggagcaguauuuggaacaggaacaaaaguaacaguacua

SEQ ID NO: 48251 - RNA, 321 nt, Artificial Sequence
  derived and/or modified sequence opt6 from anti-HIV_119-076904_VR-Chain
caaucaguauuaacacaaccaccaucaguaucagcagcaccaggacaaaaaguaacaauaucaugcucaagaucaucaucacacauagaaaacucauacguaucaugguaccaacaccuaccaggaacagcaccaaaacuacuaauauacgaaaacaacaaaagaccaucaggaauaccagacagauucucaggcucaaaaucaggaacaucagcaacacuaggaauauccggacuacaaacaggagacgaagcagacuacuucugcucaacauggucaggaucauuaaacuucggaacaggaacaagaguaacaguacua

SEQ ID NO: 48252 - RNA, 324 nt, Artificial Sequence
  derived and/or modified sequence opt6 from anti-HIV_119-075862_VR-Chain
caaucaguacuaacacaaccaccaucaauaucagcagcaccaggacaaaaaguaacaauaucaugcucaggaucagcaucaaacauaggaaaaaacucaguaucaugguaccaacaauucccaggaacagcaccaaaacuacuaauauacgaaaacaacagaagaccaucaggaacaccagacagauucucaggaucaaaaucaggaacaucagcaacacuagcaauaacaggacuacaaacaggagacgaagcagacuacuacugcgaaacaugggacggaucaggaggaguauucggaacaggaacaaaaguaacaguacua

SEQ ID NO: 48253 - RNA, 333 nt, Artificial Sequence
  derived and/or modified sequence opt6 from anti-HIV_119-075465_VR-Chain
caaucaguauuaacacaaccaccaagcguaagugcagcaccaggacaaaaaguaguaauaagcuguaguggaagcucaagcauaauaggaaacaauuacguaagcugguaccaacaauuaccaggaacagcaccaaaacuauuaauauaugaaaauaacagaagaccgagcggaauaccagacagauucucaggaucaaaaucaggaacaagcgcaacauuagcaauaagcggacuacaaacaggagacgaagcagauuacuguugcgcaguauggggaguaagaagaggagcaggagcaguauuuggagcaggaacaaaaguaacaguacua

SEQ ID NO: 48254 - RNA, 330 nt, Artificial Sequence
  derived and/or modified sequence opt6 from anti-HIV_119-074822_VR-Chain
ucaguauuaacacaaccaccaagcguaagcgcagcaccaggacaaaacauaacaauaagcuguagcggaggaucaaguaauauagcaaaaaauuacauaagcugguaccaacacuuaccaggaacagcaccaaaaauaguaauauaugacaaugacaaaagaccacuaggaauaccagacagauucucagcaucaaaaucaggaacaagugcaacauuaggaauaacaggauuacaaacaggagacgaagcagauuacuauugcgcaguauggggaguaagaagaggaguaggagcaguauuuggagcaggaacaaaaguaauaguacua

SEQ ID NO: 48255 - RNA, 333 nt, Artificial Sequence
  derived and/or modified sequence opt6 from anti-HIV_119-074629_VR-Chain
caaucaguauuaacacaaccaccaagcgaaagugcagcaccaggacaaaaaguaacaauaaguuguagcggaggaacaagcaauauaggaaacaauuacguaagcugguacagaagauuaccaggaacagcaccaaaacuauuaauauaugaaaauaacaggagaccaagcggaauaccagacagauucucaggaucaaaaucaggaacaagcgcaacauuagcaauaagcggacuacaaacaggagacgaagcagauuacuguugcgcaguauggggaguaagaagaggagcaggagcaguauuuggagcaggaacaaaaguaacaguacua

SEQ ID NO: 48256 - RNA, 324 nt, Artificial Sequence
  derived and/or modified sequence opt6 from anti-HIV_119-074500_VR-Chain
caaucaguacuaacacaaccaccaucaguaucagcagcaccaggacaaaaaguaacaaugucaugcucaggaucaucaucaaacauaggaaacaacuacguaucaugguaccaauaccuaccaggaacagcaccaaaacuacuaauauacgaaaacgacagaagaccaucaggaauaccagacagauucucagcaucaaaaucaggcacaucagcaacacuagcaauaacaggacuacaaacaggagacgaagcagacuacuacugcgaaacaugggacggaucaggaggaguauucggaacaggaacaaaaguaacaguacua

SEQ ID NO: 48257 - RNA, 333 nt, Artificial Sequence
  derived and/or modified sequence opt6 from anti-HIV_119-073911_VR-Chain
caaucaguauuaacacaaccaccaagcguaagcgcagcaccaggacaaagaguaacaauaagcuguagcggaagcucaagcaauauagaaaacaauuacguaagcugguaccaacacuuaccaggaacagcaccaaaacuauuaguauaugacgauaacaaaagaccaagcggaauaccacacagauucucagcaucaaaaucaggaacaagcgcaacacuagcaauaacaggacuacaaaccggagacgaagcagauuacuauugcacacuauggggaguaagaaaaggaguaggagcaguauuuggaacaggaacaaaaguaacaguacua

SEQ ID NO: 48258 - RNA, 324 nt, Artificial Sequence
  derived and/or modified sequence opt6 from anti-HIV_119-072765_VR-Chain
caaucaguacuaacacaaccaccaucaguaagcgcagcaccaggacaaaaaguaacaauaucaugcucaggaaacucaucaaacauaggaaauaacuucguaucaugguaucaacaaguaccaggaacagcaccaaaacuacuaguauacgaaacauacagaagaccaucaggaacaccagacagauucucaggaucaaaaucaggaacaucagcaacacuagcaauaucaggacuacaaacaggagacgaagcagacuacuacugcggaacaugggacggaucaggaggaguauucggaacaggaacaaaaguaacaguacua

SEQ ID NO: 48259 - RNA, 333 nt, Artificial Sequence
  derived and/or modified sequence opt6 from anti-HIV_119-072313_VR-Chain
caauuuguauuaacacaaccaccaagcguaagcgcagcaccaggacaaaaaguaacaauaagcuguagcgcaagcucaagcauaauaggaaaaaauuacguaagcugguaccaacaauuuccaggaacagcaccaaaacuauuaauauaugaagauaacaaaagaccaagcggaauaccagacagauucucaggaucaaaaucaggaacaagcgcaacauuagcaauaacaggacuacaaacaggagacgaagcagauuacuauugcacaguauggggaguaagaaaaggaguaggagcaguauuuggaacaggaacaaaaguaacaguacua

SEQ ID NO: 48260 - RNA, 333 nt, Artificial Sequence
  derived and/or modified sequence opt6 from anti-HIV_119-072280_VR-Chain
caaucaguacuaacacaaccaccaucaguaucagcagcaccaggacaaaaaguaucaauaucaugcucaggaucagacucaaaccuaggagacaacuacguaucaugguaccaacaauucccaggaacagcaccaaaacuacuaauacacgacaacaauaaaagaccauccggaacaccagacagauucucaggaucaaaaucaggaacaucagcaacacuagcaauaacaggacuacaaacaggagacgaagccgacuacuacugcgcaacaugggcaccaagacuaaacucagcaagaguauucggaaacggaacaaugguaacaguacua

SEQ ID NO: 48261 - RNA, 333 nt, Artificial Sequence
  derived and/or modified sequence opt6 from anti-HIV_119-071693_VR-Chain
caaucaguauuaacacaaccaccaagcguaagcgcagcaccaggacaaaaaguaguaauaagcuguagcggaagcucaagcauaauagaaaaaaauagcauaagcugguaccaacaaggaccaggagcagcaccaaaauuauuaauauaugaaaaugacaaaagaccaagcggaauaccagacagauucucaggaucaaaaucaggaacaagcgcaaccuuagcaauaacaggacuacaaacaggagacgaagcagauuacuauugcacaauauggggaguaagaaaaggaguaggagcaguauuuggaacaggaacaaaaguaacaguacua

SEQ ID NO: 48262 - RNA, 321 nt, Artificial Sequence
  derived and/or modified sequence opt6 from anti-HIV_119-071353_VR-Chain
caaucaguacuaacacaaccaccaucagcaucagcagcaccaggacaaaaaguaacaauaucaugcucaggaucaaauucaaacaucggaaacaacuucguaucaugguaccaacuauucccaggaacagcaccaaaacuacuaauauuugaaaacaacaaaagacccucaggaauaccagacagauucucaggagccaaauccggaacaucagcaacacuagcaauaacaggacuacaaacaggagacgaagcagacuacuucugcucaacauggucaggaucacuaaacuucggaacaggaacaagaguaacaguacua

SEQ ID NO: 48263 - RNA, 324 nt, Artificial Sequence
  derived and/or modified sequence opt6 from anti-HIV_119-069711_VR-Chain
caaucaguacuaacacaaccaccaucaguaucagcagcaccaggacaaaaaguaacaauaucaugcucaggaucaucaucaaacauaggaaacaacuacguaucaugguaccaacaacuaccaggaacagcaccaaaacuacuaauauacgacaacaacaacagaccaucaggaguaccagacagauucucaggaucaaaaucaggaacaucagcaacacuagcaauaacaggacuacaaacaggagacgaagcagacuacuacugcgaaacaugggacgacucaggaggaguauucggaacaggaacaaaaguaacaguauua

SEQ ID NO: 48264 - RNA, 333 nt, Artificial Sequence
  derived and/or modified sequence opt6 from anti-HIV_119-069061_VR-Chain
caaucaguacuaacacaaccaccaucaguaucagcagcaccaggacaaaaaguaacaauaucaugcucaggaucaucaucaaacauaggaucaaacuacguaucaugguaccaacaacuaccaggaacagcaccaaaacuacuaguauacgacaacaacgaaagaccaucaggaauaccagacagauucucaggaucaaaaucaggaacaucagcaacacuagcaauaacaggacuacaaacaggagacgaagcagacuacuacugcgcaacaugggcaccaagacuaaacucagcaagaguauucggaaacggaacaaugguaacaguacua

SEQ ID NO: 48265 - RNA, 324 nt, Artificial Sequence
  derived and/or modified sequence opt6 from anti-HIV_119-068202_VR-Chain
caaagcguacuaacacaagaaccaucaguaucaggagcaccaggacaaagaguaacaauaucaugcacaggaucaaacucaaacauaggaggacacgauguacauugguaucaacaacuaccaggaacagcaccaaaauuauuaauauacgauaacgauaaaagaccaucaggaauaccagauagauuuagcggaagcaaaagcgauacaucagcaucacuaggaauaacaggauuacaaacaggagaugaagcagacuauuacugugaaacaugggauggaucaggaggaguauuuggaacaggaacaaaaguaacaguacua

SEQ ID NO: 48266 - RNA, 324 nt, Artificial Sequence
  derived and/or modified sequence opt6 from anti-HIV_119-068063_VR-Chain
caaagcgcacuaacgcaaccaccaucagcaucaggaucacuaggacaaucaguaacaauaucaugcacaggaacaagaucagacguaggaaauuacuauguaucaugguaucaacaacuaccaggaacagcaccaaaauuacuaauaagcgaaaacaauagaagaccaucaggaacaccagauagauuuagcggaagcaaaagcggaacaucagcaacacuagcaauaucaggauuacaaacaggagaugaagcagacuauuacuguggaacaugggauggaucaggaggaguauuuggaacaggaacaaaaguaacaguacua

SEQ ID NO: 48267 - RNA, 333 nt, Artificial Sequence
  derived and/or modified sequence opt6 from anti-HIV_119-067980_VR-Chain
caaucaguauuaacacaaccaccaagcguaagcgcagcaccaggacaaaaaguaacaauaagcuguagcggaaacucaaguaauauaggaaacaauuucguaagcugguaccaacaaguaccaggaacagcaccaaaacuauuaguauaugaaacauacagaagaccaagcggaauaccagacagauucucaggaucaaaaucaggaacaagcgcaacauuagcaauaacaggacuacaaacaggagacgaagcagauuaccauugcgcaauauggggaguaagaaaaggaguaggagcaguauuuggaacaggaacaaaaguaacaguagua

SEQ ID NO: 48268 - RNA, 324 nt, Artificial Sequence
  derived and/or modified sequence opt6 from anti-HIV_119-067866_VR-Chain
caaucaguacuaacacaaccaccaucaguaucagcagcaccaggacaaaaaguaacaauaucaugcucaggaucaacaucaacaauaggaaacaacuacguaucaugguaccaacaccuaccaggaacagcaccaaaauuacuaauauacgacaacaacaaaagaccagcaggaauaccagacagauucacagcaagcaaaucaggaacaucagcaacacuagcaauaacaggacuacacacaggagacgaagcagacuacuacugcgaaacaugggacggaucaggaggaguauucggaacaggaacaaaaguaacaguacua

SEQ ID NO: 48269 - RNA, 321 nt, Artificial Sequence
  derived and/or modified sequence opt6 from anti-HIV_119-067756_VR-Chain
caaucaguacuaacacaaccaccaucaguaucagcagcaccaggacaaaaaguaguaauaucaugcucaggaucaacaucaaacauaggaaaaaacuucguaagcugguaccaacaacuaccaggaacagcaccaaaacuacuaauauacgaaaacucaagaagaccaucaggaauaccagacagauucucaggagcaaaaucaggaacaucagcaacacuagcaauaacaggacuacaaacaggagacgaagcagacuacuucugcucaacauggucaggaucauuaaacuucggaacaggaacaagaguaacaguacua

SEQ ID NO: 48270 - RNA, 321 nt, Artificial Sequence
  derived and/or modified sequence opt6 from anti-HIV_119-066859_VR-Chain
caaucaguauuaacacaaccaccaucaguaucagcagcaccaggacaaaaaguaacaauaacaugcucaggaucagcaucaaacauagaaaacaacuacguaucaugguaccaacaauucccaggaccagcaccaaaacuacuaauauacgaaaacgacaaaagaccauccggaauaccagacagauucucaggaucagcaucaggaacaucagcaacacuagcaauaacaggacuacaaacaggagacgaagcagacuacuucugcucaacauggucaggaucacuaaacuucggaacaggaacaagaguaacaguacua

SEQ ID NO: 48271 - RNA, 333 nt, Artificial Sequence
  derived and/or modified sequence opt6 from anti-HIV_119-065821_VR-Chain
caaucaguauuaacacaaccaccaagcguaagcgcaacaccaggacaaagaguaacaguaagcuguagcggaagcucaagcaauauaggaaaccauuacguaagcugguaccaacaaguaccaggaacagcaccaaaacuauuaauauaugacaauagcaauagaccaagcggaauaccagacagauucucaggaucaaaaucaggaacaagcgcaacauuaggaauaacaggacuacaaacaggagacgaagcagauuacuauugcacaguauggggaguaagaaaaggaguaggagcaguauuuggaacaggaacaaaaguaacaguacua

SEQ ID NO: 48272 - RNA, 333 nt, Artificial Sequence
  derived and/or modified sequence opt6 from anti-HIV_119-065191_VR-Chain
caaucaguacuaacacaaccaccaucagucucagcagcaccaggacaaaaaguaacaauaucaugcucaggaaacaacucaaacauaggaaacaacuacguaucaugguaccaacaacuaccaggaacagcaccaaaacuauuaauauucgaaaaccacaaaagaccaucaggaauaccagacagauucagcggaucaaaaucaggaacaucagcaacacuaggaauaacaggacuacaaucaggagacgaagcagacuacuacugcgcaacaugggcaccaagacuaaacucagcaagaguauucggaacaggaacaaaaguaacaguacua

SEQ ID NO: 48273 - RNA, 333 nt, Artificial Sequence
  derived and/or modified sequence opt6 from anti-HIV_119-064667_VR-Chain
caaucaguacuaacacaaccaccaucaguaucagcagcaccaggacaaaaaguaacaauaucaugcucaggaucaaacucauacauaggaaacaaauacguaucaugguaccaacaaguaccaggaacagcaccaaaacuauuaauauacgaaaacaacaaaagaccaucaggaauaccagacagauucucaggaucaaaaucaggaacaucagcaacauuaguaauaacaggacuacaaacaggagacgaagcagacuucuacugcggaacaugggacggaucacuaagaacaggaggaguaauaggaacaggaacaagaguaacaguacua

SEQ ID NO: 48274 - RNA, 324 nt, Artificial Sequence
  derived and/or modified sequence opt6 from anti-HIV_119-063791_VR-Chain
caaucaguacuaacacaaccaccaucaguaucagcagcaccaggacaaaaaguaccaauaucaugcucaggaaacucaucaaacauaggaaacaacuacguaucaugguaccaacaacuaccaggaacagcaccaaaacuauuaauauacgaaaacaacaaaagaccaucaggaauaccagacagauucucaggaucaaaaucaggaacaucagcaacacuagcaauaacaggacuacacacaggagacgaagcagacuacuacugcgaaacaugggacggaucaggaggaguauucggaacaggaacaaaaguaacaguacua

SEQ ID NO: 48275 - RNA, 333 nt, Artificial Sequence
  derived and/or modified sequence opt6 from anti-HIV_119-062989_VR-Chain
caaucaguauuaacacaaccaccaagcguaagcgcagcaccaggacaaagaguaacaauaagcuguagcggaagcucaucaaauauaggaaacaauuucguaagcugguaccaacaauuuccaggaacaguaccaaaacuauuaauauaugaaaauaacagaagaccaagcggaauaccagacagauucaguggaucaaaaucaggaacaagcgcaacauuagcaauaacaggacuacaaacaggagacgaagcagauuacuauugcgcaguauggggaguaagaagaggaguaggagcaguauuuggagcaggaacaaaaguaauaguacua

SEQ ID NO: 48276 - RNA, 321 nt, Artificial Sequence
  derived and/or modified sequence opt6 from anti-HIV_119-062286_VR-Chain
caaucaguauuaacacaaccaccaagcguaagcgcagcaccaggacaaaaaguaacaauaagcuguagcggaagcgcaagcaauauaggaaaaaauuucguaagcugguaccaacaauuaccaggaacagcaccaaaacuauuaauaucagaaaauaacagacgaccaagcggaacaccagacagauucucaggaucaaaaucaggagcaagcgcaacauuaguaauaagcggacuacaaacaggagacgaagcagauuacuauugcgcaacauggagcggaagcuuaagcauaggaacaggaacaaaaguaacaguacua

SEQ ID NO: 48277 - RNA, 321 nt, Artificial Sequence
  derived and/or modified sequence opt6 from anti-HIV_119-061416_VR-Chain
caaucaguacuaacacaaccaccaucaguaucagcagcaccaggacaaaaaguaguaauaucaugcucaggaagcucaucaauauucgaaaaaaacucaauaucaugguaccaacaaggaccaggagcagcaccaaaacuacuaauauacgaaaacgacaaaagaagaucaggaauaccagacagauucucaggaucaaaaucagcaacaucaacaacacuagcaauaguaggacuacaaacaggagacgaagcagacuacuucugcucaacauggucaggaucacuaaacuucggaacaggaacaagaguaacaguacua

SEQ ID NO: 48278 - RNA, 321 nt, Artificial Sequence
  derived and/or modified sequence opt6 from anti-HIV_119-061344_VR-Chain
caaucaguacuaacacaaccaccaucaguaucagcagcaccaggacaaaaaguaacaauaucaugcucaggaucaucaucaguauucggaaaaaacuacguaucaugguaccaacaccuaccaggaacagcaccaaaacuacuaauauacgaaaacaacaaaagaccaucaggaauaccagacagauucucaggagcaaaaucaggaacagcagcaacacuagcaauaacaggacuacaaacaggagacgaagcagacuacuacugcgcaacauggucaggaucacuaaacuucggaacaggaacaaaaguaacaguacua

SEQ ID NO: 48279 - RNA, 324 nt, Artificial Sequence
  derived and/or modified sequence opt6 from anti-HIV_119-060240_VR-Chain
caaucaguauuaacacaaccaccaucagaauacggagcaccaggacauaacguaacaguaagcuguagcggaacaacaagcaauauagaaaacaauuucguaagcugguacuuaauaguaccaggaacagcaccaaaacuauuaauauuugacaaugacaaaagaccaagcggaauaccagacagauucucaggaucaaaaucaggaacaagcgcaacauuagcaauaacaggacuacaaacaggagacgaagcagauuacuauugcgcaacaugggacggaagaguaagcguaauaggaacaggaacaaaaguaacaguauua

SEQ ID NO: 48280 - RNA, 333 nt, Artificial Sequence
  derived and/or modified sequence opt6 from anti-HIV_119-060184_VR-Chain
caaucaguacuaacacaaccaccaucaguaucaggagcaccaggacaaagaguaacaauaucaugcucaggaucaucaucaaauauaggaucaaacacaguaaacugguaccaacaacuaccaggaacagcaccaaaauuacuaauauacgacaacaacaaaagaccaucaggaauaccagacagauucucaggaucaaaaucaggaacaucagcaacauuaguaauaacaggacuacaaacaggagacgaagcagacuucuacugcggaacaugggacggaucacuaagaacaggaggaguaauaggaacaggaacaagaguaacaguacua

SEQ ID NO: 48281 - RNA, 321 nt, Artificial Sequence
  derived and/or modified sequence opt6 from anti-HIV_119-058035_VR-Chain
caaucaguacuaacacaaccaccaucaguaucagcagcaccaggacaaaaaguaacaauaucaugcucaggaucagcaucaaacauaggaaaaaacuucguaucaugguaccaacaauuaccaggaacagcaccaaaacuacuaauauacgaaaacaacagaagaccaucaggaaccccagacagauucucaggagcaaaaucaggaacaucagcaacacuagcaauaacaggacuacaaacaggagacgaagcagacuacuucugcucaacauggucaggaucacuaaacuucggaacaggaacaagaguaacaguacua

SEQ ID NO: 48282 - RNA, 321 nt, Artificial Sequence
  derived and/or modified sequence opt6 from anti-HIV_119-057858_VR-Chain
caaucaguauuaacacaaccaccaucaguaucagcagcaccaggacaaaacguaaacauaucaugcucaggaggaucaucaaacauaggaucaaacuacguaucaugguaccaacaauucccaggaacagcaccaaaacuacuaauauacgaaaacaacaaaagaccaucaggaauaccagacagauucucaggagcaaaaucaggaacaucagcaacacuagcaauaacaggacuacaaacaggagacgaagcagacuacuucugcucaacauggucaggaucacuaaacuucggaacaggaacaagaguaacaguacua

SEQ ID NO: 48283 - RNA, 324 nt, Artificial Sequence
  derived and/or modified sequence opt6 from anti-HIV_119-057473_VR-Chain
caaagcguacuaacacaaccaccaucaguaucagcagcaccaggacaaaaaguaacaauaucaugcucaggaucaagcucaaacauaggaaauaacuauguaucaugguaucaacaucuaccaggaacagcaccaaaauuacuaauauacgauacauauaguagaccaucaggaauaccagauagauuuagcggaagcaaaagcggaacaucagcaacacuagcaauaacaggauuacaaacaggagaugaagcagacuauuacuguggaacaugggauggaucaggaggaguauuuggaacaggaacaaaaguaacaguacua

SEQ ID NO: 48284 - RNA, 321 nt, Artificial Sequence
  derived and/or modified sequence opt6 from anti-HIV_119-057090_VR-Chain
caaucaguacuaacacaaccaccaucaguaucagcagcaccaggacaaacaguaacaauaucaugcucaggaucaacaucaaacauaggaaaaaacgacguaucaugguaccaacaacuaccaggaacagcaccaaaacuacuaauaucagaaaacaacagaagaccaucaggaacaccagacagauucagcgcaucaaaaucaggaacauccgcaacacuagcaauaacaggacuacaaacaggagacgaagcagacuacuucugcucaacauggucaggaucauuaaacuucggaacaggaacaagaguaacaguacua

SEQ ID NO: 48285 - RNA, 333 nt, Artificial Sequence
  derived and/or modified sequence opt6 from anti-HIV_119-055754_VR-Chain
caaucaguacuaacacaaccaccaucaguaucagcagcaccaggacaaaaaguaacaauaucauguucaggaaacucaucaucaauaggaaacaacuucguaucaugguaccaacaacuaccaggaacagcaccaaaacuacuaguauacgaaaauuacagaagaccaucaggaauaccagacagauucucaggaucaaaaucaggaacaucagcaacacuagcaauagacggacuacaaacaugggacgaagcagacuaccacugcgcaauauggggaguaagaaaaggaguaggagcaguauucggaacaggaacaaaaguaacaguagua

SEQ ID NO: 48286 - RNA, 324 nt, Artificial Sequence
  derived and/or modified sequence opt6 from anti-HIV_119-054899_VR-Chain
caaucaguacuaacacaaccaccaucaguaucagcagcaccaggacaaaaaguaacaauaucaugcucaggaucaaacucauacauaggaaacaaauacguaucaugguaccaacaauucccaggaacagcaccaaaacuacuaauacacgaaaacaacagaagaccaucaggaacaccagacagauucucaggaucaaaaucaggaacaucagcaacacuagcaauaucaggacuacaaacaggagacgaagcagacuacuacugcgaaacaugggacggaucaggaggaguauucggaacaggaacaaaaguaacaguacua

SEQ ID NO: 48287 - RNA, 324 nt, Artificial Sequence
  derived and/or modified sequence opt6 from anti-HIV_119-054501_VR-Chain
caaucaguacuaacacaaccaccaucaguaucagcagcaccaggacaaaaaguaacaauaucaugcucaggaacaucaucaaacauaggaaacaacuacguaucaugguaccaacaccuaccaggaacagcaccaaaacuacuaauauucgaaacaaacaaaagaccaucaggaauaccagacagauucucagcaucaaaaucaggaacaucagcaacacuagcaauaacaggacuacaaacaggagacgaagcagacuacuacugcgaaacaugggacggaucaggaggaguauucggaccaggaacaagaguaacaguauua

SEQ ID NO: 48288 - RNA, 324 nt, Artificial Sequence
  derived and/or modified sequence opt6 from anti-HIV_119-051867_VR-Chain
caaagcguacuaacacaaccaccaucaguaucagcagcaccaggacaaaaaguaacaauaucaugcucaggaaacucaucaaacauaggaaacaacuucauaucaugguaccaacaacuaccaggaacagcaccaaaacuauuaauauacgaaaacgacagaagaccaucaggaacaccagacagauucucaggaucaaaaucaggaacaucagcaacacuagcaauaacaggacuacaaacaggagacgaagcagacuacuacugcgaaacaugggacggaucaggaggaguauucggaacaggaacaaaaguaacaguacua

SEQ ID NO: 48289 - RNA, 324 nt, Artificial Sequence
  derived and/or modified sequence opt6 from anti-HIV_119-051814_VR-Chain
caaucaguacuaacacaaccaccaucaguaucagcagcaccaggacaaaaaguaacaauaucaugcucaggaucaaacucaaacauaggaaacaaagacguaucaugguaccaacaaauaccagcaacagcaccaaaacuacuaauauacgaaaacaacaaaagaccaucaggaauaccagacagauucucaggaucaaaaucaggaacaucagcaacacuagcaauaacaggacuacaaacaggagacgaagcagacuacuacugcgcaacaugggacggaagaguaucaguaauaggaacaggaacaaacguaauaguacua

SEQ ID NO: 48290 - RNA, 321 nt, Artificial Sequence
  derived and/or modified sequence opt6 from anti-HIV_119-051567_VR-Chain
caaucaguacuaacacaaccaccaucaguaucagcagcaccaggacaaaaaguaacaauauacugcucaggaucaagaucaaacauaggaagaaacuacgcaucaugguaccaacaacuaccaggaacagcaccaaaacuacuaauauucgacaacaacagaagaccaucaggaauaccagacagauucucaggagcaaaaucaggaacaucagcaacacuagcaauaacaggacuacaaacaggagacgaagcagacuacuucugcucaacauggucaggaucacuaaacuucggaacaggaacaagaguaacaguacua

SEQ ID NO: 48291 - RNA, 324 nt, Artificial Sequence
  derived and/or modified sequence opt6 from anti-HIV_119-051483_VR-Chain
caaucaguacuaacacaaccaccaucaguaucagcagcaccaggacaaaaacuaacaauaucaugcucaggaacaucaucaaacauaggaaacaacuacguaucaugguaccaacaccuaccaggaacagcaccaaaacuacuaauauacgaaaacaacagaagaccaucaggaauaccagaaagauucucagcaucaaaaucaggaacaucagcaacacuaggaauaacaggacuacaaacaggagacgaagcagacuacuacugcgaaacaugggacgacucaggaggaguauucggaacaggaacaaaaguaacaguacua

SEQ ID NO: 48292 - RNA, 333 nt, Artificial Sequence
  derived and/or modified sequence opt6 from anti-HIV_119-050913_VR-Chain
caaucaguauuaacacaaccaccaagcguaagcgcagcaccaggacaaaaaguaacaauaagcuguaguggaggaacaagcaauauaggaaacaauuacguaagcugguaccaacaauuaccaggaacagcaccaagacuauuaauauaugaaacaaacaaaagaccaagcggaauaccagacagauucuuuggaucaaaaucaggaacaagcgcaacauuagcaauaagcggacuacaaacaggagacgaagcagauuacuauugcacaguauggggaguaagaaaaggaguaggagcaguauuuggaacaggaacaaaaguaacaguauua

SEQ ID NO: 48293 - RNA, 333 nt, Artificial Sequence
  derived and/or modified sequence opt6 from anti-HIV_119-050187_VR-Chain
caaucaguacuaacacaaccaccaucaguaucagcagcaccaggacaaaaaguaacaauaucaugcucuggaucaucaucaaacauaggaaaaaacucaguaucaugguaccaacaauucccaggaacagcaccaaaacuacuaauauacgaaaacaacaaaagaccaucaggaauaccagacagauucucagacucacaaucaggaacaucagcaacacuagcaauaacaggacuacaaacaggagacgaagcagacuacucaugcgcaacaugggcagcaucacuaaacucagcaagaguauucggaacaggaacaagaguaacaguacua

SEQ ID NO: 48294 - RNA, 324 nt, Artificial Sequence
  derived and/or modified sequence opt6 from anti-HIV_119-049069_VR-Chain
caaagcguacuaacacaaccaccaucaguaucagcagcaccaggacaaaaaguaacaauaucaugcucaggaucaacaucaaacauaggaaaaagcgauguauuuugguaucaacaacuaccaggaacagcaccaaaauuacuaauaagcgaaacaucaagaagaccaucaggaacaccagacagauuuagcggaagcaaaagcggaacaucagcaacacuaacaauaacaggauuacaaacaggagaugaagcagacuauuacugugaagcaugggacggaucaggaggaguauuuggaacaggaacaaaaguaacaguacua

SEQ ID NO: 48295 - RNA, 333 nt, Artificial Sequence
  derived and/or modified sequence opt6 from anti-HIV_119-048517_VR-Chain
caaucaguauuaacacaaccaccaagcguaagcgcagcaccaggacaaaaaguaacaauaagcuguagcggaagcaaauucaauauaggaaacaaagacguaaguugguaccaacacucaccaggaacagcaccaaaacuauuaauauaugaaaauaacaaaagaccaagcggaauaccagacagauucucaggaucaaaaucaggaacaagugcaacauuaggaauaagcggacuacaaacaggagacgaagcagauuacuguugcgcaguauggggaguaagaagaggagcaggagcaguauuuggagcaggaacaaaaguaacaguacua

SEQ ID NO: 48296 - RNA, 333 nt, Artificial Sequence
  derived and/or modified sequence opt6 from anti-HIV_119-048470_VR-Chain
caaucaguauuaacacaaccaccaagcguaagcgcagcaccaggacaaaaaguaacaauaagcuguagcggaagcacaagcaauauaggaaaaaaucuaguaagcugguaccaacaauuuccaggaacagcaccaaaacuauuaauauaugaaaauaacagaagaccaagcggaauaccagacagauucucaggaucaaaaucaggaacaagcgcaacauuaguaauaacaggacuacaaacaggagacgaagcagauuucuauugcggaacauggggaggaucacuaagagcaggaggaguaauaggaacaggaacaagaguaacaguacua

SEQ ID NO: 48297 - RNA, 282 nt, Artificial Sequence
  derived and/or modified sequence opt6 from anti-HIV_119-048303_VR-Chain
ucaguacuaacacaaccaccaucaguaucagcagcaccaggacaaaacauaacaauaucaugcucaggaucaauaucaaacauagcaucaaacuucauaucaugguaccaacaacuaccaggaacagcaccaaaaauaauaauauacgacaacgaccaaagaccacuaggaauaccagcaagauucucaggaucaaaaucaggagcaucagcaacacuaguaauaacaggacuacaaacaggagacgaagcagacuacuacugcggaacaugggacggauca

SEQ ID NO: 48298 - RNA, 333 nt, Artificial Sequence
  derived and/or modified sequence opt6 from anti-HIV_119-048021_VR-Chain
caaucaguacuaacacaaccaccaucaguaucagcagcaccaggacaaaaaguaacaauaucaugcucaggaucaagcucaaacauaggaaacaacuacguaucaugguaccaacaacuaccaggaacagcaccaaaacuacuaauauacgacaacaacaaaagaccaucaggaauaccagacagauucucaggaucaaaaucaggaacaagcgcaacauuaguaauaacaggacuacaaacaggagacgaagcagacuucuacugcggaacaugggacggaucacuaucaggaggaggaguaauaggaacaggaacaagaguaacaguacua

SEQ ID NO: 48299 - RNA, 324 nt, Artificial Sequence
  derived and/or modified sequence opt6 from anti-HIV_119-047928_VR-Chain
caaagcguacuaacacaaccaccaucaguaucagcagcaccaggacaaaaaguaacaauaucaugcucaggaucaaacucaaacauaggaaacaacugcguaucaugguaccaacaaguaccaggaacagcaccaaaacuacuaauauacgaaaacaacagaagaccaucaggaauaccagacagauucucaggaucaaaaucaggaacaucagcaacacuagcaauaucaggacuacaaacaggagacgaagcagacuacuacugcggaacaugggacggaucaggaggaguauucggaacagcaacaaaaguaacaguacua

SEQ ID NO: 48300 - RNA, 324 nt, Artificial Sequence
  derived and/or modified sequence opt6 from anti-HIV_119-047384_VR-Chain
caaucaguacuaacacaaccaccaucaguaucagcagcaccaggacaaaaaguaacaauaucaugcucaggaucaaacucaaacauaggaaacaaagacguaucaugguacagacaaguaccaccaacagcaccaaaacuacuaauauacgaaaacaacaaaagaccaucaggaauaccagacagauucucaggaucaaaaucaggaacaucagcaacacuagcaauaacaggacuacaaacaggagacgaagcagacuacuacugcgcaacaugggacggaagaguaucaguauucggaacaggaacaaaaguagcaguacua

SEQ ID NO: 48301 - RNA, 333 nt, Artificial Sequence
  derived and/or modified sequence opt6 from anti-HIV_119-047145_VR-Chain
caaucaguacuaacacaaccaccaucaguaucagcagcaccaggacaaacaguaaacauaucaugcucaggaucaaacucaaacauaggaucaaaauacguaucaugguaccaacacuucccaggaacagcaccaaaacuacuaauauacgaaaacaacaaaagaucaucaggaauaccagacagauucucaggaucaaaaucagcaacaucagcaacacuagcaauaacaggacuacaaacaggagacgaagcagacuacuacugcgcaacaugggcaccaucacuaaacucagcaagaguauucggaacaggaacaaaaguaacaguacua

SEQ ID NO: 48302 - RNA, 333 nt, Artificial Sequence
  derived and/or modified sequence opt6 from anti-HIV_119-046752_VR-Chain
caaucaguacuaacacaaccaccaucaguaucagcagcaccaggacaaaaaguaacaauaucaugcucaggaaacucaucaucaauaggaaacaacuucguaucaugguaccaacaacuaccaggaacagcaccaaaacuauuaguauacgaaaacuacagaagaccaucaggaauaucagacagauucucaggaagcaaaucaggaacaucagcaacacuagcaauaacaggacuacaaacaggagacgaagcagacuacuacugcacaguauggggaguaagaaaaggaguaggagcaguauucggaacaggaacaaaaguaacaguauua

SEQ ID NO: 48303 - RNA, 324 nt, Artificial Sequence
  derived and/or modified sequence opt6 from anti-HIV_119-046660_VR-Chain
caaucaguacuaacacaaccaccaucaguaucagcagcaccaggacaaaaaguaacaauaucaugcucaggaucaucaucaaacauaggaaaccacuacguaucaugguaccaacaacuaccaggaacagcaccaaaacuacuaauauacgacaacaacaaaagaccaucaggaauaccagacagauucucagcaucaaaaucaggaacaucagcaacacuaggaauaacaggacuacaaacaggagacgaagcagacuacuacugcgcaacaugggacggaagaguaucaguaauaggaacaggaacaaaaguaacaguagua

SEQ ID NO: 48304 - RNA, 333 nt, Artificial Sequence
  derived and/or modified sequence opt6 from anti-HIV_119-046202_VR-Chain
caaucaguacuaacacaaccaccaucaguaucagcagcaccaggacaaaaaguaacaauaucauguucaggaucaucaucaaauauaggaaacaauuacguaucaugguaccaacaauuaccaggaacagcaccaaaacuauuaguauacgaaaauuaccgaagaccaucaggaauaccagacagauucucaggaucaaaaucaggaacaucagcaacacuagcaauaacaggacuacaaacaggagacgaagcagacuaccacugcgcaauauggggaguaagaaaaggaguaggagcaguauucggaacaggaacaaaaguaacaguagua

SEQ ID NO: 48305 - RNA, 333 nt, Artificial Sequence
  derived and/or modified sequence opt6 from anti-HIV_119-045790_VR-Chain
caaucaguauuaacacaaccaccaagcguaagcgcagcaccaggacaaaaaguaacaauaagcuguagcggaucaucaagcaauauaggaaacaauuacguaaguugguaccaauacuuaccaggaacagcaccaaaacuauuauucuaugaagauaacagaagaccaagcggaacaccagacagauucucaggaucaaaaucaggaacaagcgcaacauuagcaauaagcggacuacaaacaggagacgaagcagauuacuauugcacaauauggggaguaagaaaaggaguaggagcaguauuuggaacaggaacaaaaguaacaguacua

SEQ ID NO: 48306 - RNA, 333 nt, Artificial Sequence
  derived and/or modified sequence opt6 from anti-HIV_119-044670_VR-Chain
caaucaguacuaacacaaccaccaucaguaucaggagcaccaggagaaagaguaacaauaucaugcacaggaaacacaucaaauauaggaacauacgacguacaaugguaccaacaccuaccaggaacagcaccaagacuauuaauauaccacaacguaaaucuaccaucaggaguaccagacagauucucagcaucaaaaucaggaacaucagcaacacuagcaauaacaggacuacaaacaggagacgaagcagacuacuacugcacaauauggggaguaagaaaaggaguaggagcaguauucggaacaggaacaaaaguaacaguacua

SEQ ID NO: 48307 - RNA, 321 nt, Artificial Sequence
  derived and/or modified sequence opt6 from anti-HIV_119-044140_VR-Chain
caaucaguacuaacacaaccaccaucaguaucagcagcaccaggacaaaaaguaacaauaucaugcucaggaggaacaucaaacauaggaaaccacuucguaucaugguacagacaccuaccaggaacagcaccaaaacuacuaauauacgaaaacaacaacagaccaucaggaauaccagacagauucucaggagcaaaaucaggaacaagcgcaacacuagcaauaacaggacuacaaacaggagacgaaggagacuacuacugcgcaacauggucaggaucacuaaacauaggaacaggaacaaaaguaacaguacua

SEQ ID NO: 48308 - RNA, 333 nt, Artificial Sequence
  derived and/or modified sequence opt6 from anti-HIV_119-042776_VR-Chain
caaucaguauuaacacaaccaccaagcguaagcgcagcaccaggacaaaaaguaacaauaagcuguagcggaagcucaagcaauauaggaaacaauuacguaagcugguaccaacacuuaccaggaacagcaccaaaacuauuaauauaugaaucagcaagaagaccaagcggaacaccagacagauucucaggaucaaaaucaggaacaagcgcaacauuagcaauaacaggacuacaaacaggagacgaagcagauuacuauugcacacuauggggaguaagaaaaggaguaggagcaguauuuggaacaggaacaagaguaacaguacua

SEQ ID NO: 48309 - RNA, 333 nt, Artificial Sequence
  derived and/or modified sequence opt6 from anti-HIV_119-042581_VR-Chain
caaucaguauuaacacaaccaccaagcguaucagcagcaccaggacaaaaaguaacaauaagcuguagcggaagcucaaguaauauaggaaacaauuucguaagcugguaccaacaauuaccaggaacagcacccaaacuauuaauauuugaaacacacagaagaccaaguggaauaccagacagauucucaggaucaaaaucaggaacaagcgcaacauuagcaauaacaggacuacaaagcggagacgaagcagauuacuauugcgcaguauggggaguaagacaaggagcaggagcaguauuuggaacaggaacaaaaguaacaguacua

SEQ ID NO: 48310 - RNA, 333 nt, Artificial Sequence
  derived and/or modified sequence opt6 from anti-HIV_119-040905_VR-Chain
caaucaguacuaacacaaccaccaucaguaucagcagcaccaggacaaaaaguaacaauaucaugcucaggaaacucaucaaacauaggagacaacuucguaucaugguaccaacaauuaccaggaauagcaccaaaacuauuaguauacgaaacaaacaaaagaccaucaggaauaccagacagauucgcaggcucaaaaucaggaacaucagcaacauuaguaauaacaggacuacaaacaggagacgaagcagacuucuacugcggaacaugggacggaucacuaagaacaggaggaguaauaggaacaggaacaagaguaacaguacua

SEQ ID NO: 48311 - RNA, 321 nt, Artificial Sequence
  derived and/or modified sequence opt6 from anti-HIV_119-040322_VR-Chain
caaucaguacuaacacaaccaccaucaguaucagcagcaccaggacaaaaaguaguaauaucaugcucaggaucaucaucaauaauagaaaaaaacucaauaucaugguaccaacaaggaccaggagcagcaccaaaacuacuaauauacgaaaacgacaaaagaccaucaggaauaccagacagauucucaggaucaaaaucaggaacaacaggaacauuagcaauaacaggacuacaaacaggagacgaagcagacuacuucugcgcaacauggucaggaagacuaaacauaggaacaggaacaaaaguaacaguacua

SEQ ID NO: 48312 - RNA, 324 nt, Artificial Sequence
  derived and/or modified sequence opt6 from anti-HIV_119-039892_VR-Chain
caaucaguauuaacacaaccaccaucaguaucagcagcaccaggacaaaaaguaacaauaucaugcucaggaucaaacgcaaacauaggaaacaaagacguaucaugguaccaacaacuaccagcaacagcaccaaaacuacuaauauacgaaucaaacaaaagaccaucaggaauaccagacagauucucaggaucaaaaucaggaacaucagcaacacuagcaauaacaggacuacaaacaggagacgaagcagacuacuacugcgcaacaugggacggaagaguaucaggaauaggaacaggaacaaaaguaacaguacua

SEQ ID NO: 48313 - RNA, 324 nt, Artificial Sequence
  derived and/or modified sequence opt6 from anti-HIV_119-039764_VR-Chain
caaucaguacuaacacaaccaccaucaguaucagcagcaccaggacaaaaaguaacaauaucaugcucaggaucagcaucaaacauaggaaaaaacuucguaucaugguaccaacaaguaccaggaacagcaccaaaacuacuaauauacgaaaacaacagaagaccaucaggaacaccagacagauucucaggaucaaaaucaggaacaucaggaacacuagcaauaucaggacuacaaacaggagacgaagcagacuacuacugcgaaacaugggacggaagcggaggaguauucggaacaggaacaaaaguaacaguacua

SEQ ID NO: 48314 - RNA, 333 nt, Artificial Sequence
  derived and/or modified sequence opt6 from anti-HIV_119-039188_VR-Chain
caaucaguauuaacacaaccaccaaguuuaaguggagcaccaggacaaacaguaacaauaagcuguagcggaagcucaagcaauauaggaaacaauuacguaagcugguaccaacaauuaccaggaacagcaccaaaacuauuaauauaugacucaaacagaagaccaagcggaauaccagacagauucucaggaucaaaaucaggaacaagcgcaacauuagcaauaagcggacuacaaacaggagacgaagcagauuacuguugcgcaguauggggaguaagaagaggagcaggagcaguauuuggagcaggaacaaaaguaacaguacua

SEQ ID NO: 48315 - RNA, 321 nt, Artificial Sequence
  derived and/or modified sequence opt6 from anti-HIV_119-039058_VR-Chain
caaucaguacuaacacaaccaccaucaguaucaggagcaccaggacaaagaguaacaauaucaugcacaggaucaucaucaaacauaggaaacaacuacguaucaugguacagaagacuaccaggaacagcaccaaaacuacuaauauacgaaaacaacaaaagaccaucaggaauaccagacagauucucaggagcaaaaucaggaacaucagcaacauuagcaauaacaggacuacaaacaggagacgaagcagacuacuucugcucaacauggucaggaucacuaaacuucggaacaggaacaagaguaacaguacua

SEQ ID NO: 48316 - RNA, 321 nt, Artificial Sequence
  derived and/or modified sequence opt6 from anti-HIV_119-038837_VR-Chain
caaucaguacuaacacaaccaccaucaguaucagcagcaccaggacaaaaaguaacaauaucaugcucaggaggaacaucaaacauaggaaacaacuucguaucaugguaccaacacuuaccaggaacagcaccaaaacuacuaauauuugaaaacaacaaaagaccaucaggaguaccagacagauucucaggagcaaaaucaggaacaucagcaacacuagcaauaacaggacuacaaacaggagacgaaggagacuacuacugcgcaacauggucaggaucacuaaacauaggaacaggaacaaaaguaacaguacua

SEQ ID NO: 48317 - RNA, 321 nt, Artificial Sequence
  derived and/or modified sequence opt6 from anti-HIV_119-038396_VR-Chain
caaucaguacuaacacaaccaccaucaguaucagcaacaccaggacaaaaaguaacaauaucaugcuccggaucaaacucaaacauaggaaacaaauacguaucaugguaccaacuauucccaggaacagcaccaaaauuacuaauaucagaaaacaacagaagaccaucaggaacaccagacagauucucaggaucaaaaucaggaacaucagcaacacuagcaauaacaggacuacaaacaggagacgaagcagacuacuacugcgcaacauggucaggaucacuaaacauaggaacaggaacaaaaguaacaguacua

SEQ ID NO: 48318 - RNA, 321 nt, Artificial Sequence
  derived and/or modified sequence opt6 from anti-HIV_119-036918_VR-Chain
caaucaguacuaacacaaccaccaucaguaucagcagcaccaggacaaaaaguaacaauaucaugcucaggagcaacaucaaacauaugggaccacuacguaucaugguaccuacaaguaccaggaacagcaccaagacuauuaauauacgacaacgacaaaagaccaucaggaauaccagacagauucucaggaucaaaaucaggaacaucagcaacacuagcaauaacaggacuacaaacaggagacgaaggagacuacuacugcgcaacauggucaggaucacuaaacauaggaacaggaacaaaaguaacaguacua

SEQ ID NO: 48319 - RNA, 324 nt, Artificial Sequence
  derived and/or modified sequence opt6 from anti-HIV_119-036592_VR-Chain
caaucaguacuaacacaaccaccaagcguaagcgcagcaccaggacaaaaaguaacaauaagcuguaguggaagcaauaguaauacaggaaacaaagacguaagcugguaccaacaaguaccagcaacagcaccaaaacuacuaauauaugaaucaaacaaaagaccaagcggaauaccagacagauucucaggaucaaaaucaggaacaagcgcgacauuagcaauaacaggacuacaaacaggagacgaagcagauuacuauugcgcaauaugggacggaagaguaagcguaauaggaacaggaacaaaaguaacaguauua

SEQ ID NO: 48320 - RNA, 324 nt, Artificial Sequence
  derived and/or modified sequence opt6 from anti-HIV_119-036310_VR-Chain
caaucaguacuaacacaaccaccaucagucucagcagcaccaggacaaaaaguaacaauaucaugcuccggaucaacaucaaacauaggacaaaacuacguaucaugguaccaacaacuaccaggaacagcaccaaaacuacuaauauacgaaaacaacagaagaccaucaggaucaccagacagauucucaggaucaaaaagcggaacaucagcaacacuagcaauaacaggacuacaaacaggagacgaagcagacuacuacugcgaaacaugggacggaucaggaggaguauucggaacaggaacaaaaguaacaguacua

SEQ ID NO: 48321 - RNA, 333 nt, Artificial Sequence
  derived and/or modified sequence opt6 from anti-HIV_119-035618_VR-Chain
caaucaguauuaacacaaccaccaaguguaagugcagcaccaggacaaaaaguaacaauaagcuguagcggaagcucauucacaauaggaaacaaucacguaagcugguaccaacaauuaccaggaacagcaccaaaacuauuaauauuugaaucacacaaaagaccaagcggaguaccagacagauucucaggaucaaaaucaggaacaagugcaacauuagcaauaacaggacuacaaacaggagacgaagcagauuacuauugcacaguauggggaguaagaaaaggaguaggagcaguauuuggaacaggaacaaaaguaacaguacua

SEQ ID NO: 48322 - RNA, 321 nt, Artificial Sequence
  derived and/or modified sequence opt6 from anti-HIV_119-035569_VR-Chain
caaucaguauuaacacaaccaccaucaguaucaggagcaccaggacaaacaguaacaauaucaugcacaggaucaucaucaaacauaggaggauacgacguacacugguaccaacaauuaccaggaacagcaccaaaacuauuaauauacgaaaacaacagaagaccaucaggaacaccagacagauucucaggagcaaaaucaggaacaucagcaacauuagcaauaacaggacuacaaacaggagacgaaggagacuacuacugcgccacauggucaggaucacuaaacauaggaacaggaacaaaaguaacaguacua

SEQ ID NO: 48323 - RNA, 324 nt, Artificial Sequence
  derived and/or modified sequence opt6 from anti-HIV_119-035466_VR-Chain
caaucaguacuaacacaaccaccaucaguaucagcagcagcaggacaaaacguaaacauaagcugcucaggaaaaaaaucaaacauaggaaacaacuacguaucaugguaccaacaauucccaggaacagcaccaaaacuacuaauauacggaaacacaaacagaccaucaggaauaccagacagauucucaggaucaaaaucaggaacaucagcaacauuagcaauaacaggacuacaaacaggagacgacgcagacuacuacugcgaaacaugggacggaucaggaggaguauucggaacaggaacaaaaguaacaguacua

SEQ ID NO: 48324 - RNA, 333 nt, Artificial Sequence
  derived and/or modified sequence opt6 from anti-HIV_119-035157_VR-Chain
caaucaguacuaacacaaccaccaucaguaucagcagcaccaggacaaaaaguaacaauaucaugcucaggaucaucaucaaacauaggaaacaacuucguaucaugguaccaacaaagaccaggaacagcaccaaaacuacuaauauacgaaacaaacaaaagaccaucaggaauaccagacagauucucaggaucaaaaucaggaacaucagcaacauuagcaauaacaggacuacaaacaggagacgaagcagacuacuacugcgcaacaugggcaccaagacuaaacucagcaagaguauucggaaacggaacaaugguaacaguacua

SEQ ID NO: 48325 - RNA, 333 nt, Artificial Sequence
  derived and/or modified sequence opt6 from anti-HIV_119-035121_VR-Chain
caaucaguacuaacacaaccaccaucaguaucagcagcaccaggacaaaaaguaacaauaucaugcucaggaucaacaucauacauaggaaacaaauacguaucaugguaccaacaauuuccaggagcagcaccaaaacuacuaauauacgaaaauaacaaaagaccaucaggaauaccagacagauucucagcaagcaaaucagcaacaucagcaacacuagcaauaacaggacuacaaacaggagacgaagcagacuacugcugcgcaguauggggaguaagaagaggagcaggagcaguauucggagcaggaacaaaaguaacaguauua

SEQ ID NO: 48326 - RNA, 324 nt, Artificial Sequence
  derived and/or modified sequence opt6 from anti-HIV_119-035046_VR-Chain
caaucagcauuaacacaaccagcaagcguaagcggaagcccaggacaaaguauaacaauaagcuguacaggaacaucaagcgauguaggauacgauuacguaagcugguacagacaaguaccagcaacaacaccaaaauuauuaauauaugaaaauaacaaaagaccaagcggaauaccagacagauucucaggaucaaaaucaggaacaagcgcaacauuagcaauaacaggacuacaaacaggagacgaagcagauuacuauugcgcaacaugggacggaagaguaaguguaauaggaacaggaacaaaaguaacaguagua

SEQ ID NO: 48327 - RNA, 324 nt, Artificial Sequence
  derived and/or modified sequence opt6 from anti-HIV_119-034754_VR-Chain
caaucaguacuaacacaaccaccaucaguaucagcagcaccaggagaaaaaguaacaauaucaugcucaggaucaucaucaaacauaggaaacaacuacguaucaugguaccaacaacuaccaggaacaguaccaaaacuacuaauauacgacaacaacaaaagaccaagcggaacaccagacagauucucaggaucaaaaucaggaacaucagcaacacuagcaauaacaggacuacaaacaggagacgaagcagacuacuacugcgaaacaugggacggaucaggaggaguauucggaacaggaacaaaaguaacaguauua

SEQ ID NO: 48328 - RNA, 324 nt, Artificial Sequence
  derived and/or modified sequence opt6 from anti-HIV_119-034318_VR-Chain
caaagcguacuaacacaaccaccaucaguaucagcagcaccaggacaaaaaauaacaauaucaugcucaggaucaagcucaaacauaggaaauaacgacguaucaugguaucaacaacuaccaggaacagcaccaaaauuacuaauauacgaaaacgacagaagaccaucaggaacaccagacagauucagcggaaguaaaagcggaacaucagcaacacuagcaauaacaggacuacaaacaggagacgaagcagacuauuacugugaaacaugggacggaucaggaggaguauuuggaacaggaacaaaaguaacaguacua

SEQ ID NO: 48329 - RNA, 333 nt, Artificial Sequence
  derived and/or modified sequence opt6 from anti-HIV_119-033780_VR-Chain
caaucaguacuaacacaaccaccaagcguaucagcagcaccaggacaaagaguaacaauaagcuguagcggaacaucaagcaauauaggagaaaauuacguaagcugguaccaacaaauaccaggaacagcaccaaaacuauuaauauaugaaaauaacaaaagaccaagcggaauaccagacagauucucaggaucaaaaucaggaacaagcgcaacauuaguaauaacaggacuacaaacaggagacgaagcagauuucuauugcggaacauggggaggaaguuuaagaacaggaggaguauuaggaacaggaacaagaguaacaguacua

SEQ ID NO: 48330 - RNA, 333 nt, Artificial Sequence
  derived and/or modified sequence opt6 from anti-HIV_119-033632_VR-Chain
caaucaguauuaacacaaccaccaagcguaagcgcagcaccaggacaaagaguaacaauaagcuguagcggaggaucaagcaauauaggaagcaauuacguaagcugguaccaacaauuaccaggaacagcaccaaaacuauuaauauaucaaaauaacaaaagaccaagcggaauaccagacagauucaguggaucaaaaucaggaacaagcgcaacauuaggaauaacaggacuacaaacaggagacgaagcagauuacuauugcacaguauggggaguaagaaaaggaguaggagcaguauuuggaacaggaacaaaaguaacaguauua

SEQ ID NO: 48331 - RNA, 333 nt, Artificial Sequence
  derived and/or modified sequence opt6 from anti-HIV_119-033183_VR-Chain
caaucaguauuaacacaaccaccaagcguaagcgcagcaccaggacaaaugguaacaauaagcuguagcggaggagcaagcaaucuaggaaaaaauagcguaagcugguaccaacaauuaccaggaacagcaccaaaacuauuaauauaugaagauaacagaagaccaagcggaacaccagacagauucucaggaucaagaucaggaacaagcgcaacauuagcaauaacaggacuacaaacaggagacgaagcagauuacuauugcacaauauggggaguaagaaaaggaguaggagcaguauuuggaacaggaacaaaaguaacaguacua

SEQ ID NO: 48332 - RNA, 333 nt, Artificial Sequence
  derived and/or modified sequence opt6 from anti-HIV_119-030696_VR-Chain
caaucaguauuaacacaaccaccaagcguaucaggagcaccaggacaaauaguaacauuaucauguacaggagcaaugacaaauauaggaaacaaugacguacacugguaccaacacuuaccaggaacaggaccaaaacuauuaauauacgaaaauaacaaaagaccaucaggaauaccagacagauucucaggaucaaaaucaggaacaucagcaacauuaguaauaacaggacuacaaacaggagacgaagcagacuucuacugcggaacaugggacggaucacuaagaacaggaggaguaauaggaacaggaacaagaguaacaguacua

SEQ ID NO: 48333 - RNA, 324 nt, Artificial Sequence
  derived and/or modified sequence opt6 from anti-HIV_119-030059_VR-Chain
caaucaguacuaacacaaccaccaucaguaucagcagcaccaggacaaaaaguaguaauaucaugcucaggaucaucaucaauaauagaaaaaaacucaauaucaugguaccaacaaggaccaggagcagcaccaaaacuacuaauauacgaaaacgacaaaagaccaucaggaauaucagacagauucucaggaucaaaaucagcaacaucagcaacacuagcaauaacaggacuacacacaggagacgaagcagacuacuacugcgaaacaugggacggaucaggaggaguauucggaacaggaacaaaaguaacaguacua

SEQ ID NO: 48334 - RNA, 333 nt, Artificial Sequence
  derived and/or modified sequence opt6 from anti-HIV_119-029589_VR-Chain
caaagcguauuaacacaaccaccaagcguaagcgcagcaccaggacaaaaaguaacaauaagcuguagcggaacaucaagcaauauaggaaacaauuucguaagcugguaccaacuauuaccaggaacagcaccaagacuauuaauauaugacaauaacaaaagaccaagcggaacaccagacagauucucaggaucaaaaucaggaacaagugcaacauuaggaauaacaggacuacaaacaggagacgaagcagauuucuauugcggaacaugggacggaucauuaagaacaggaggaguaauaggaacaggaacaagaguaacaguacua

SEQ ID NO: 48335 - RNA, 324 nt, Artificial Sequence
  derived and/or modified sequence opt6 from anti-HIV_119-029448_VR-Chain
caaagcguacuaacacaaccaccaucaguaucagcagcaccaggacaaaaaguaacaauaucaugcucaggaaacagcucaaacauaggaaaaaacucaguaucaugguaucaccaacuaccaggaacagcaccaaaacuacuaauauacgaaaacgacagaagaccaucaggaacaccagacagauucagcggaagcaaaagcggaacaucagcaacacuagcaauaacaggacuacaaacaggagacgaagcagacuacuacugcgaaacaugggacggaucaggaggaguauucggaacaggaacaaaaguaacaguacua

SEQ ID NO: 48336 - RNA, 333 nt, Artificial Sequence
  derived and/or modified sequence opt6 from anti-HIV_119-029220_VR-Chain
caaucaguauuaacacaaccaccaagcguaagcgcagcaccaggacaaaaaguaacaauaagcuguagcggaagcacaagcaauauaggacaaaauuacguaagcugguaccaacaauuaccaggaacagcaccaaaacuauuaauauaugaaaaugacagaagaccaagcggaauaccagacagauucucaggaucaaaaucaggaacaucagcaacauuagcaauaagcggacuacaaacaggagacgaagcagauuacuguugcgcaguauggggaguaagaagaggagcaggagcaguauuuggaccaggaacaaaaguaacaguacua

SEQ ID NO: 48337 - RNA, 333 nt, Artificial Sequence
  derived and/or modified sequence opt6 from anti-HIV_119-028317_VR-Chain
caaucaguauuaacacaaccaccaagcguaagcgcagcaccaggacaaaaaguaacaauaagcuguagcggaagcucaagcaauauaggaaacgauuacguaagcugguaccaacaauuaccaggaacagcaccaaaauuauuaauauaugaaaauaacaaaagaccaaguggaauaccagacagauucucaggaucaaaaucaggaacaagcgcaacauuagcaauaacaggacuacaaacaggagacgaagcagauuacuauugcacaauauggggaguaagaaaaggaguaggagcaguauuuggaacaggaacaaaaguaacaguauua

SEQ ID NO: 48338 - RNA, 324 nt, Artificial Sequence
  derived and/or modified sequence opt6 from anti-HIV_119-028165_VR-Chain
caaucaguacuaacacaaccaccaucaguaucagcagcaccaggacaaacaguaacaauaucaugcucaggaauaacaucaaacauaggaaaaaacgacguaucaugguaccaacaacuaccaggaacagcaccaaaacuacuaauaucagaaaacaacagaagaccaucaggaauaccagacagauucucaggaagcaaaucaggaacaucagcaacauuagcaauaacaggacuacaaacaggagacgaagcagacuacuacugcgcaauaugggacggaagaguaucaguaauaggaacaggaacaaaaguaacaguacua

SEQ ID NO: 48339 - RNA, 324 nt, Artificial Sequence
  derived and/or modified sequence opt6 from anti-HIV_119-027147_VR-Chain
caaucaguacuaacacaaccaccaucaguaucagcagcaccaggacaaacaguaacaauaucaugcucaggaucaacaucagacauaggaaaaaacgacguaucaugguaccaacaacuaccaggaauagcaccaaaacuacuaauaucagaaaacaacagaagaccaucaggaacaccagacagauucucaggaucaaaaucaggaacaucagcaacacuagcaauaacaggacuacaaacaggagacgaagcagacuacuacugcgaaacaugggacggauccggagcaguauucggaacaggaacaaaaguaacaguacua

SEQ ID NO: 48340 - RNA, 333 nt, Artificial Sequence
  derived and/or modified sequence opt6 from anti-HIV_119-026743_VR-Chain
caaucaguacuaacacaaccaccaucaguaucagcagcaccaggacaaaacguaacaauaucaugcucaggaucaucaucaaacauaggaaacaacuucguaucaugguaccaacaaagaccaggaacaggaccaaaacuacuaauauacgaaacaaacagaagaccaucaggaauaccagacagauucucaggaucaaaaagcggaacaucagcaacacuagcaauaacaggacuacaaacaggagacgaagcagacuacuacugcgcaacaugggcaccaucacuaaacucagcaagaguauucggaacaggaacaaaaguaacaguacua

SEQ ID NO: 48341 - RNA, 333 nt, Artificial Sequence
  derived and/or modified sequence opt6 from anti-HIV_119-026508_VR-Chain
caaucaguacuaacacaaccaccaucaguaucagcagcaccaggacaaaaaguaacaauaucaugcagcggaucaucaucaacaauaggaaacaacuacauaucaugguaccaaguacuaccaggaacagcaccaaaauuaguaauauucaaaaacaacgaaagaccaucaagaguaccagacagauucucaggaucaaaaucaggaacaucagcaacacuaggaauaacaggacuacaacuaggagacgaaggagacuacuacugcggaacaugggaaacaucacuaucaggaggaggaguauucggaacaggaacaaaaguaacaguacua

SEQ ID NO: 48342 - RNA, 324 nt, Artificial Sequence
  derived and/or modified sequence opt6 from anti-HIV_119-025683_VR-Chain
caaucaguacuaacacaaccaccaucaguaucagcagcaccaggacaaaaaguaacaauaucaugcucaggaucaucaucaaacauaggaaacaacuacguaucaugguaccaacaacuaccaggaacagcaccaaaacuacuaauauacgaaaacaacaaaagaccaucaggaauaccagacagauucucagacucacaaucaggaacaucagcaacacuagcaauaacaggacuacaaacaggagacgaagcagacuacuacugcgaaacaugggacggaucaggaggaguauucggaacaggaacaaaaguaacaguacua

SEQ ID NO: 48343 - RNA, 333 nt, Artificial Sequence
  derived and/or modified sequence opt6 from anti-HIV_119-025614_VR-Chain
caaucacuauuaacacaacccccaagcguaagugcagcaccaggacaaaacguaauaauaagcuguagcggaagcucaagcaauauagguaaaaauuacguagcaugguaccaacaaguacccggaacagcaccaaaaauaguaguauuugaaacaacaaauagaccaagcggaauaccagacagauucaguggaucaaaaucaggaacaagcgcaacauuagcaauaacaggacuacaaaccggagacgaagcagauuacuauugcacaguauggggaguaagaaaaggaguaggagcaguauuuggaacaggaacaaaaguaacaguacua

SEQ ID NO: 48344 - RNA, 324 nt, Artificial Sequence
  derived and/or modified sequence opt6 from anti-HIV_119-025548_VR-Chain
caaagcauacuaacacaaccaccaucaguaucagcagcaccaggacaaaaaguaacaauaucaugcucaggaucaagcucaaacauaggaaauaacuauguaucaugguaucaacauguaccaggaacagcaccaaaauuacuaauauacgaaaacaauagaagaccaucaggaacaccagacagauucagcggaagcaaaagcggaacaucagcaacacuagcaauaacaggacuacaaucaggagacgaagcagacuacuacugcggaacaugggacggaucaggaggaguauucggaacaggaacaaaaguaacaguacua

SEQ ID NO: 48345 - RNA, 333 nt, Artificial Sequence
  derived and/or modified sequence opt6 from anti-HIV_119-025526_VR-Chain
caaucaguacuaacacaaccaccaagcguaagcgcagcaccaggacaaaaaguaacaauaagcuguagcggaagcgcaagcaauauaggaaaaaauuucguaagcugguaccaacaauuaccaggaacagcaccaaaacuauuaauauaugaaaauaacagaagaccaagcggaacaccagacagauucucaggaucaaaaucaggaacaagcgcaacauuagcaauaacaggacuacaaacaggagacgaagcagauuacuauugcacaguauggggaguaagaaaaggaguaggagcagucuuuggaacaggaacaaaaguaacaguacua

SEQ ID NO: 48346 - RNA, 324 nt, Artificial Sequence
  derived and/or modified sequence opt6 from anti-HIV_119-023552_VR-Chain
caaucaguacuaacacaaccaccaucaguaucagcagcaccaggacaaacaguaacaauaucaugcucaggaucaacaucaaacauaggaaaaaacgacguaucaugguaccaacaacuaccaggaacagcaccaaaacuacuaauaucagaaaacaacagaagaccaucaggaacaccagacagauucucagcaucaaaaucaggaacaucagcaacacuagcaauaacaggacuacaaacaggagacgaagcagacuacuacugcgaaacauggcacggaucaggaggaguauucggaacaggaacaaaaguaacaguacua

SEQ ID NO: 48347 - RNA, 321 nt, Artificial Sequence
  derived and/or modified sequence opt6 from anti-HIV_119-023092_VR-Chain
caaucaguauuaacacaaccaccaucaguaagcgcagcaccaggacaaaaaguaacaauaucaugcucaggaucaacaucagaccuaggacaaacaagaguaucaugguaccaacaauuaccaagaucagcaccagaacuauuaauauuugaaaacaacagaagaccaucaggaauaccagacagauucucaggagcaaaaucaggaacaucagcaacauuagcaauaacaggacuacaaacaggagacgaagcagacuacuucugcucaacauggucaggaucacuaaacuucggaacaggaacaagaguaacaguacua

SEQ ID NO: 48348 - RNA, 324 nt, Artificial Sequence
  derived and/or modified sequence opt6 from anti-HIV_119-022793_VR-Chain
caaucaguauuaacacaaccaccaagcguaagcgcagcaccaggacaaaaaguaacaauaaguuguagcggaggaacaagcaauauaggaaacaauuacguaagcugguacagaagacuaccaggaacagcaccaaaacuauuaauauaugaaaauaacaaaagaccaagcggaauaccagacagauucucaggagcaaaaucaggaacaagcgcaacauuaggaauaacaggacuacaaacaggagacgaagcagauuacuauugcgaaacaugggacgauagcggaggaguauucggaacaggaacaaaaguaacaguauua

SEQ ID NO: 48349 - RNA, 324 nt, Artificial Sequence
  derived and/or modified sequence opt6 from anti-HIV_119-022395_VR-Chain
caaucaguacuaacacaaccaccaucaguaucagcagcaccaggacaaacaguaacaauaucaugcucaggaucaacaucaaacauaggaaaaaacgacguaucaugguaccaacaauuaccaggaacagcaccaaaacuacuaauaucagacaacaacagaagaccaucauggacaccagacagauucucaggaaguaaaucaggaacaucagcaacccuagcaauaacaggacuacaaacaggagacgaagcagacuacuacugcgaaacaugggacggaucaggaggaguauucggaccaggaacaagaguaacaguacua

SEQ ID NO: 48350 - RNA, 333 nt, Artificial Sequence
  derived and/or modified sequence opt6 from anti-HIV_119-022334_VR-Chain
caaaguguacuaacacaaccaccaucaguaucagcagcaccaggacaaaacguaaacauaucaugcucaggaggaucaagcaacauaggaucaaacuacguaucaugguaccaacaauucccaggaacagcaccaaaacaccuaauauacgaaaacaacaaaagaccaucaggaauaccagacagauucucagacucacaaucaggaacaucagcaacacuaggaauaacaggacuacaaacaggagacgaagcagacuacuacugcggaacaugggacggaucacuaagaacaggaggaguaauaggaacaggaacaagaguaacaguacua

SEQ ID NO: 48351 - RNA, 321 nt, Artificial Sequence
  derived and/or modified sequence opt6 from anti-HIV_119-021866_VR-Chain
caaucagucuuaacacaaccaccaucaguaucagcagcaccaggacaaagaguaacaauaagcuguucaggaucagcaucaaauauaggaaaaaauuucguaucaugguaccaacaauuaccaggaaaagcaccaaaacuaauaauauaugaaguaacaaaaagaccaagcggaguaccagcaagauucucaggaucaaaaucaggaacaucagcaacauuagcaauaacaggacuacaaacaggagacgaagcagauuacuucugcucaacauggucaggaucauuaaacuuuggaacaggaacaagaguaacaguacua

SEQ ID NO: 48352 - RNA, 324 nt, Artificial Sequence
  derived and/or modified sequence opt6 from anti-HIV_119-021278_VR-Chain
caaucaguacuaacacaaccaccaucaguaucagcagcaccaggacaaaaaguaacaauaucaugcucaggaucagcaucaaacauaggaaaaaacuucguaucaugguaccaacaacuaccaggaacagcaccaaaacuacuaauauacgaaaacaacagaagaccaucaggaacaccagacagauucucaggaucaagaucaggaacaucagcaacauuaggaauaacaggacuacaaacaggagacgaagcacacuacuacugcgaaacaugggacgacucaggaggaguauucggaacaggaacaaaaguaacaguauua

SEQ ID NO: 48353 - RNA, 333 nt, Artificial Sequence
  derived and/or modified sequence opt6 from anti-HIV_119-021183_VR-Chain
caaucaguauuaacacaaccaccaucaguaucagcagcaccaggacaaaaaguaacaauaucauguucaggaaacucaucaaauauaggaaacaauuucguaucaugguaccaacaauuuccaggaacagcaccaaaacuauuaguauuugaaacacacagaagaccaucaggaauaccagacagauucucaggaucaaaaucaggaacaucagcaacauuagcaauaacaggacuacaaacaggagacgaagcagauuacuauugcgcaguauggggaguaagaagaggaguaggagcaguauuuggagcaggaacaaaaguaacaguacua

SEQ ID NO: 48354 - RNA, 333 nt, Artificial Sequence
  derived and/or modified sequence opt6 from anti-HIV_119-019376_VR-Chain
caaucaguauuaacacaaccaccaagcguaagcgcagcaccaggacaaaaaguaacaauaaguuguagcggaagcucaagcaauauaggaaacaauuacguaagcugguaccaacaaguaccaggaacagcaccaaaacuauuaguauaugaaacauacagaagaccaagcggaauaccagacagauucucaggaucaaaaucaggaacaagcgcaacauuagcaauaacaggacuacaaacaggagacgaagcagauuacuauugcacaauauggggaguaagaaaaggaguaggagcaguauuuggaacaggaacaaaaguaacaguacua

SEQ ID NO: 48355 - RNA, 321 nt, Artificial Sequence
  derived and/or modified sequence opt6 from anti-HIV_119-019238_VR-Chain
caaucaguacuaacacaaccaccaucaguaucagcagcaccaggacaaaaaguaacaauaucaugcucaggaacaucaucaaacauaggaaacaaccacguaucaugguaccaacaaguaccaggaacagcaccaaaacuacuaauauacgaaaacaacaaacgaccaucaggaauaccagcaagauucucagcagcaaaaucaggaacaucagcaacacuagcaauaacaggacuacaaacaggagacgaagcagacuacuucugcgcaacauggucaggaagacuaaacauaggaacaggaacaaaaguaacaguacua

SEQ ID NO: 48356 - RNA, 333 nt, Artificial Sequence
  derived and/or modified sequence opt6 from anti-HIV_119-018500_VR-Chain
caaucaguacuaacacaaccaccaucaguaucagcagcaccaggacaaaaaguaaacauaucaugcucaggaucaucaucaaacauaggaaacaacuucguaucaugguaccaacaaagaccaggaacagcaccaaaauuacuaauauacgaaacaaacagaagaccaucaggaauaccagacagauucucaggcucaaaaucaggaacaucagcaacacuagcaauaacaggacuacaaacaggagacgaagcagacuacuacugcgcaacaugggcagcaucacuaacaucagcaagaguauucggaauaggaacaaaaguaacaguacua

SEQ ID NO: 48357 - RNA, 324 nt, Artificial Sequence
  derived and/or modified sequence opt6 from anti-HIV_119-018318_VR-Chain
caaucaguacuaacacaaccaccaagcguaucagcagcaccaggacaaacaguaauaauaucaugcucaggaucaacaucaaacauaggaaaaaacgacguaucaugguaccaacaacuaccaggaacagcaccaaaacuacuaauaucagaaaacaacagaagaccaucaggaacaccagacagauucucaggaucaaaaucaggaacaucagcaacacuagcaauaacaggacuacaaacaggagacgacgcagacuacuacugcgaaacaugggacggaucaggaggaguauucggaacaggaacaaaaguaacacuagua

SEQ ID NO: 48358 - RNA, 333 nt, Artificial Sequence
  derived and/or modified sequence opt6 from anti-HIV_119-018218_VR-Chain
caaucaguauuaacacaaccaccaagcguaagcgcagcaccaggacaaaaaguaacaauaagcuguagcggaaacucaagcaauauaggaaacaauuucguaagcugguaccaacaauuaccaggaacagcaccaaaacuauuaauauaugaaaauaacagaagaccaaguggaauaccagacagauucucaggaucaaaaucaggaacaagcgcaacauuagcaauaagcggacuacaaacaggagacgaagcagauuacuggugcgcaguauggggaguaagaagaggagcaggagcaguauuuggagcaggaacaaaaguaacaguacua

SEQ ID NO: 48359 - RNA, 324 nt, Artificial Sequence
  derived and/or modified sequence opt6 from anti-HIV_119-017876_VR-Chain
caaucaguacuaacacaaccaccaucaguaucagcagcaccaggacaaaaaguaacaauaucaugcucaggaucaacaucaaaaauaggacaaaacucaguaucaugguaccaacaacuaccaggaacagcaccaaaacuacuaauauacgaaaacgacagaagaccaucaggaacacccgacagauucucagcaucaaaaucaggaacaucagcaacacuagcaauaacaggacuacaaacaggagacgaagcagacuacuacugcgaaacaugggacgacucaggcggcguauucggaacaggaacaaaaguaacaguacua

SEQ ID NO: 48360 - RNA, 324 nt, Artificial Sequence
  derived and/or modified sequence opt6 from anti-HIV_119-017740_VR-Chain
caaagcguacuaacacaaccaccaucaguaucagcagcaccaggacaaaaaguaacaauaucaugcucaggaucaaacucaaacauaggaaacaaagacguaucaugguacagacaaguaccagcaacagcaccaaaacuaccaauauacgaaaacaaaaacgaaccaucaggaguaccagacagauucucaggaucaaaaucaggaacaucagcaacacuagcaauaacaggacuacaaacaggagacgaagcagacuacuacugcgcaacaugggacggaagaguaucaguaauaggaacaggaacaaaaguaacaguagua

SEQ ID NO: 48361 - RNA, 321 nt, Artificial Sequence
  derived and/or modified sequence opt6 from anti-HIV_119-017128_VR-Chain
caaucaguacuaacacaaccaccaucaguaucagcagcaccaggacaaaaaguaacaauaucaugcucaggaagcucaucaaacauaggaaacaacuacguaucaugguaccaacaacuaccaggaacagcaccaaaacuacuaauauacgaaaacaacaaaagaccaucaggaauaccagacagauucucaggagcaaaaucaggaacaucagcaacauuagcaauaacaggacuacaaacaggagacgaagcagacuacuucugcucaacauggucaggaucacuaaacuucggaacaggaacaagaguaacaguacua

SEQ ID NO: 48362 - RNA, 324 nt, Artificial Sequence
  derived and/or modified sequence opt6 from anti-HIV_119-017044_VR-Chain
caaucaguacuaacacaaccaccaucaguaucagcagcaccaggacaaaaaguaacaauaucaugcucaggaucaaacucaaacauaggaaacaacuacguaucaugguaccaccaccuaccaggaacagcaccaagacuacuaauauacgacaacaacaaaagaccaucaggaauaccagacagauucucaggaucaaaaucaggaacaucagcaacacuagcaauaacaggacuacaaacaggagacgaagcagacuacuacugcgcaacaugggacggaagaguaucaguaauaggaacaggaacacaaguaacaguacua

SEQ ID NO: 48363 - RNA, 321 nt, Artificial Sequence
  derived and/or modified sequence opt6 from anti-HIV_119-016644_VR-Chain
caaucaguacuaacacaaccaccaucaguaucagcagcaccaggacaaaaaguaacaauaucaugcucaggaggaacaucaaacauaggaaacaacuacguaucaugguaccaacaacuaccaggaacagcaccaaaacuacuaauauacgaaaacaacaaaagaccaucaggaauaccagcaagauucucagcagcaaaaucaggaacaucagcaacacuagcaauaacaggauuacaaacagaagacgaagcagacuacuacugcgcaacauggucaggaucacuaaacauaggaacaggaacaaaaguaacaguacua

SEQ ID NO: 48364 - RNA, 333 nt, Artificial Sequence
  derived and/or modified sequence opt6 from anti-HIV_119-015878_VR-Chain
caaucagcacuaacacaaccaccaucagcaucaggaucaccaggacaaucaguaacaauaucaugcucaggaucaucaucaaacauaggaaacaacuucguaucaugguaccaacaaagaccaggaacagcaccaaaacuacuaauauacgaaacaaacaaaagaccaucaggaauaccagacagauucucaggcucaaaaucaggaacaucagcaacacuagcaauaacaggacuacaaacaggagacgaagcagacuacuacugcgcaacaugggcaccaagacuaaacucagcaagaguauucggaaacggaacaaugguaacaguacua

SEQ ID NO: 48365 - RNA, 321 nt, Artificial Sequence
  derived and/or modified sequence opt6 from anti-HIV_119-015538_VR-Chain
caaucaguauuaacacaaccaccaucaguaucagcaacaccaggacaaaaaguaacaauaucaugcucaggaucaucaucaaacauaggaaacaacuacguaucaugguacagaagacuaccaggaacagcaccaaaacacuuaauauacgaaacaaacaacagaccaucaggaguaccagcaagacuaucagcagcaaaaucaggaacaucagcaacacuagcaauaacaggacuacaaacagaagacgaagcagacuacuacugcgcaacauggucaggaucacuaaacauaggaacaggaacaaaaguaacaguacua

SEQ ID NO: 48366 - RNA, 321 nt, Artificial Sequence
  derived and/or modified sequence opt6 from anti-HIV_119-015455_VR-Chain
caaucaguacuaacacaaccaccaucaguaucagcaacaccaggacaaaaaguaacaauaucaugcucaggaucaaacucaaacauaggaaacaaagacguaucaugguaccaacacuucccaggaacagcaccaaaacuacuaauauacgaaaacaacaaaagaccaucaggaauaccagacagauucucaggaucaaaaucagcaacauccgcaacacuaacaauaacaggacuacaaacagaagacgaagcagacuacuacugcgcaacauggucaggaucacuaaacauaggaacaggaacaaaaguaacaguacua

SEQ ID NO: 48367 - RNA, 321 nt, Artificial Sequence
  derived and/or modified sequence opt6 from anti-HIV_119-014425_VR-Chain
caaucaguacuaacacaaccaccaucaguaucagcagcaccaggacaaaaaguaacaauaucaugcucaggaggaacaucaaacauaggaaacaacuacguaucaugguaccaacaccuaccaggaacagcaccaaaacuacuaauauacgaaaacaacaaaagaccaucaggaauaccagacagauucucaggagcaaaaucaggaacaucagcaacacuagcaauaacaggacuacaaacaggagacgaaggagacuacuacugcgcaacauggucaggaucacuaaacauaggaacaggaacaaaaguaacaguacua

SEQ ID NO: 48368 - RNA, 324 nt, Artificial Sequence
  derived and/or modified sequence opt6 from anti-HIV_119-013582_VR-Chain
caaagcaugguaacacaaucaccaucaguaucagcagcaccaggacaaaaaguaacaauaucaugcucaggaacaagcaguaacauaggacaaaacuacguaucaugguaucaacaacuaccaggaacagcaccaaaauuacuaauaagcgaaaacaacagaagaccaucaggaacaccagacagauucagcggaagcaaaagcggaacaucagcaacacuagcaauaacaggacuacaaacaggagacgaagcagacuacuacugcgaaacaugggacggaucaggaggaguauucggaacaggaacaaaaguaacaguacua

SEQ ID NO: 48369 - RNA, 333 nt, Artificial Sequence
  derived and/or modified sequence opt6 from anti-HIV_119-013364_VR-Chain
caaucaguauuaacacaaccaccaagcguaagcgcagcaccaggacaaaaaguaacaauaaguuguagcggaagcucaaguaauauaggaaacaauuacguaagcugguaccaacaauuaccaggaacagcaccaaaacuauuaauauaugacaauaacaaaagaccaagcggaauaccagacagauucucaggaucaaaaucaggaacaagcgcaacauuagcaauaacaggacuacauacaggagacgaagcagauuacuauugcacaguauggggaguaagaaaaggaguaggagcaguauuuggaacaggaacaaaaguaacaguacua

SEQ ID NO: 48370 - RNA, 333 nt, Artificial Sequence
  derived and/or modified sequence opt6 from anti-HIV_119-012886_VR-Chain
caaucaauauuaacacaaccaccaagcguaagcgcagcaccaggacaaaaaguaacaauaagcuguagcggaagcucaagcacaauaggaacaaauuacguaagcugguaccaacaauuuccaggaacagcaccaaaauuauuaguauuugaaacacacagaagaccaagcggaauaccagacagauucucaggaucaaaaucaggaacaagcgcaacauuagcaauaacaggacuacaaacaggagacgaagcagauuacuauugcgcaguauggggaguaagaagaggaguaggagcaguauuuggagcaggaacaaaaguaacaguacua

SEQ ID NO: 48371 - RNA, 333 nt, Artificial Sequence
  derived and/or modified sequence opt6 from anti-HIV_119-012249_VR-Chain
caaucaguauuaacacaaccaccaagcguaagcggagcaccaggacaaaaaguaacaauaagcuguagcggaagcucaagcaauauaggaagaaauuacguaucaugguaccaacaacuaccaggaacagcaccaaaacuauuaauauaugaaaauaacaaaagaccaagcggaauaccagacagauucaguggaucaaaaucaggaacaagcgcaacauuaguaauaacaggacuacaaacaggagacgaagcagauuucuauugcggaacaugggacggaagccuaaguggaggaggaguaauaggaacaggaacaagaguaacaguacua

SEQ ID NO: 48372 - RNA, 324 nt, Artificial Sequence
  derived and/or modified sequence opt6 from anti-HIV_119-012161_VR-Chain
caaucauuccuaacacaaccaccaucaguaucagcagcaccaggacaaaaaguaacaauaucaugcucaggaucaaacucaaacauaggaaaaaacuacguaucaugguaccaauaccuaccaggaacaguaccaaaauuacuaauauacgaaaacgacaaaagaccaucaggaauaccaggaagauucucagcaucaaaaucaggaacaucagcaacacuagcaauaacaggacuacaaacaggagacgaagcagacuacuacugcggaacaugggacggaucaggaggaguauucggaacaggaacaaaaguaacaguacua

SEQ ID NO: 48373 - RNA, 324 nt, Artificial Sequence
  derived and/or modified sequence opt6 from anti-HIV_119-012110_VR-Chain
caaagcguacuaacacaaccaccaucaguaucagcagcaccaggacaaacaguaacaauaucaugcucaggaucaacaucaaacauagggaaaaacgauguaucaugguaucaacaacuaccaggaacagcaccaaaauuacuaauaagcgaaaacaauagaagaccaucaggaacaccagauagauuuagcggaagcaaaagcggaacaucagcaacacuagcaauaucaggauuacaaacaggagaugaagcagacuauuacuguggaacaugggauggaucaggaggaguauuuggaacaggaacaaaaguaacaguacua

SEQ ID NO: 48374 - RNA, 333 nt, Artificial Sequence
  derived and/or modified sequence opt6 from anti-HIV_119-012100_VR-Chain
caagcaguacuaacacaaccaccaucaguaucagcagcaccaggacaaaaaguagcaauaucaugcucaggaucaucaucaaacauaggaaacaauuacguaucaugguaccaacaacuaccaggaacaguaccaaaacuacuaauauacgacacagacaaaagaccaucaggaauaccagacagauucucaggaucaaaaucaggaacaucagcaacacuaggaauaacaagacuacaaacaggagacgaagcagacuacuacugcgcaacaugggcaccaagacuaaacucagcaagaguauucggaaacggaacaaugguaacaguacua

SEQ ID NO: 48375 - RNA, 324 nt, Artificial Sequence
  derived and/or modified sequence opt6 from anti-HIV_119-011651_VR-Chain
caaucaguacuaacacaaccaccaucaguaucagcagcaccaggacaaaaaguaacaauaucaugcucaggaaacucaucaaacauaggaaacaacuacguaucaugguaccaacaacuaccaggaacagcaccaaaacuacuaauauacgaaaacaacaaaagaccaucaggaauaccagacagauucucaggaucaaaaucaggaacaucagcaacacuagcaauaacaggacuacaaacaggagacgaagcagacuacuacugcgcaacaugggacggaagaguaucaguauucggaacaggaacaaaaguagcaguacua

SEQ ID NO: 48376 - RNA, 333 nt, Artificial Sequence
  derived and/or modified sequence opt6 from anti-HIV_119-011479_VR-Chain
caaucaguauuaacacaaccaccaagcguaagcgcaacaccaggacaaaaaguaacaauaagcuguaguggaaguaauagcaauauaggaaacaaauacguaagcugguaccaacacuuuccaggaacagcaccaaaacuauuaauauaugaaaauaacagaagaccaagcggaauaccagacagauucucaggaucaaaaucaggaacaagcgcaacauuagcaauaacaggacuacaaacaggagacgaagcagauuacuauugcacaauauggggaguaagaaaaggaguaggagcaguauuuggaacaggaacaaaaguaacaguacua

SEQ ID NO: 48377 - RNA, 333 nt, Artificial Sequence
  derived and/or modified sequence opt6 from anti-HIV_119-011232_VR-Chain
caaucaguauuaacccaaccaccgagcguaagcgcagcaccaggacaaaacguaaacauaagcuguagcggaggaucaagcaauauaggaagcaauuacguaagcugguaccaacaauuuccaggaacagcaccaaaacuauuaauauaugacgaugacaaaagaccaagcggaauaccacacagauucucagcaucaaaaucaggaacaagcgcaacauuagcaauaagcggacuacaaacaggagacgaagcagauuacuguugcgcaguauggggaguaagaagaggagcaggagcaguauuuggagcaggaacaaaaguaacaguacua

SEQ ID NO: 48378 - RNA, 333 nt, Artificial Sequence
  derived and/or modified sequence opt6 from anti-HIV_119-011175_VR-Chain
caaucaguauuaacacaaccaccaagcguaagcgcagcaccaggacaaaaaguaacaauaagcuguaguggaaguaauagcuauauaggaaacaaauauguaagcugguaccaacaauuuccaggaacagcaccaaaauuauuaauauaugaaaauaacagaagaccaagcggaauaccagacagauucucaggaucaaaaucaggaacaagcgcaacacuagcaauaagcggacuacaaacaggagacgaagcagauuacuguugcgcaguauggggaguaagaagaggagcaggagcaguauuuggaccaggaacaaaaguaacaguacua

SEQ ID NO: 48379 - RNA, 321 nt, Artificial Sequence
  derived and/or modified sequence opt6 from anti-HIV_119-008396_VR-Chain
caaucaguacuaacacaaccaccaucaguaucagcagcaccaggacaaaaaguaacaauaagcugcucaggaucaucaucaaacauaggaaacaacuacguaucaugguaccaacaaguaccaggaacagcaccaaaacuauuaguauacgaaaacacaagaagaccaucaggaguaccagacagauucucaggagcaaaaucaggaacaucagcaacacuagcaauaacaggacuacaaacaggagacgaaggagacuacuacugcgcaacauggucaggaucacuaaacauaggaacaggaacaaaaguaacaguacua

SEQ ID NO: 48380 - RNA, 324 nt, Artificial Sequence
  derived and/or modified sequence opt6 from anti-HIV_119-007148_VR-Chain
caaucaguacuaacacaaccaccaagcguaucagcagcaccaggacaaaaaguaacaauaucaugcucaggaucaacaucaaacauaggcaaaaacuacguaucaugguaccaacaccuaccaggaacagcaccaaaauuacuacuauacgaaaacgacagaagaccaucaggaacaccagacagauucucaggaucaaaaucaggaacaucagcaacauuagcaauaacaggacuacacacaggagacgaagcagacuacuacugcgaaacaugggacggaucaggaggaguauucggaacaggaacaaaaguaacaguacua

SEQ ID NO: 48381 - RNA, 333 nt, Artificial Sequence
  derived and/or modified sequence opt6 from anti-HIV_119-007029_VR-Chain
caaucaguauuaacacaaccaccaagcguaagugcagcaccaggacaaaaaguaacaauaagcuguagcggaaacucaaguaauauaggaaacaauuucguaucaugguaccaacaaguaccaggaacagcaccaaaacuauuacuauaugaaacauacagaagaccaagcggaauaucagacagauucucaggaucaaaaucaggaacaagcgcaacauuagcaauaacaggacuccaaacaggagacgaagcagauuacuauugcacaguauggggaguacgaaaaggaguaggagcaguauuuggaacaggaacaaaaguaacaguacua

SEQ ID NO: 48382 - RNA, 324 nt, Artificial Sequence
  derived and/or modified sequence opt6 from anti-HIV_119-004707_VR-Chain
caaagcguacuaacacaaccaccaucaguaucagcagcaccaggacaaaaaguaacaauaucaugcucaggaucaacaucaaacauaggaaaaaacgacguaucaugguaucaacaauuaccaggaacagcaccaaaacuacuaauaagcgaaaacaacagaagaccaucaggaacaccagacagauucagcggaagcaaaagcggaacaucagcaacauuagcaauaacaggacuacaaacaggagacgaagcagacuacuacugugaaacaugggacggaucaggaggaguauucggaacaggaacaaaaguaacaguacua

SEQ ID NO: 48383 - RNA, 333 nt, Artificial Sequence
  derived and/or modified sequence opt6 from anti-HIV_119-003910_VR-Chain
caaucaguauuaacacaaccaccaagcguaagcgcagcaccaggacaaaaaguagcaauaagcuguaguggaaacacaagcucaauaggaaacaauuucguaagcugguaccaacaaguaccaggaacagcaccaaaacuauuaguauaugaaacauacagaagaccaagcggaauaccagacagauucucaggaucaaaaucaggaacaagugcaacauuagcaauaacaggacuacaaacaggagacgaagcagauuacuauugcacaguauggggaguaagaaaaggaguaggagcaguauuuggaacaggaacaaaaguaacaguacua

SEQ ID NO: 48384 - RNA, 321 nt, Artificial Sequence
  derived and/or modified sequence opt6 from anti-HIV_119-002450_VR-Chain
caaucaguacuaacacaaccaccaucaguaucaggagcaccaggacaaagaguaacaauaucaugcacaggaucaucaucaaacauaggaaacaacuacguaucaugguaccaaggacuaccaggaacagcaccaaaacuacuaauauaugaaaacaacaaaagaccaucaggaauaccagacagauucucaggagcaaaaucaggaacagcagcaacauuagcaauaacaggacuacaaacaggagacgaagcagacuacuacugcgcaacauggucaggaucacuaaacuucggaacaggaacaaaaguaacaguacua

SEQ ID NO: 48385 - RNA, 321 nt, Artificial Sequence
  derived and/or modified sequence opt6 from anti-HIV_119-001552_VR-Chain
caaucaguauuaacacaaccaccaucaguaucagcagcaccaggacaaaaaguaacaauaucaugcucaggaucaaacucauaccuaggaaacaaauacguaucaugguaccaacaauucccaggaacagcaccaaaacuacuaauauacgaaaacaacaaaagaccaucaggaauaccagacagauucucagcaucaaaaucagcagcaucagcaacauuagcaauaacaggacuacaaacaggagacgaaggagacuacuacugcgcaacauggacaggaucacuaaacauaggaacaggaacaaaaguaacaguacua

SEQ ID NO: 48386 - RNA, 333 nt, Artificial Sequence
  derived and/or modified sequence opt6 from anti-HIV_059-188169_VR-Chain
caaucaguacuaacacaaccaccaucaguaucagcagcaccaggacaaaaaguaacaauaucaugcucaggaucaacaucaaacauaggagacaacuacguaucaugguaccaacaaguaccaggaacagcaccaaaacuacuaauauacgaaaacaacagaagaccaucaggaacaccagacagauucucaggaucaaaaucaggaacaucagcaacacuagcaauaacaggacuacaaacaggagacgaagcagacuacuacugcggaacaugggacacaucacuaucaacaggaggaguauucggaacaggaacaaaaguaacaguacua

SEQ ID NO: 48387 - RNA, 333 nt, Artificial Sequence
  derived and/or modified sequence opt6 from anti-HIV_059-183739_VR-Chain
caaucaguauuaacacaaccaccaagcguaucagcagcaccaggacaaaaaguaacaauaucaugcucaggaucaacaucaaacauaggaaaaaacuacguaucaugguaccaacaacuaccaggaacagcaccaaaacuacuaauauacgaaaacaacagaagaccaucaggaacaccagacagauucucaggaucaaaaucaggaacaucagcaacacuaggaauaucaggacuacaaacaggagacgaagcagacuacuacugcggaacaugggacacaucacuaucaggaggaggaguauucggaacaggaacaaaaguaacaguauua

SEQ ID NO: 48388 - RNA, 333 nt, Artificial Sequence
  derived and/or modified sequence opt6 from anti-HIV_059-182376_VR-Chain
caaucaguauuaagccaaccaccaucaguaucagcagcaccaggacaaaaaguaacaauaucauguucaggaucaucaucaaauauaggaaacuauuacguaucaugguaccaacaauuuccaggaacagcaccaaaacuauuaauauauaaaaaugacaauagaccaagcggaauaccagacagauucucaggaucaaaaucaggaacaucagcaacauuaggaauaucaggacuacaaacaggagacgaagcagauuacuauugcggaacauggggaacaucauuaucaggaggaggaguauuuggaacaggaacaaaaguaacaguacua

SEQ ID NO: 48389 - RNA, 333 nt, Artificial Sequence
  derived and/or modified sequence opt6 from anti-HIV_059-182199_VR-Chain
caaucaguacuaacacaaccaccaucaguaucagcagcaccaggacaaaacauaacaauaucaugcucaggaucaucaucaaacauaggaucacacucaauaucaugguaccaacaccuaccaggaacagcaccaaaaauaguaauauacgacaacgacaaaagaccacuaggaauaccagacagauucucaggaucaaaaucaggaacaucagcaacacuaggaauaacaggacuacaaacaggagacgaagcagacuacuacugcggaacaugggacacaucacuaucaggaggaggaguauucggaccaggaacaaaaguaacaguacua

SEQ ID NO: 48390 - RNA, 324 nt, Artificial Sequence
  derived and/or modified sequence opt6 from anti-HIV_059-169202_VR-Chain
cacucaguacuaacacaaccaccaucaguaucagcagcaccaggacaaaaaguaacaauaucaugcucaggaucaucaucaaaaauaggaaacaacuucguaucaugguaccaacaacuaccaggaacagcaccaaaacuacuaauauacgaaaacaacaaaagaccaucaggaauaccagacagauucucaggaucaaaaucaggaacaagcgcaacacuagcaauaacaggacuacaaacaggagacgaagcagacuacuacugcggaacaugggacggaagaguaucaguaauaggaucaggaacaaaacuaacaguauua

SEQ ID NO: 48391 - RNA, 324 nt, Artificial Sequence
  derived and/or modified sequence opt6 from anti-HIV_059-155645_VR-Chain
caaucagcauuaacacaaccagcaucaguaucaggaucaccaggacaaucaauaacaauaucaugcacaggaacaucaucagacguaggauacaacuacguaucaugguaccaacaacuaccaggaacagcaccaaaacuacuaauauacgaaaacaacaaaagaccaucaggaauaccagacagauucucaggaucaaaaucaggaacaucagcaacacuagcaauaacaggacuacaaacaggagacgaagcagacuacuacugcggaacaugggacggaagacuaucaguaauaggaacaggaacaaaaguaacaguacua

SEQ ID NO: 48392 - RNA, 333 nt, Artificial Sequence
  derived and/or modified sequence opt6 from anti-HIV_059-151619_VR-Chain
caaucaguauuaacacaaccaccaucaguaucagcagcaccaggacaaaaaguaacaauaucauguucaggaucaucaucaaauauaggaaacaauuucguaucaugguaccaacuauuaccaggaacaccaccaaaacuauuaauauucaaaaauaacgaaagaccaucaggaauaccagacagauucucaggaucaaaaucaggaacaucagcaacacuaggaauaacaggacuacaaacaggagacgaaggagacuacuacugcggaacaugggacacaucacuaucaggaggaggaguauucggaacaggaacaagaguaacaguacua

SEQ ID NO: 48393 - RNA, 333 nt, Artificial Sequence
  derived and/or modified sequence opt6 from anti-HIV_059-146503_VR-Chain
caaagcguauuaacacaaccaccaaguguaagcgcaacaccaggacaaaaaguaacaauaagcuguagcggaagcgcaagcaauauaggaaacaauuacguaagcugguaccaacaauuuccaggaacagcaccaaaacuauuaauauaugacacaaacaaaagaccaagcggaauaccagacagauucucaggaucaaaaucaggaacaagcgcaauauuaggaauaacaggacuacaaauaggagacgaagcagauuacuauugcggaacaugggacacaucauuaagcggaggaggaguauuuggaacaggaacaaaaguaacaguacua

SEQ ID NO: 48394 - RNA, 324 nt, Artificial Sequence
  derived and/or modified sequence opt6 from anti-HIV_059-136098_VR-Chain
caaucaguauuaacacaaccaccaagcguaagcgcagcaccaggacaaagaguaacaauaagcuguagcggaagcucaagcaauauaggaaacaauuacguaagcugguaccaacaauuaccaggaacagcaccaaaacuauuaauauaugaaaauaacagaagaccaagcggaauaccagacagauucucaggaucaaaaucaggaacaagcgcaacauuagcaauaacaggacuacaaacaggagacgaaggagauuacuauugcgcaagaugggacggaagauuaagcguaauaggaaguggaaccaaaguaacaguauua

SEQ ID NO: 48395 - RNA, 333 nt, Artificial Sequence
  derived and/or modified sequence opt6 from anti-HIV_059-105516_VR-Chain
caaucagcacuaacacaaccaccaucaguaucagcagcaccaggacaaaaaguaacaauaucaugcucaggaucaucaucaaacauaggaaacaauuacguaucaugguaccaacaacuaccaggaacagcaccaaaacuacuaauauacgacaacaacaaaagaccaucaggaauaccagacagauucucaggaucaaaaucaggaacaucagcaacauuagcaauagcaggacuacaaacaggagacgaagcaaacuacuacugcggaacaugggacggaucacuaagaacaggaggaguauucggaacaggaacaaaaguaacaguacua

SEQ ID NO: 48396 - RNA, 333 nt, Artificial Sequence
  derived and/or modified sequence opt6 from anti-HIV_059-095709_VR-Chain
caaagcguauuaacacaaccaccaagcguaagcgcagcaccaggacaaaaaguaacaauaagcuguagcggaagaucaagcaauauaggaaacaauuucguaagcugguaccaacuauuaccaggaacagcaccaaaauuauuaauauauaaaaauaacgaaagaccaagcggaauaccagacagauucucagcaucaaaaucaggaacaagcgcaacauuaggaauaacaggacuacaaacaggagacgaagcagauuacuauugcggaacaugggacacaucauuaagcggaggaggaguauuuggaacaggaacaaaaguaacaguacua

SEQ ID NO: 48397 - RNA, 333 nt, Artificial Sequence
  derived and/or modified sequence opt6 from anti-HIV_059-069468_VR-Chain
caaaguguauuaacacaaccaccaucaguaucaggagcaccaagacaaucaguaauaauaucaugcacaggaucaagcucaaacauaggaggauucgauguacacugguaucaacaacuaccaggaacagcaccaaaauuauuaauauacgaaaacaacagaagaccaucaggaacaccagacagauuuagcggaagcaaaagcggaacaucagcaacacuagcaauaacaggauuacaaacaggagacgaagcagacuauuacuguggaacaugggauggaucacuaucaacaggaggaguaauaggaacaggaacaaaaguaacaguauua

SEQ ID NO: 48398 - RNA, 333 nt, Artificial Sequence
  derived and/or modified sequence opt6 from anti-HIV_059-060026_VR-Chain
caaucaguauuaacacaaccaccaagcguaagcgcagcaccaggacaaaaaguaacaauaaguuguagcggaagcucaucaaauauaggaaacaauuacguaagcugguaccaacaauuaccaggaacaguaccaaaacuacuaauauauaaaaaugacaaaagaccaagcggaauaccagacagauucucaggaucaaaaucagcaacaagcgcaacauuaggaauaacaggacuacaaacaggagacgaagcagauuacuauugcggaauaugggacacaaguuuaagcgcaggaggaguauuuggaacaggaacaagaguaacaguacua

SEQ ID NO: 48399 - RNA, 333 nt, Artificial Sequence
  derived and/or modified sequence opt6 from anti-HIV_059-053668_VR-Chain
caaucaguacuaacacaaccacccucaguaucagcagcaccaggacaaaaaguaacaauaucaugcucaggaucaucaucaaacauaggaaacaacuacguaucaugguaccaacaacuaccaggaacagcaccaaaacuacuaauauacgaaaacaacaaaagaucaucaggaauaccagacagauucucaggaagcaaaagcggaacaucagcaacacuagcaauaacaggauuacaaacaggagacgaagcagacuacuacugcggaacaagagacucaucauuaucaggaggaggaguaauaggaacaggaacaaaaguaacaguacua

SEQ ID NO: 48400 - RNA, 333 nt, Artificial Sequence
  derived and/or modified sequence opt6 from anti-HIV_059-052864_VR-Chain
caaucaguacuaacacaaccaccaucacuaucagcagcaccaggacaaagaguaacaauaucaugcucaggaucaucaucaaacauaggaaacaacuacguaucaugguaccaacaacuaccaggaacagcaccaaaacuacuaauauacgaaucaaacaaaagaccaucaggaacaccagacagauucucaggaucaaaaucaggaacaucagcaacacuagcaauaacaggacuacaaacaggagacgaagcagacuacuacugcggaacaugggacgcaucacuaucaucaggaggaguaaugggaacaggaacaaaaguaacaguacua

SEQ ID NO: 48401 - RNA, 333 nt, Artificial Sequence
  derived and/or modified sequence opt6 from anti-HIV_059-050968_VR-Chain
caaagcguauuaacacaagcaccaagcguaagcgcagcaccaggagaaaaaguaacaauaagcuguagcggaacaucaagcaauauaggauacuauuacguaagcugguaccaacaauuuccaggaacagcaccaaaaguaguaauauaugaaaauaacagaagaccaagcggaacaccagacagauucucaggaucaaaaucaggaacaagcgcaacauuagcaauaacaggacuacaaacaggagacgaagcagauuacuauugcggaacauggggaggaucauuaagcacaggaggaguaauaggaacaggaacaaaaguaacaguacua

SEQ ID NO: 48402 - RNA, 333 nt, Artificial Sequence
  derived and/or modified sequence opt6 from anti-HIV_059-046422_VR-Chain
caaucaguacuaacacaaccaccaucaguaucagcagcaccaggacaaaaaguaacaauaucaugcucaggaucaucaucaacaauaggaaacaauuacauaucaugguaccaacuacuaccaggaacaccaccaaacuaccuaauauucaaaauaucagaaagaccaucaggaguaccagacagauucucaggaucaaaaucaggaacaucagcaacacuacacauaacaggacuacaaacaggagacgaaggagacuacuacugcggaacaugggacacaucacuaucaggaggaggaguauucggaacaggaacaaaaguaacaguacua

SEQ ID NO: 48403 - RNA, 333 nt, Artificial Sequence
  derived and/or modified sequence opt6 from anti-HIV_059-045120_VR-Chain
caaucaguauuaacacaaccaccaagcguaagcgcagcaccaggacaaaaaguagcaauaagcuguagcggaagcucaagcacaauaggaaacaauuacguaagcugguaccaacuauuaccaggaacaccaccaaaacuauuaauauuuaaaagucacgaaagaccaagcggaauaccagacagauucucaggaucaaaaucaggaacaagcgcaacauuaggaauaacaggacuacaaacaggagacgaaggagauuacuauugcggaacaugggacagcucauuaagcguaggaggaguauuuggaacaggaacaaaaguaacaguacua

SEQ ID NO: 48404 - RNA, 333 nt, Artificial Sequence
  derived and/or modified sequence opt6 from anti-HIV_059-039932_VR-Chain
caaucaguacuaacacaaccaccaucaguaucagcagcaccaggacaaaaaguaacaauaagcugcucaggaucaucaucaauaauaggaaaaaacuacguaucaugguaccaacaccuaccaggaacagcaccaaaacuacuaauauacgaaaacaacaaaagaccaucaggaauaccagacagauucucaggaucaaaaucaggaacaucagcaacauuagcaauagcaggacuacaaacaggagacgaagcaaacuacuacugcggaacauggggaggaucacuaucaacaggaggaguauucggaacaggaacaaaaguaacaguacua

SEQ ID NO: 48405 - RNA, 333 nt, Artificial Sequence
  derived and/or modified sequence opt6 from anti-HIV_059-038595_VR-Chain
caaucaguauuaacacaaccaccaagcguaagugcagcaccaggacaaaaaguaacaauaaguuguagcggaagaucaagcaacauaggaaacaauuucguaagcugguaccaacaauuaccaggaacagcaccaaaacuauuaauauaugaaaauaacaaaagaccaaguggaauaccagacagauucucaggaucaaaaucaggaacaagcgcaacauuaggaauaacaggacuacaaacaggagacgaagcagauuacuauugcggaacaugggacacaucauuaagcgcaggaggaguauuuggaagcggaacaaaaguaauaguacua

SEQ ID NO: 48406 - RNA, 333 nt, Artificial Sequence
  derived and/or modified sequence opt6 from anti-HIV_059-035082_VR-Chain
caaucaguacuaacacaaccaccaucaguaucagcagcaccaggacaaaaaguaacaauaucaugcucaggaucaacaucaaacauaggaaaaucauucguaucaugguaccaacaauuaccaggaacagcaccaaaacuacuaauauacgacaacaacagaagaccaagcggaacaccagacagauucucaggaucaaaaucaggaacaucagcaacacuagcaauaacaggacuacaaacaggagacgaagcagacuacuacugcggaacauggggaggaucacuaucaacaggaggaguaauaggaacaggaacaaaaguaacaguacua

SEQ ID NO: 48407 - RNA, 333 nt, Artificial Sequence
  derived and/or modified sequence opt6 from anti-HIV_059-029204_VR-Chain
caaucaguacuaacacaaccaccaucaguaucagcagcaccaggacaaaaaguaacaauaucaugcucaggaucaacaucaaacauaggaaaaauacuaguaucaugguaccaacaacuaccaggaacagcaccaaaaccaucaauauacgacaacaacagaagaccaucaggaaccccagacagauucucaggaucaaaaucaggaacaucagcaacacuagcaauaacaggacuacaaacaggagacgaagcagacuacuacugcggaacaugggacggaucacuaucaacaggaggaguaauaggaacaggaacaaaaguaacaguacca

SEQ ID NO: 48408 - RNA, 324 nt, Artificial Sequence
  derived and/or modified sequence opt6 from anti-HIV_059-025235_VR-Chain
caaucaguacuaacacaaccaccaucaguaucaggagcaccaggacaaaaaauaacaauaucaugcucaggaucaacaucaaacauaggaaaaucauacguaucaugguaccaacaacuaccaggaacagcaccaaaacuacuaauauacgaaaacaacagaagaccaucaggaacaccagacagauucucaggaucaaaaucaggaacaucagcaacacuagcaauaacaggacuacaaacaggagacgaagcagacuacuacugcggaacaugggacggaucaggaggaguaauaggaacaggaacaaaaguaacaguacua

SEQ ID NO: 48409 - RNA, 333 nt, Artificial Sequence
  derived and/or modified sequence opt6 from anti-HIV_059-015192_VR-Chain
caaucaguacuaacacaaccaccaucaguaucagcagcaccaggacaaaaaguaacaauaucaugcucaggaucaucaucaacaauaggagacaaauacguaucaugguaccaacuacuaccaggaacagcaccaaaacuacuaauauacaaaaacaacaaaagaccaucaggaauaccagacagauucucaggaucaaaaucaggaacaucagcaacacuaggaauaacaggacuacaaacaggagacgaagcagacuacuacugcggaacaugggacacaucacuaucaguaggaggaguauucggaacaggaacaaaaguaacaguacua

SEQ ID NO: 48410 - RNA, 333 nt, Artificial Sequence
  derived and/or modified sequence opt6 from anti-HIV_059-007060_VR-Chain
caaucaguacuaacacaaccaccaucaguaucagcagcaccaggacaaaaaguaacaauaucaugcucaggaucaucaucaaacauaggaaacaaauacguaucaugguaccaacaacuaccaggaacagcaccaaaacuacuaauauacgaaaacaaaaaaagaccaucaggaauaccagacagauucucaggaucaaaaucaggaacaucagcaacacuaggaauaacaggacuacaaacaggagacgaagcagacuacuucugcggaacaugggacacaucacuaucaggaggaggaguauucggaucaggaacaaaaguaacaguacua

SEQ ID NO: 48411 - RNA, 324 nt, Artificial Sequence
  derived and/or modified sequence opt6 from anti-HIV_059-006953_VR-Chain
caaagcguacuaacacaaccaccaucaguaucagcagcaccaggacaaaaaguaacaauaucaugcucaggaucaagcucaaacauaggaguaagcugguaccaacaaguaccaggaacagcaccaaaacuauuaauauaugacaaugacaaaagaccaacaggaauaccagacagauucucaggaucaaaaucaggaacaagcgcaauauuagcaauaacaggacuacaaacaggagacgaaggagauuacuauugcggaacaugggaaacaagccuaagcggaggaggaguauuuggaacaggaacaaaaguaacaguacua

SEQ ID NO: 48412 - RNA, 333 nt, Artificial Sequence
  derived and/or modified sequence opt6 from anti-HIV_059-005953_VR-Chain
cacucaguacuaacacaaccaccaucaguaucagcagcaccaggacaaaaaguaacaauaucaugcucaggaacaucaucaaacauaggaaaaaacuacguaucaugguaccaacaacuaccaggaacagcaccaaaacuacuaauauacgaaaacaacagaagaccaucaggaacaccagacagauucucaggaucaaaaucaggaacaucagcaacacuagcaauaacaggacuacaaacaggagacgaagcagacuacuacugcggaacaugggacacaucacuaucaacaggaggaguauucggaacaggaacaaaaguaacaguacua

SEQ ID NO: 48413 - RNA, 324 nt, Artificial Sequence
  derived and/or modified sequence opt6 from anti-HIV_059-003725_VR-Chain
caaucaguacuaacacaaccaccaucaguaucagcagcaccaggacaaaaacuaacaauaucaugcucaggaucaacaucaaaaauaggaaacaacuacguaucaugguaccaacaccuaccaggaacagcaccaaaacuacuaguauacgaaaacaacaaaagaccaucaggaauaccagacagauucagcggaucaaaaucaggaacaucagcaacacuagcaauaacaggacuacaaacaggagacgaagcagacuacuacugcggaacaugggacggaagacuaucaguaauaggaacaggaacaaaaguaacaguacua

SEQ ID NO: 48414 - RNA, 333 nt, Artificial Sequence
  derived and/or modified sequence opt6 from anti-HIV_059-002618_VR-Chain
caauuaguauuaacacaaccaccaagcguaagcgcagcaccaggacaaaaaguaacaauaagcuguagcggaagcucaagcaauauaggaaacaauuucguaagcugguaccaacaauuaccaggaacagcaccaaaacuauuaauauaugaaaauaacaaaagaccaagcggaauaccagacagauucucaggaucaaaaucaggaacaagcgcaacauuaggaauaacaggacuacaaacaggagacgaagcagauuacuauugcggaacaugggacacaagauuaagcgcaggaggaguauuuggaacaggaacaaaaguaacaguacua

SEQ ID NO: 48415 - RNA, 324 nt, Artificial Sequence
  derived and/or modified sequence opt6 from anti-HIV_059-001522_VR-Chain
caaucaguacuaacacaaccaccaucaguaucagcagcaccaggacaaaaaguaacaauaucaugcucaggaucaaacucaaacauaggaaacaacuacguaucaugguaccaacaacuaccaggaacagcaccaaaacuacuaauauacgaaaacaacaaaagaccaucaggaauaccagacagauucucaggaucaaaaucaggaacaucagcaacacuagcaauaacaggacuacaaacaggagacgaagcagacuacuacugcggaacaugggacggaagacuaucaguaauaggagcaggaacaaaaguaauaguagua

SEQ ID NO: 48416 - RNA, 333 nt, Artificial Sequence
  derived and/or modified sequence opt6 from anti-HIV_059-000731_VR-Chain
caaucaguacuaacacaaccaccaucaguaucagcagcaccaggacaaaaaguaacaauaucaugcagcggaucaacaucaaacauaggaaacaaauacguaucaugguaccaacaaguaccaggaacagcaccaaaacuacuaauauacgaaaacaacagaagaccaucaggaauaccagacagauucucaggaucaaaaucaggaacaucagcaacacuagcaauaacaggacuacaaacaggagacgaagcagacuacuacugcggaacaugggacgcaagccuaagaacaggaggaguaauaggaacaggaacaaaaguaacaguacua

SEQ ID NO: 48417 - RNA, 333 nt, Artificial Sequence
  derived and/or modified sequence opt6 from anti-HIV_059-000634_VR-Chain
caaucaguacuaacacaaccaccaucaguaucagcagcaccaggacaaaaaguaacaauaucaugcucaggaucaucaucaacaauaggaaacaacuacguaucaugguaccaaguaguaccaggaacagcaccaaaacuauuaauauacaaaauaaacgaaagaccaucaggaauaccagacagauucucaggaucaaaaucaggaacaucagcaacacuaggaauaacaggacuacaaacaggagacgaagcagacuacuacugcggaacaugggacacaucacuaucaggaggaggaguauucggcccaggaacaaaaguaacaguacua

SEQ ID NO: 48418 - RNA, 333 nt, Artificial Sequence
  derived and/or modified sequence opt6 from anti-HIV_048-250757_VR-Chain
caaucaguacuaacacaaccaccaucaguaucaggagcaccaggacaaagaguaacaauaucaugcacaggaacaacaucaaacauaggaucaaacuacguagcaugguaccaacaauuaccaggaacagcaccaaaacuacuaauauacgacaacgacaaaagaccaucaggaauaccagacagauucucaggaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 48419 - RNA, 333 nt, Artificial Sequence
  derived and/or modified sequence opt6 from anti-HIV_048-250716_VR-Chain
caaucaguauuaacacaaccaccaagcguaagcgcagcaccaggacaaaaaguaacaauaagcuguagcggaagcucaagcaauauaggaaacaaauacguaagcugguaccaacaauuaccaggaacagcaccaaaacuauuaauauaugaaaauucaaaaagaccaagcggaauaccagacagauucucaggaucaaaaucaggaacaagcgcaacauuaggaauaacaggacuacaaacaggaggacaagcagauuacuauugcggaacaugggacacaucauuaagcgcaggaggaguauuuggaagcggaacaaaaguaacaguacua

SEQ ID NO: 48420 - RNA, 333 nt, Artificial Sequence
  derived and/or modified sequence opt6 from anti-HIV_048-250463_VR-Chain
caaucaguacuaacacaaccaccaucaguaucagccgcaccaggacaaaaaguaacaauaucaugcucaggaucaagaucaaacaacggaaacaacuacguaucaugguaccaacaacuaccaggaacagcaccaaaacuacuaauauacgaaaacaacaaaagaccaucaggaauaccagacagauucucaggaucaaaaucaggaacaucagcaacacuagccauaacaggacuacaaacaggagacgaagcagacuacuacugcggaacaugggacucaucacuaucaggaggaggaguaauaggaacaggaacaaaacuaacaguacua

SEQ ID NO: 48421 - RNA, 333 nt, Artificial Sequence
  derived and/or modified sequence opt6 from anti-HIV_048-248153_VR-Chain
caaucagcauuaacacaaccagcaucaguaagcgcaucauuuggacaaagcauaacaauaagcuguacaggagcagcaagcgauguaggauacaauuacguaagcugguaccaacaauuaccaggaacaacaccaaaacuauuaauauauagaaauaaccaaagaccaagcggaauaccagacagauucucaggaucaaaaucaggaacaucagcaacauuaggaauaacaggacuacaaacaggagacgaagcagauuacuauugcggaacaugggacacaagccuaagcgcaggaggaguauuuggaacaggaacaaaaguaacaguacua

SEQ ID NO: 48422 - RNA, 333 nt, Artificial Sequence
  derived and/or modified sequence opt6 from anti-HIV_048-247532_VR-Chain
caaucaguacuaacacaaccaccaucaguaucagcagcaccaggacaacaaguaacaauaucaugcucaggaacaacaucaaacauaggaacaaacuacguaucaugguaccaacaaaugccaccagcagcaccaaaacuacuaauauacgacaacaaaaaaagaccaucagacauaccagacagauucucaggaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 48423 - RNA, 333 nt, Artificial Sequence
  derived and/or modified sequence opt6 from anti-HIV_048-245846_VR-Chain
caaucaguauuaacacaaccaccaagcguaucagcaacaccaggacaaagaguaacaauaucauguacaggaucaucaucaaauauaggaggauaugauguaucaugguaccaaguauuaccaggaacagcaccaaaacuauuaauauaugacagugacaaaagaccaucaggaauaccagacagauucucaggaucacaaucaggaacaucagcaacacuaggaauaacaggacuacaaacaggagacgaagcagauuacuauugcggaacaugggacacaucauuaucaggaggaggaguauuuggaacaggaacaaaaguaacaguacua

SEQ ID NO: 48424 - RNA, 333 nt, Artificial Sequence
  derived and/or modified sequence opt6 from anti-HIV_048-244016_VR-Chain
caaagcguauuaacacaaccaccaagcguaagcggagcaccaggacaaagaguaacaauaagcuguacaggaagcucaagcaauauaggaggauaugacguacacugguaccaacaauuaccaggaacagcaccaaaacuauuaauauauaaaaaugacaaaagaccaagcggaauaccagacagauucucaggaucaaaaucaggaacaagcgcaauauuaggaauaacaggauuacaaacaggagacgaagcagauuacuauugcggagcaugggacacaucauuaagcgcaggaggaguauuuggaacaggaacaaaaguaacaguacua

SEQ ID NO: 48425 - RNA, 333 nt, Artificial Sequence
  derived and/or modified sequence opt6 from anti-HIV_048-243682_VR-Chain
caaucacuauuaacacaaccaccaagcguaagcgcagcaccaggacaaaaaguaacaauaagcuguacaggaagcucaagcaauauaggaggauaugacguacacugguaccaacaauuaccaggaacagcaccaaaacuauuaauauaugaaaauaacaaaagaccaagcggaauaccagacagauucucaggaucaaaaucaggaacaagcgcaacauuaggaauaacaggacuacaaacaggagacgaagcagauuacuauugcggaacaugggauucgagcuuaagcgcaggaggaguauuuggaacaggaacaaaaguaacaguacua

SEQ ID NO: 48426 - RNA, 333 nt, Artificial Sequence
  derived and/or modified sequence opt6 from anti-HIV_048-243588_VR-Chain
caaucacuacuaacacaaccaccaucaguaucagcaccaccaggacaaaugguaucaauaucaugcucaggaucaucacacaacauaggagacaacuacguaucaugguaccaacaccuaccaggaacagcaccaaaacuacuaauauacgacaacaacucaagaccaagcggaauaccagacagauucucaggaucaaaaucaggaacaucagcaacacuaggaauaacaggacuacaaacaggagacgaagcagacuacuacugcggaacaugggacacaucacuaucaggaggaggaguauucggaacaggaacaaaaguaacaguacua

SEQ ID NO: 48427 - RNA, 333 nt, Artificial Sequence
  derived and/or modified sequence opt6 from anti-HIV_048-241775_VR-Chain
caaucaguacuagcacaaccaccaucaguaucaggagcaccaggacaaagaguaacaauaucaugcacaggaucaucaucaaacauaggagaauacgacguacacugguaccaacaacuaccaggaacagcaccaaaacuacuaauauacgaaaacaacaaaagaccaucaggaauaccagacagauucucaggaucaaaaucaggaacaucagcaacacuaggaauaacaggauuacaaacaggagacgaagcagacuacuacugcggaacaugggacucaucauuaucagcaggaggaguauucggaacaggaacaaaaguaacaguacua

SEQ ID NO: 48428 - RNA, 333 nt, Artificial Sequence
  derived and/or modified sequence opt6 from anti-HIV_048-237996_VR-Chain
caaaguguauuaacacaaccaccaucaguaaguggagcaccaggacaaagaguaacaauaucauguacaggaaguaguucaaauauaggaggauaugauguacauugguauagacaauuaccaggaacagcaccaaaauuacuaauauaugauacaguaaaaagaccaucaggaauaccagauagauuuaguggaaguaaaaguggaacaucagcaacauuaggaauaacaggauuacaaacaggagaugaagcagauuauuauuguggaacaugggauacaucauuaucagcaggaggaguauuuggaacaggaacaaaaguaacaguauua

SEQ ID NO: 48429 - RNA, 330 nt, Artificial Sequence
  derived and/or modified sequence opt6 from anti-HIV_048-237730_VR-Chain
agcguauuaacacaaccaccaagcguaagcggagcaccaggacaaagaguaacaauaagcuguacaggaacaaauagcaauuucggaagcaauuacgcacacugguaccaacaaguaccaggaacagcaccaaaacuauuaauauauagcaauaacgcaagaccaagcggaauaccagacagauucucaggaucaaaaucaggaacaagcgcaacauuaggaauaacaggacuacaaacaggagacgaagcagauuacuauugcggaacaugggacacaucauuaagcgcaggaggaguauuuggaacaggaacaaaaguaacaguacua

SEQ ID NO: 48430 - RNA, 333 nt, Artificial Sequence
  derived and/or modified sequence opt6 from anti-HIV_048-237253_VR-Chain
caaucaguacuaacacaaccaccaucaguaucagcagcaccaggacaaaaaguaacaguaucauguucaggaucaucaucaaauauaggaucaaaugacguaucaugguaccaacaauuuccaggagcagcaccaaaacuauuaauauacaaaaauaacgaaagaccaucaggaauaccagacagauucucaggaucaaaaucaggaacaucagcaacacuaggaauaacaggacuacaaacaggagacgaagcagacuacuacugcggaacaugggacacaucacuaucagcaggaggaguauucggaacaggaacaaaaguaacaguauua

SEQ ID NO: 48431 - RNA, 333 nt, Artificial Sequence
  derived and/or modified sequence opt6 from anti-HIV_048-234100_VR-Chain
caaagcauguuaacacaaccaccaagcguaagcgcagcaccaggagaaaaaguaacaauaagcuguagcggaagcucaagcaauauaggaaaaacauucguaagcugguaccaacaaguaccaggaacagcaccaaaacuauuaauauauaaaaaugacaauagaccaagcggaauaccagacagauucucaggaucaaaaucaggaacaagcgcaacauuaggaauaagcggacuacaaacaggagacgaagcagauuacuauugcggaacaugggacacaucauuaagcggaggaggaguauuuggaacaggaacaaaaguaacaguauua

SEQ ID NO: 48432 - RNA, 333 nt, Artificial Sequence
  derived and/or modified sequence opt6 from anti-HIV_048-230882_VR-Chain
caaagcguauuaacacaaccaccaaguguaagcgcagcaccaggacaaaaaguaacaauaagcuguagcggaaacucaaguaauauaggaagcaauuucguaagcugguaccaacaauuaccaggaacagcaccaaaacuauuaauauaugaaaauaacaaaagaccaagcggaauaccagacagauucucaggaucaaaaucaggaacaagugcaacauuaggaauaacaggacuacaaacaggagacgaagcagauuacuauugcggaacaugggacacaucauuaagcccaggaggaguauuugguacaggaacaaaaguaacaguacua

SEQ ID NO: 48433 - RNA, 333 nt, Artificial Sequence
  derived and/or modified sequence opt6 from anti-HIV_048-229473_VR-Chain
caaagcguauuaacacaaccaccaagcguaagcgcagcaccaggacaaaaaguaacaauaagcuguagcggaagcucaagcaauauaggaaacaauuacguaucaugguaccaacaauuuccaggaacagcaccaaaacuauuaauauaugaaaauaacaaaagaccaagcggaauaccagacagauucucaggaucaaaaucaggaacaacagcaacauuagcaauaacaagacuacaaacaggagacgaagcagauuacuauugcggaacauggggaggaucauuaagcgcaggaggaguauuuggaacaggaacaaaaguaacaguacua

SEQ ID NO: 48434 - RNA, 333 nt, Artificial Sequence
  derived and/or modified sequence opt6 from anti-HIV_048-228238_VR-Chain
caaucaguacuaacacaaccaccaucaguaucagcagcacccggacaaaaaguaacaauaucaugcucaggaucaucaucaaacauaggaauaaacuacguaucaugguaccaacaacuaccaggaacagcaccaaaacuacuaauauacgacaacacaaaaagaccacaaggaauaccagacagauucucaggaucaaaaucaggaacaucagcaacacuagcaauaacaggacuacaaacaggagacgaagcagacuacuacugcggaacaugggacggaucacuaucaacaggaggaguaauaggaacaggaacaaaaguaacaguacua

SEQ ID NO: 48435 - RNA, 333 nt, Artificial Sequence
  derived and/or modified sequence opt6 from anti-HIV_048-228027_VR-Chain
caaucacuauuaacacaaagcccaagcgcaagcggaccaccaggacaaagaguaacaauaagcuguagcggaagcaauagcaauauaggaagcaauacaguaaacugguaccaucacuuaccaggagcagcaccaaaacuauuaauauaugaaaauagcaaaagaccaagcggaauaccagacagauucucaggaucaaaaucaggaacaagcgcaacauuaggaauaacaggacuacaaacaggagacgaagcagauuacuauugcggaacaugggacacaaguuuaagcgcaggaggaguauuuggaucaggaacaaaaguaacaguacua

SEQ ID NO: 48436 - RNA, 333 nt, Artificial Sequence
  derived and/or modified sequence opt6 from anti-HIV_048-227795_VR-Chain
caaucaguauuaacacaaccaccaagcguaagcgcagcaccaggacaaaaaguaacaauaagcuguagcggaagcucaagcaauauagaaagcagaagcguacacugguaccaacaaaaaccaggacaagcaccaguauuaguaauauauuacgauagcgauagaccaaguggaauaccagacagauucucaggaucaaaaucaggaacagcagcaacacuaggaauaacaggacuacaaacaggagacgaagcagauuacuauugcggaacaugggacacaagccuaagcgcaggaggaguauuuggaacaggaacaaaaguaacaguacua

SEQ ID NO: 48437 - RNA, 333 nt, Artificial Sequence
  derived and/or modified sequence opt6 from anti-HIV_048-227770_VR-Chain
caaucaguacuaacacaaccaccaucaguaucaggagcaccaggacaaagaguaacaauaucaugcacaggaucaucaucaaacauaggaccaagagacguacacugguaccaacaacuaccaggaacaguaccaaaacuacuaauauacgacacauacacaagaccaucaggaauaccagacagauucucaggaucaaaaucaggagcaucagcaacacuagacauaacaggacuacaaacaggagacgaagcagacuacuacugcggaauaugggacacaucacuaucagcaggaggaguauucggaacaggaacaaaaguaacaguacua

SEQ ID NO: 48438 - RNA, 333 nt, Artificial Sequence
  derived and/or modified sequence opt6 from anti-HIV_048-225298_VR-Chain
caaucagcauuaacacaaccaagaucaguaucaggaucaccaggacaaucaguaacaauaagcugcacaggaacaucaaacgacguaggauacgacuacguaucaugguaccaacaacuaccaggaacagcaccaaaacuacuaauauacgacauaaacaaaagaccaucaggaauaccagacagauucucaggaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 48439 - RNA, 327 nt, Artificial Sequence
  derived and/or modified sequence opt6 from anti-HIV_048-225090_VR-Chain
gaacuaacacaaccaccaucaguaucaggagcaccaggacaaagaguaacaauaucaugcacaggaucaucaucaaacauaggaggauaugacguacauugguaccaacaacuaccaggaacagcaccaaaacuacuaauauacgacaacaacaaaagaccaucaggaauaccagacagauucucaggaucaaaaucaggaacaucagcaacacuaggaauaacaggacuacaaacaggagacgaagcagacuacuacugcggaacaugggacacaucacuaucaacaggaggaguauucggaacaggaacaaaaguaacaguacua

SEQ ID NO: 48440 - RNA, 333 nt, Artificial Sequence
  derived and/or modified sequence opt6 from anti-HIV_048-224187_VR-Chain
caaucaguacuaacacaaccaccaucagcaucaggaacaccaggacaaagaguaacaauaucauguucaggaucaucagcaaauauaggaacaaauuacguauucugguaccaacacuuaccaggaacaacaccaagacuacuaauauucagaaauaacgaaagaccaucaggaauaccagacagauucucaggaucaaaaucaggaacaucagcaacacuaggaauuacaggacuacaaacaggagacgaagcagacuacuacugcggaacaugggacacaucacuaucagcaggaggaguauuuggaacaggaacaaaaguaacaguacua

SEQ ID NO: 48441 - RNA, 333 nt, Artificial Sequence
  derived and/or modified sequence opt6 from anti-HIV_048-223055_VR-Chain
caaucaguacuaacacaaccaccaucaguaucagcagcaccaggacaaaaaguaacaauaucaugcucaggaucaucaucaaauauaggaaacaacuacguaucaugguaccaacaauucccaggaacagcaccaaaaguauuaauauacggaaacucaaaaagaccaucaggaauaccagacagauucucaggaucaaaaucaggaacaucagcaacacuaggaauaacaggacuacaaacaggagacgaagcagacuacuacugcggaacaugggacacaucacuaucagcaggaggaguauucggaucaggaacaaaaguaacaguacua

SEQ ID NO: 48442 - RNA, 333 nt, Artificial Sequence
  derived and/or modified sequence opt6 from anti-HIV_048-222711_VR-Chain
caaccaguauuaacacaaccaccaagcguaagcggagcaccaggacaacgaguaacaauaagcuguacaggaagcucaagcaauauaggaggauaugacguacacugguaccaacaaguaccaggaacagcaccaaaacuauuaauauuugaaaauaacagaagaccaagcggaauaccagacagauucucaggaucaaaaucaggaacaagcgcaacauuagcaauaacaggacuacaaacaggagacgaagcagauuacuauugcggaacaugggacggaaguuuaagcacaggaggaguaauaggaacaggaacaaaaguaacaguacua

SEQ ID NO: 48443 - RNA, 333 nt, Artificial Sequence
  derived and/or modified sequence opt6 from anti-HIV_048-221209_VR-Chain
caaucaguauuaacacaaccaccaagcguaagcggagcaccaggacaaagaguaacaauaagcuguacaggaaacucaagcaauauaggagacuaugacguacacugguaccaacaaguagcaggaacagcaccaaaacuauuaauauuuaaaaauaacgaaagaccaagcggaauaccagacagauucucaggaucaaaaucaggaacaagcgcaacauuaggaauaacaggacuacaaacaggagacgaagcagauuacuauugcggaacaugggacacaaguuuaagcgcaggaggaguauuuggaucaggaacaaaaguaacaguacua

SEQ ID NO: 48444 - RNA, 333 nt, Artificial Sequence
  derived and/or modified sequence opt6 from anti-HIV_048-220629_VR-Chain
caaucagcauuaacacaaccagcaucaguaucaggaagccuaggacaaucaauaacaauaucauguacaggaacaucaagagauguaggauacucauacguaucaugguaccaacacuuaccaggaacagccccaaaacuauuaauauaugaaaauaacaaaagaccaucaggaauaccagacagauucucaggaucaaaaucaggaacaucagcaacauuaggaauaacaggacuacaaacaggagacgaagcagacuacuauugcggaacaugggacucaucauuaucagcaggaggaguauuuggaacaggaacaaaaguaacaguacua

SEQ ID NO: 48445 - RNA, 333 nt, Artificial Sequence
  derived and/or modified sequence opt6 from anti-HIV_048-219430_VR-Chain
caaucaguacuaacacaaccaccaucaguaucagcagcaccaggacaaaugguaacaauaucaugcucaggaagcacaucaaauauaggaauaaacuacguaucaugguaccaacacguaccaggaacagcaccaaaacuauuaauauacgacaacaacaaaagaccaucaggaauaccagacagauucucaggaucaaaaucaggaacaucagcaacacuaggaauaacaggacuacacacaggagacgaagcagacuacuacugcggaacaugggacacaucacuaucagcaggaggaguauucggaacaggaacaaaaguaacaguacua

SEQ ID NO: 48446 - RNA, 333 nt, Artificial Sequence
  derived and/or modified sequence opt6 from anti-HIV_048-216250_VR-Chain
caaucaguauuaacacaaccaccaagcguaagugcagcaccaggacaaaaaguaacaauaagcuguacaggaacaacaagcgauuucggauacaauugcguaagcugguaccaacaacauccaggcagagcaccaaaaguaauaauaucaggaguaaacaaaagaccaagcggaauaccagacagauucucaggaucaaaaucaggaacaagcgcaacauuaggaauaacaggacuacaaacaggagacgaagcagauuacuauugcggaacaugggacagcucauuaagcgcaggaggaguauuuggaacaggaacaaaaguaacagugcua

SEQ ID NO: 48447 - RNA, 321 nt, Artificial Sequence
  derived and/or modified sequence opt6 from anti-HIV_048-216133_VR-Chain
acacaaccaccaucacuaucagcaacaccaggacaaagaguaucaauaucauguucaggaggaggaaguaacauaggaaauaaugauguauuuugguuucaacaauucccaggagcaggaccaagauuauuaauauacgauaaccauaaaagacacuauggaacaccagauagauuuagcggaaguaaaagcggaacaucagcaacacuagcaauaacaggauuacaaacaggagaugaagcagcauauuacuguggaacaugggauggaucacuaucaacaggaggaguaauaggaacagggacaaaaguaacaguauua

SEQ ID NO: 48448 - RNA, 333 nt, Artificial Sequence
  derived and/or modified sequence opt6 from anti-HIV_048-214886_VR-Chain
caaagcgcauuaacacaaccaagaagcguaagcggaagcccaggacaaagcguaacaauaagcuguacaggaacaucaagcgauguaggauacaauuacguaagcugguaccaacaccauccaggaacagcaccaaaacuauuaauauauaaaaauaacaauagaccaagcggaauaccagacagauucucaggaucaaaaucaggaacaagcgcaacauuaggaauaacaggacuacaaacaggagacgaagcagauuacuauugcggaacaugggacacaucauuaagcgcaggaggaguauuuggaacaggaacaaaaguaacaguacua

SEQ ID NO: 48449 - RNA, 333 nt, Artificial Sequence
  derived and/or modified sequence opt6 from anti-HIV_048-214709_VR-Chain
caaucaguacuaacacaaccaccaucaguaucagcagcaccaggacaaaaaguaacaauaucauguucaggaucaucaucaaacauaggaaacaacuacguaucaugguaccaacaacuaccaggaacagcaccaaaacuauuaauauacgaaaacgacagaagaccaucaggaauaccagacagauucucaggaucaaaaucaggaacaucagcaacacuaggaauaacaggacuacaaacaggagacgaagcagacuacuacugcggaacaugggacacaagccuaucagcaggaggaguauucggaacaggaacaaaaguaacaguacua

SEQ ID NO: 48450 - RNA, 333 nt, Artificial Sequence
  derived and/or modified sequence opt6 from anti-HIV_048-214001_VR-Chain
caaucaguacuaacacaaccaccaucaguaucaggagcaccaggacaaacaguaacaauaucaugcucaggaucaaacucaaacauaggaaaccacgacguacacugguaccaacacguaccaggaacagcaccaaaacuacuaauauacgacaacaacaaaagaccaucaggaauaccagacagauucucaggaucaaaaucaggaacaucagcaacacuaggaauaacaggacuacaaacaggagacgaagcagaauacuacugcgcaacaugggacgcaucacuaucaggaggaggaguauucagaacaggaacaaaaguaacaguacua

SEQ ID NO: 48451 - RNA, 333 nt, Artificial Sequence
  derived and/or modified sequence opt6 from anti-HIV_048-213230_VR-Chain
caaucaguacuaacacaaccaccaucaaugucagcagcaccaggacaaaaaguaacaauaucaugcucaggaucaucaaacaacauaggaaaaaacguaguaucaugguaccaacaacuaccaggaacagcaccaaaaguacuaauauacgaaaacaacaaaagacuaucaggaauaccagacagauucucaggaucaaaaagcggaacaucagcaacacuaguaauaacaggacuacaaacaggagacgaagcagacuacuacugcggaacaugggacucaucacuaucagcaggaggaguauucggaacaggaacaaaaguaacaguacua

SEQ ID NO: 48452 - RNA, 333 nt, Artificial Sequence
  derived and/or modified sequence opt6 from anti-HIV_048-212574_VR-Chain
caaucaguauuaacacaaccaccaagcguaagcgcagcaccaggacaaagaguaacaguaaguuguagcggaagcacaagcaauauagaaagcaauuacguaagcugguaccaacaaguaccaggaacagcaccaaaacuauuaauauaugaaaauaacaaaagaccaagcggaauaccagacagauucucaggaucaaaaucaggaacaagugcaacauuagcaauaacaggacuacaaacaggagacgaagcagcauacuauugcggaacaugggacggcagcuuaagcacaggaggaguaauaggaacaggaacaaaaguaacaguacua

SEQ ID NO: 48453 - RNA, 333 nt, Artificial Sequence
  derived and/or modified sequence opt6 from anti-HIV_048-212207_VR-Chain
caaucaguacuaacacaaccaccaucacuaucagcagcaccaggacaaaaaguaacaauaucaugcuccggaggaucaucaaacauaggaaacaacuacguaucaugguaccaacaccuaccaggaacagcaccaaaacuacuaauauacgacaacuacaaaagaccaucaggaauaccagacagauucucaggaucaaaaucaggaacaucagcaacacuagacauaacaggacuacaaacaggagacgaagcagacuacuacugcggaacaugggacacaagccuaucagcaggaggaguauucggaacaggaacaaaaguaacaguacua

SEQ ID NO: 48454 - RNA, 333 nt, Artificial Sequence
  derived and/or modified sequence opt6 from anti-HIV_048-209146_VR-Chain
caaucaguauuaacacaaccaccaucaguaucaggagcaccaggacaaaaaauaacaguaucauguacaggaacaacaucaaauauaggaccacaugacguacacugguaccaacuaguaccaggaagaccaccaaaacuauuaauauuccacaauaacauaagaccaucaggaauaccagacagauucucaggaucaaaaucaggaaugucagcaacauuaggaauaacaggacuacaaacaggagacgaagcagacuacuacugcggaacaugggacucaucauuaucagcaggaggaguauuuggaacaggaacaaaaguaacaguacua

SEQ ID NO: 48455 - RNA, 333 nt, Artificial Sequence
  derived and/or modified sequence opt6 from anti-HIV_048-208206_VR-Chain
caaucaguacuaacacaacccccaucaguaucagcagcaccaggacaaaaaguaacaauaagcugcucaggaucaucaucaaacauaggaucaaacuacguaucaugguaccaacaauucccaggaacagcaccaagacuacuaauauacgaaaacgacaaaagaccaucagcaauaccagacagauucuccggaucaaaaucaggaacaucagcaacacuaggaauaacaggacuacacacaggagacgaagcagacuacuacugcggaacaugggacggaucacuaucaacaggaggaguaauaggaacaggaacaaaaguaacaguacua

SEQ ID NO: 48456 - RNA, 333 nt, Artificial Sequence
  derived and/or modified sequence opt6 from anti-HIV_048-208194_VR-Chain
caaucagcauuaacacaaccaccaucagcaucaggaucaccaggacaaucaguaacaauaucauguacaggaacaucaucagacauaggauacaaauacguaucaugguaccaacuacuaccaggaacaccaccaaaacuauuaauauucaaaaauaacgaaagaccaucaggaauaccagacagauucucaggaucaaaaucaggaacaagcgcaacauuaggaauaacaggacuacaaacaggagacgaagcagacuacuauugcggagcaugggacacaucauuaucagcaggaggaguauucggaacaggaacaaaaguaacaguacua

SEQ ID NO: 48457 - RNA, 333 nt, Artificial Sequence
  derived and/or modified sequence opt6 from anti-HIV_048-207744_VR-Chain
caaucagcacuaacacaaccagcaucaguaucagcaucauucggacaaucaauaacaauaucaugcacaggagcagcaucaacaauaggaaacaaccuaguaucaugguacagacuacuaccaggaacagcaccaaaacuacuaauauacaaaaacgacaacagaccaucaggaauaccagacagauucucaggaucaaaaucaggaacaucagcaacacuaggaauaucaggacuacaaacaggagacgaagcagacuacuacugcggaacaugggacacaucacuaucaggaggaggaguauucggaacaggaacaaaaguaacaguacua

SEQ ID NO: 48458 - RNA, 333 nt, Artificial Sequence
  derived and/or modified sequence opt6 from anti-HIV_048-206501_VR-Chain
caaucaguauuaacacaaccaccaucaguaaguggagcaccaggacaaagaguaacaauaucauguucaggaucaucaucaaauauaggaaacaacgcaguaaacugguaccaacaacuaccaggaaaagcaccaaaacuauuaauauacgaaaauaacaaaagaccaucaggaauaccagacagauucucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguauua

SEQ ID NO: 48459 - RNA, 333 nt, Artificial Sequence
  derived and/or modified sequence opt6 from anti-HIV_048-204221_VR-Chain
caaucaguacuaacacaaccaccaucagcaucaggaacaccaggacaaagaguaacaauaucaugcuucggaucaucaucaaacauagcaucaucagcaguaaacugguaccaacaacuacccggaacagcaccaaaacuacuaauauacaaaaacgacaaaagaccaucaggaauaccagacagauucucaggaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 48460 - RNA, 333 nt, Artificial Sequence
  derived and/or modified sequence opt6 from anti-HIV_048-204015_VR-Chain
caaucaguauuaacacaaccaccaagcgcaagcggaacaccaggacaaagaguaacaauaagcuguagcggaucaucaagcaauauaggaagcaaauacguauacugguaccaacaauuaccaggaacagcaccaaaacuauuaauauauaaaaaugacaauagaccaagcggaauaccagacagauucucaggaucaaaaucaggaacaagcgcaacauuaggaauaagcggacuacaaacaggagacgaagcagauuacuauugcggaacaugggacaccagcuuaagcggaggaggaguauuuggaacaggaacaaaaguaacaguacua

SEQ ID NO: 48461 - RNA, 333 nt, Artificial Sequence
  derived and/or modified sequence opt6 from anti-HIV_048-201240_VR-Chain
caaucaguacuaacacaaccaccaucaguaucagcagcaccaggacaaaaaguaacaauaucaugcucaggaucaucaucaaacauaggaaacaacuacguagcaugguaccaacaacuaccaggaacagcaccaaaacuacuaauaaaagaaaacucacaacgaccaucaggaauaccagacagauucucaggaucaaaaucaggaacaucagcaacacuagcaauaacaggacuacaaacaggagacgaagcagacuacuacugcggaacaugggacacaucacuaucaacaggaggaguauucggaacaggaacaaaaguaacaguacua

SEQ ID NO: 48462 - RNA, 333 nt, Artificial Sequence
  derived and/or modified sequence opt6 from anti-HIV_048-200455_VR-Chain
caaucagcauuaacacaaccagcaucaguaucaggaucaccaggacaaucaauaacaauaucauguacaggaacaucaucagauguaggauacaauuacguaucaugguaccaaguacuaccaggaacagcaccaaaacuacuaauauacaaaaacacagaaagaccaucaggaauaccagacagauucucaggaucaaaaucaggaacaucagcaacacuagacauaacaggacuacaaacaggagacgaagcagacuacuauugcggaacaugggacacaucacuaucagcaggaggaguauucggaacaggaacaaaaguaacaguacua

SEQ ID NO: 48463 - RNA, 333 nt, Artificial Sequence
  derived and/or modified sequence opt6 from anti-HIV_048-200319_VR-Chain
caaagcguaguaacacaaccaccaagcgcaagcggaacaccaggacaaagaguaacaauaagcuguucaggaaguucaucaaauauaggaagcaaauacguauacugguaccaucaacauccaggaacagcaccaaaacuauuaauauaugacaauaacaauagaccaagcggaauaccagacagauucucaggaucaaaaucaggaacaagcgcaacauuaggaauaacaggacuacaaacaggagacgaagcagauuacuauugcggaacaugggacacaucauuaagcagaggaggaguauuuggaacaggaacaaaaguaacaguacua

SEQ ID NO: 48464 - RNA, 333 nt, Artificial Sequence
  derived and/or modified sequence opt6 from anti-HIV_048-197896_VR-Chain
caaucaguacuaacacaaccaccaucaguaucagcagcaccaggacaaaaaguaacaauaucaugcucaggagcaucauacaacauaggaaaaaacucaguaucaugguaccaacaacuaccaggaacaccaccaaaacuauuaauauucaaaaacaacgaaagaccaucaggaauaccagacagauucucaggaucaaaaucaggaacaucagcaacacuaggaauaacaggacuacaaacaggagacgaagcagacuacuacugcgcaacaugggacacaucacuaucagcaggaggaguauucggaacaggaacaaaaguaacaguacua

SEQ ID NO: 48465 - RNA, 333 nt, Artificial Sequence
  derived and/or modified sequence opt6 from anti-HIV_048-193813_VR-Chain
caaucaguacuaacacaaucaccaucaguaucagcagcaccaggacaaaaaguaacaauaucaugcucaggaucaaacucaaacguaggaaacuacuacguaucaugguaccaacaccuaccaggaacagcaccaaaaguacuaauauacgaaggaaacaaaagaccaucaggaguaccagacagauucucaggaucaaaaucaggaacaucagcaucacuagcaauaacaggacuacaaacaggagacgaagcagacuacuacugcggaacaugggacacaucauuaucagcaggaggaguauucggaucaggaacaaaaguaacaguacua

SEQ ID NO: 48466 - RNA, 333 nt, Artificial Sequence
  derived and/or modified sequence opt6 from anti-HIV_048-192098_VR-Chain
caaucaguacuaacacaaccaccaucagcaucaggaaccccaggacaaagaguaacaauaucaugcucaggaucaacaucaaacauaggaagcaacuacguauacugguaccaacaacuaccaggaacaacaccaaaacuacuaauauacgaaaacaacaaaagaccaucaggaauaacagacagauucuucggaucaaaaucaggaccaagcgcaacacuagacauaacaggacuacaaacaggagacgaagcagacuacuacugcggaacaugggacgcaucacuaucagcaggaggaguauucggaacaggaacaaaaguaacaguacua

SEQ ID NO: 48467 - RNA, 333 nt, Artificial Sequence
  derived and/or modified sequence opt6 from anti-HIV_048-191786_VR-Chain
caaucaguauuaacacaaccaccaagcguaagugcagcaccaggacaaaacguaaacauaagcuguaguggaagcucaagcaauauagaaaacaauuucguaagcugguaccaaaaacuaccaggaacagcaccaaaacuauuaauauaugacaauaacaaaagaccaagcggaauaagagacagauucucaggaucaaaaucaggaacaagcgcaacauuaggaauaacaggacuacaaacaggagacgaagcagauuacuauugcggaacaugggacacaaguuuaagcgcaggaggaguauuuggaucaggaacaaaaguaacaguacua

SEQ ID NO: 48468 - RNA, 333 nt, Artificial Sequence
  derived and/or modified sequence opt6 from anti-HIV_048-188746_VR-Chain
caaucaguauuaacacaaccaccaucagcaucaggaacaccaggacaaaaaguaacaauaucauguucaggaucaaauucaaauauaggaucaaauuucguaucaugguaccaacuauuaccaggaacaacaccaaaacuauuaauauaccgaaacaaccaaagaccaucaggaguaccagacagauucucaggaucaaaaucaggaacaucagcaacauuaggaauaacaggacuacaaacaggagacgaagcagacuacuacugcggaacaugggacucaucacuaucagcaggaggaguauuuggaacaggaacaaaaguaacaguacua

SEQ ID NO: 48469 - RNA, 333 nt, Artificial Sequence
  derived and/or modified sequence opt6 from anti-HIV_048-185937_VR-Chain
caaucaguacuaacacaaccaccaucaguaucagcagcaccaggacaaaaaguaacaauaucaugcucaggaagcucaucaaacauaggaaacaacuacguaucaugguaccaacaacuaccaggaacagcaccaaaacuacuaauauacgaaaacaacaaaagaccaucaggaauaccauacccaauaucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 48470 - RNA, 333 nt, Artificial Sequence
  derived and/or modified sequence opt6 from anti-HIV_048-184849_VR-Chain
caaucaguauuaacacaagcaccaagcgcaagcggaacaccaggacaaacaguaacaauaagcuguagcggaagcucaagcaauauaggaaccaaauacguauacugguaccaacaauuaccaggaacagcaccaaaacuauuaauauauaaaaauaacgaaagaccaagcggaauaccagacagauucucaggaucaaaaucaggaacaagcgcaacauuaggaauaacaggacuacaaacaggagacgaagcagauuacuauugcggaacaugggacacaaguuuaagcccaggaggaguauuuggaacaggaacaaaaguaacaguacua

SEQ ID NO: 48471 - RNA, 333 nt, Artificial Sequence
  derived and/or modified sequence opt6 from anti-HIV_048-183089_VR-Chain
caaucaguacuaacacaaccaccaucagcaucaggaacaccaggacaaagaguaacaauaucaugcucaggaucaucaucaaacauaggauccucauacguauacugguaccaacuacuaccaggaacaccaccaaaacuacuaauauucaaaaacaacgaaagaccaucaggaauaccagacagauucucaggaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 48472 - RNA, 333 nt, Artificial Sequence
  derived and/or modified sequence opt6 from anti-HIV_048-181509_VR-Chain
caaucaguacuaacacaaccaccaucaguaucaggagcaccaggacaaagaguaacaauaucauguacaggaucaucaucaaauauaggaggauaugacguacacugguaccaucaauuaccaggagcagcaccaaaacuauuaauauacaaaaaugacaauagaccaucaggaauaccagacagauucucaggaucaaaaucaggaacaucagcaacauuaggaauaucaggacuacaaacaggagacgaagcagacuacuacugcggaacaugggacacaucacuaucaggaggaggaguauuuggaacaggaacaaaaguaacaguacua

SEQ ID NO: 48473 - RNA, 333 nt, Artificial Sequence
  derived and/or modified sequence opt6 from anti-HIV_048-180990_VR-Chain
caaucaguauuaacacaaccaccaucaguaagcgcagcaccaggacaaagaguaacaauaagcuguagcggaagcacaagcaauauaggaaacaauuacguaagcugguaccaacacuuuccaggaaaaguaccaaaaguaguaauaucagaaacaacaaaaagaccaagcggaauaccagacagauucucaggaucaaaaucaggaacaagcgcaacauuaggaauaacaggacuacaaacaggggacgaagcagauuacuauugcggaacaugggacagcucauuaagcgcaggcggaguauuuggaacaggaacaaaaguaacaguacua

SEQ ID NO: 48474 - RNA, 333 nt, Artificial Sequence
  derived and/or modified sequence opt6 from anti-HIV_048-177532_VR-Chain
caaucagcacuaacacaaccaccaucagcaucaggaucacuaggacaaucaguaacaauaucaugcacaggaacaucaucagacguaggaaacaacuucguaucaugguaccaaaaaaaaccaggaaaagcaccaaaacuaauaguauacgaaguaaacaaaagaccaucaggaauaccagacagauucagcggaucaaaaucaggaacaucagcaacacuaggaauaacaggacuacaaacaggagacgaagcagacuacuacugcggaacaugggacacaucacuaucaacaggaggaguauucggaacaggaacaaaaguaacaguacua

SEQ ID NO: 48475 - RNA, 324 nt, Artificial Sequence
  derived and/or modified sequence opt6 from anti-HIV_048-177426_VR-Chain
uuaacacaaccacauucaguaagugaaucaccaggaaaaacaguaacaauaucauguacaggaacaucaucagauguaggauacaauuacguaucaugguaccaacaccauccaggaaaagcaccaaaacuauuaauauaugaaguaacaaaaagaccaucaggaauaccagacagauucaguggaucaaaaucaggaacaucagcaacauuaggaauaacaggacuacaaacaggagacgaagcagauuacuauugcggaacaugggacucaucacuaucagcaggaggaguauuuggaacaggaacaaaaguaacaguacua

SEQ ID NO: 48476 - RNA, 333 nt, Artificial Sequence
  derived and/or modified sequence opt6 from anti-HIV_048-177389_VR-Chain
caaucaguauuaacacaaccaccaagcaugagcgcagcaccaggagaaagaguaacaauaagcuguagcggaagcucaagcaauauaggaaaccaucacguaagcugguaccaacaaagaccaggaacagcaccaaaacuauuaauauaugaaaauaacgaaagaccaagcggaauaccagacagauucucaggaucaaaaucaggaacaagcgcaacauuaggaauaacaggacuacaaacaggagacgaagcagauuacuauugcggaacaugggacaccagcuuaagcgcaggaggaguauuuggaucaggaacaaaaguaacaguacua

SEQ ID NO: 48477 - RNA, 333 nt, Artificial Sequence
  derived and/or modified sequence opt6 from anti-HIV_048-174266_VR-Chain
caaucaguauuaacacaaccaccaucaguaucaggagcaccaggacaaagaguaacaauaucaugcucaggaucaucaucaaauauaggaucacauuacguaucaugguaccaacaaguaccaggaacagcaccaagauuaguaauauaugacacaauaaaaagacauucaggaauaccagacagauucucaggaucaaaaucaggaacaucagcaacacuaggaauaacaggacuacaaacaggagacgaagcagauuacuauugcggaacaugggacacaucauuaucagcaggaggaguauuuggaacaggaacaaaaguaacaguacua

SEQ ID NO: 48478 - RNA, 333 nt, Artificial Sequence
  derived and/or modified sequence opt6 from anti-HIV_048-172847_VR-Chain
caaagcguauuaacacaaccaccaaguguaagcgcagcaccaggacaaagaguaacaguaagcuguagcggaagcacaagcaauauagaaagcaauuacguaagcugguaccaacaaguaccaggaacagcaccaaaauuauuaauauaugaaaauaacaaaagaccaagcggaauaccagacagauucucaggaucaaaaucaggaacaagcgcaacauuaggaauaacaggacuacaaacaggagacgaagcagauuacuauugcggaacaugggacacaucauuaagcgcaggaggaguauuuggaacaggaacaaaaguaacaguacua

SEQ ID NO: 48479 - RNA, 333 nt, Artificial Sequence
  derived and/or modified sequence opt6 from anti-HIV_048-172845_VR-Chain
caaagcgcauuaacacaaccaccaagcgcaagcggaagcccaggacaaagcguaacaauaucauguacaggaacaucaagcgauguaggauacaauuacguaagcugguaccaacaauuaccaggaacagcaccaaaacuauuaauauauagaaauaaccaaagaccaagcggaguaccagacagauucucaggaucaaaaucaggaacaucagcaacauuaggaauaacaggacuacaaacaggagacgaagcagauuacuauugcgcaacaugggacacaucauuaagcgcaggaggaguauuuggaacaggaacaaaaguaacaguacua

SEQ ID NO: 48480 - RNA, 333 nt, Artificial Sequence
  derived and/or modified sequence opt6 from anti-HIV_048-172363_VR-Chain
caaucaguacuaacacaaccaccaucaguaucagcagcaccaggacaaaaaguaacaauaucaugcucaggaucaggaucaaacauaggaaacacauacguaucaugguaccaacaacuaccaggaacagcaccaaaacuacuaauauucgaagacaacaaaagaccaucaggaauaccagacagauucucaggaucaaaaucaggaacaucagcaacacuagcaauaacaggauuacaaacaggagacgaagcagacuacuacugcggaacaugggacucaucacuaucaggaggaggaguaauaggaacaggaacaaaacuaacaguacua

SEQ ID NO: 48481 - RNA, 333 nt, Artificial Sequence
  derived and/or modified sequence opt6 from anti-HIV_048-171609_VR-Chain
caaucaguacuaacacaaccaccaucaguaucagcagcaccaggacaagaaguaacaauaucaugcucagcaucaucaucaucaauaggaaacgacuucguaucaugguaccaacaacuaccaggaacagcaccaaaauuacuaauauacggaaauucaaacagaccaucaggaauaccagacagauucucaggaucaaaaucaggaacaucagcaacacuaggaauaacaggauuacaaacaggagacgaagcagacuacuacugcggaacaugggacacaucacuaucaacaggaggaguauucggaacaggaacaaaaguaacaguacua

SEQ ID NO: 48482 - RNA, 333 nt, Artificial Sequence
  derived and/or modified sequence opt6 from anti-HIV_048-170705_VR-Chain
caaucaguacuaacacaaccaccaucaguaucagcagcaccaggacaaaugguaacaauaucaugcucaggaucaacaucaaacauaggaauaaacuacguaucaugguaccaacacguaccaggaacagcaccaaaacuacuaauauacgaaaacguagaaagaagaucaggaauaccagacagauucucagcaucaaaaucagcaacaucagcaacacuaggaauaacaggacuacaaacaggagacgaagcagacuacuacugcggaacaugggacacaucacuaucagcaggaggagucuucggaucaggaacaaaaguaacaguacua

SEQ ID NO: 48483 - RNA, 333 nt, Artificial Sequence
  derived and/or modified sequence opt6 from anti-HIV_048-168381_VR-Chain
caaucagcacuaacacaaccagcaagcguaagcggaagcccaggacaaagcauaacaauaagcuguacaggaacaucaagcaauauaggaagcaauuacguaagcugguaccaacaauuaccaggaacagcaccaaaauuauuaauauaugaaaauaaccaaagaccaagcggaauaccagacagauucucaggaucaaaaucaggaacaagcgcaacauuaggaauaacaggacuacaaacaggagacgaagcagauuacuauugcggaacaugggacacaaguuuaagcgcaggaggaguauuuggaucaggaacaaaaguaacaguauua

SEQ ID NO: 48484 - RNA, 333 nt, Artificial Sequence
  derived and/or modified sequence opt6 from anti-HIV_048-166619_VR-Chain
caaucaguauuaacacaaccaccaagcguaagcggagcaccaggacaaagaguaacaauaagcuguacaggaagcucaagcaauauaggaggcuaucacacacacugguaccaacaauuaccaggaacagcaccaaaacuauuaauauaugaaaauaguaaaagaccaagcggaauaccagacagauucucaggaucaaaaucaggaacaagcgcaacauuaggaauaacaggacuacaaacaggagacgaagcagauuacuauugcggaacaugggacacaucauuaagcgcaggaggaguauuuggaagcggaacaaaaguaacaguacua

SEQ ID NO: 48485 - RNA, 333 nt, Artificial Sequence
  derived and/or modified sequence opt6 from anti-HIV_048-162036_VR-Chain
caaagcguacuagcacaaccaccaucaguaucaggagcaccaggacaaacaguaacaauaucaugcacaggaucaaguucaaacauaggaggauacgauguacacugguaucaacaacuaccaggaacagcaccaaaauuacuaauauacaaagacgauaaaagaccaucaggaauaccagacagauucagcggaagcaaaagcggaacaucagcaacauuaggaauaacaggauuacaaacaggagaugaagcagacuauuacugcggaacaugggacacaucacuaaauagaggaggaguauucggaacaggaacaaaaguaacaguauua

SEQ ID NO: 48486 - RNA, 333 nt, Artificial Sequence
  derived and/or modified sequence opt6 from anti-HIV_048-160042_VR-Chain
caaucaguacuaacacaaccaccaucaguaucagcagcaccaggacaaaaaguaacaauaucaugcucaggaucaucaucaaacauaggaauaaacuacauaucaugguaccaacaacuaccaggaacagcaccaaaaauacuaauauacgacaacgacaaaagaccauuaggaauaccagacagauucucaggaucaaaaucaggaacaucagcaacacuaggaauaacaggacuacaaacaggagacgaagcagacuacuacugcggaacaugggacgcaagccuaucagcaggaggaguauucggaacaggaacaaaaguaacaguacua

SEQ ID NO: 48487 - RNA, 333 nt, Artificial Sequence
  derived and/or modified sequence opt6 from anti-HIV_048-159676_VR-Chain
caaucaguauuaacacaaccaccaagcguaagcgcaagcccaggacaaaaaguaacaauaagcuguagcggaaguucaagcgauauaggaagcaauuacguaagcugguacguacaauuaccaggaacagcaccaaaacuacuaauauauaaaaauaacgaaagaccaagcggaauaccagacagauucucaggaucaaaaucaggaacaagcgcaacauuaggaauaacaggacuacaaacaggagacgaagcagauuacuauugcggaacaugggacacaaguuuaagcgcaggaggaguauuuggaacaggaacaaaaguaacaguacua

SEQ ID NO: 48488 - RNA, 333 nt, Artificial Sequence
  derived and/or modified sequence opt6 from anti-HIV_048-159500_VR-Chain
caaucaguacuaacacaaccaccaucaguaucagcagcaccaggacaaaacguaacaauaucauguucaggaucauggucaaauauaggagcaaauuacguaucaugguaccaacaauuaccaggaacagcaccaaaacuacuaauauacgaaaauaacaaaagaccaucaggaauaccagacagauucucaggaucaaaaucaggaacaagcgcaacacuaggauucacaggacuacaaacaggagacgaagcagacuacuacugcggaacaugggacacaucacuaucagcaggaggaguauucggaacaggaacaaaaguaacaguacua

SEQ ID NO: 48489 - RNA, 333 nt, Artificial Sequence
  derived and/or modified sequence opt6 from anti-HIV_048-159421_VR-Chain
caaucacuauuaacacaagcaccaucaguaucagcagcaccaggacaaacaguaacaauaucauguucaggaucaaaugcagauauaggaaaaaauuucguaucaugguaccaacaaucaccaggagcagcaccaaaacuauuaauauaugaaaaugacagaagaccaucaggaauaccagacagauucucaggaaguaaaucaggaacaagcgcaacauuaggaauaacaggacuacaaacaggagacgaagcagaauacuauugcgcaacaugggacgcaucauuaucaggaggaggaguauuuggaacaggaacuaaaguaacaguacua

SEQ ID NO: 48490 - RNA, 333 nt, Artificial Sequence
  derived and/or modified sequence opt6 from anti-HIV_048-159333_VR-Chain
caaucaguauuaacacaaccaccaagcgcaagcggaacaccaggacaaagaguaacaauaagcuguagcggaaguaauagcaauauaggaagcgauagcguauacugguaccaacaauuaccaggaagaucaccaaaacuauuaauauauagaaauaacgaaagaccaagcggaauaccagacagauucucaggaucaaaaucaggaacaagcgcaacauuaggaauaacaggacuacaaacaggagacgaagcagauuacuauugcggaacaugggacacaaguuuaagcgcaggaggaguauuuggaacaggaacaaaaguaacaguacua

SEQ ID NO: 48491 - RNA, 333 nt, Artificial Sequence
  derived and/or modified sequence opt6 from anti-HIV_048-158932_VR-Chain
caaagcguauuaacacaaccagcaaguguaagcggaagcccaggacaaagcauaacaauaaguuguagcggaagcucaagcaauauaggagacauauucguaaguugguaccaacaaguaccaggagcagcaccaaaacuauuaauauaugacaaugacaaaagaccaagcggaauaccagacagauucucaggaucaaaaucaggaacaagcgcaacauuagacauaacaggacuacaaacaggagacgaagcagauuacuauugcggaacaugggacacaucauuaagcgcaggaggaguauuuggaacaggaacaaaaguaacaguacua

SEQ ID NO: 48492 - RNA, 333 nt, Artificial Sequence
  derived and/or modified sequence opt6 from anti-HIV_048-155811_VR-Chain
caaucagcauuaacacaaccagcaucaguaucaggaucaccaggacaaucaauaacaauaucauguacaggaacaucaucagacguaggauacgacuacguaucaugguaccaacuauuaccaggaacaccaccaaaacuacuaauauucaaaaauaacgaaagaccaucaggaauaccagacagauucucaggaucaaaaucaggaacaucagcaacacuaggaauaacaggacuacaaacaggagacgaagcagacuacuacugcgcaacaugggacacaucauuaucagcaggaggaguauuuggaacaggaacaaaaguaacaguacua

SEQ ID NO: 48493 - RNA, 333 nt, Artificial Sequence
  derived and/or modified sequence opt6 from anti-HIV_048-155464_VR-Chain
caaucagcauuaacacaaccagcaaguguaagcggaagcccaggacaaagcauaacaauaagcuguacaggagcaacaggagauagcggacacacauacguaagcugguaccaacaauuaccaggaacagcaccaaaacuauuaauauauagcaauaacgaaagaccaagcggaguaccagacagauucucaggaucaaaaucaggaacaagcgcaacacuaggaauaacaggacuacaaacaggagacgaagcagauuacuauugcggaacaugggacacaucauuaagcgcaggaggaguauuuggaagcggaacaaaaguaacaguacua

SEQ ID NO: 48494 - RNA, 333 nt, Artificial Sequence
  derived and/or modified sequence opt6 from anti-HIV_048-155392_VR-Chain
caaucaguacuaacacaaccaccaucaguaucagcagcaccaggacaaaugguaacaauaucaugcucaggaucaucaucaaacauaggagacaacuacguaucaugguaccaacaacuaccaggaagaggaccaaaacuauuaguauacgacacauacaaaagauaccuagaaacaccagacagauucucaggaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 48495 - RNA, 333 nt, Artificial Sequence
  derived and/or modified sequence opt6 from anti-HIV_048-155389_VR-Chain
caaucaguacuaacacaaccaccaucaguaucagcagcaccaggacaaaaaguaacaauaucaugcucaggaauaucaucaaacauaggaaacaacccaguaucaugguaccaacaauucccaggaacagcaccaaaacuacuaauauacaaaaacgacaaaagaccaucaggaauaccagacagauucucaggaucaaaaucaggaacaucagcaacacuaggaauaacaggacuacaaacaggagacgaagcagacuacuacugcggaacaugggacacaucacuaaguacaggaggaguauucggaacaggaacaaaaguaacaguacua

SEQ ID NO: 48496 - RNA, 333 nt, Artificial Sequence
  derived and/or modified sequence opt6 from anti-HIV_048-154449_VR-Chain
caaucaguauuaaaacaaccaccaucaguaucaggagcaccaggacuaagaguaacaauaucauguacaggaggaucaucaaauauaggaggauuugacguacacugguaccaacacuuuccaggaacagcaccaaaacuauuaauauaugacaaugaccaaagaccaucaggaauaccagacagauucucaggaucaaaaucaggaacaucagcaacacuaggaauaacaggacuacaaacaggagacgaagcagauuacuauugcggaacaugggacucaucauuaucagcaggaggaguauuuggaacaggaacaaaaguaacaguacua

SEQ ID NO: 48497 - RNA, 333 nt, Artificial Sequence
  derived and/or modified sequence opt6 from anti-HIV_048-153379_VR-Chain
caaucaguauuaacacaaccaccaucaguaucagcaacaccaggacaaaaaguaacaauaucaugcucaggaucaagaucaaacauaggaucacacuacguaucaugguaccaacaauucccagaaucagcaccaaaacuacuaauauacaaaaacgacaacagaccaucaggaauaccagacagauucucaggaucaaaaucaggaacaucagcaacauuaggaauaucaggacuacaaacaggagacgaagcagacuacuacugcggaacaugggacacaucacuaucaggaggaggaguauucggaacaggaacaaaaguaacaguacua

SEQ ID NO: 48498 - RNA, 333 nt, Artificial Sequence
  derived and/or modified sequence opt6 from anti-HIV_048-153171_VR-Chain
caaucaguacuaacacaaccaccaagcguaucagcagcaccaggacaaaaaguaacaauaucaugcucaggaucaacaucaaacauagaagacauauacguaucaugguaccaacaccuaccaggaacagcaccaaaacuacuaauauacgacaacaacaaaagaccaucaggaauaccagacagauucucaggaucaaaaucaggaacaucagcaacacuagcaauaacaggacuacaaacaggagacgaagcagacuacuacugcggaaccugggacacaucacuaucagcaggaggaguauucggaacaggaacaaaaguaacaguacua

SEQ ID NO: 48499 - RNA, 333 nt, Artificial Sequence
  derived and/or modified sequence opt6 from anti-HIV_048-152324_VR-Chain
caaucaaugguaacacaaucaccaucaguaucagcagcaccaggacaaaaaguaacaauaagcuguagcggaacaucaucaaauauaggacaaaauuacguaucaugguaccaacaauuaccaggaacagcaccaaaacuauuaauauaugaaaauagcaaaagaccaagcggaauaccagacagauucucaggaucaaaaucaggaacaucagcaacauuaggaauaacaggacuacaaacaggagacgaagcagauuacuauugcggaacaugggacacaagccuaucagcaggaggaguauuuggaucaggaacaaaaguaacaguacua

SEQ ID NO: 48500 - RNA, 333 nt, Artificial Sequence
  derived and/or modified sequence opt6 from anti-HIV_048-146102_VR-Chain
caaucaguacuaacacaaccaccaucaguaucagcagcaccaggacaaaaaguaacaauaagcugcucaggaucaucaucaacaauaggaaacaacuacauaucaugguaccaacuacuaccaggaacaccaccaaaacuacuaauauacaaaaacaacgaaagaccaucaggaauaccagacagauucucaggaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 48501 - RNA, 333 nt, Artificial Sequence
  derived and/or modified sequence opt6 from anti-HIV_048-145984_VR-Chain
caaucaguauuaacacaaccauuaucaguuucaggagcaccaggacaaagaguaacaauaucauguacaggaucaucaucaaacauaggaucaaauuucguaucaugguaccaaguauuaccaggaacaacaccaaaacuauuaauauuuaaaaauaacgaaagaccaagcggaauaccagacagauucucaggaucaaaaucaggaacaucagcaacauuaggaauaacaggacuacaaacaggagacgaagcagauuacuauugcggagcaugggacacaucauuaagcgcaggaggaguauuuggaacaggaacaaaaguaacaguacua

SEQ ID NO: 48502 - RNA, 333 nt, Artificial Sequence
  derived and/or modified sequence opt6 from anti-HIV_048-145371_VR-Chain
caaucaguacuaacacaaccaccaucaguaucagcagcaucaggacaaaaaguaucaauaccaugcucaggaggaacaucaaacauaggagacaacuacguaucaugguuccaacaauucccaggaucagcaccaaaaauacuaauauacgacucagacaaaagaccaucaagaauaucagacagauucucagcaucaaaaucaggaacaucagcaacacuagacauaacaagacuacaaacaggagacgaagcagacuacuacugcggaacaugggacacaucacuaucagcaggaggaguauucggaacaggaacaaaaguaacaguacua

SEQ ID NO: 48503 - RNA, 333 nt, Artificial Sequence
  derived and/or modified sequence opt6 from anti-HIV_048-144907_VR-Chain
caaucagcauuaacacaaccagcaucaguaagcggaucaccaggacaaucaauaacaauaucauguacaggaacaagaagagauguaggauucaauuacguaucaugguaccaacaacauccaggaacagcaccaaaacuauuaauauaugaaaauaacaaaagaccaucaggaauaccagacagauucucaggaucaaaaucaggaacaucagcaacauuaggaauaacaggacuacaaacaggagacgaagcagacuacuauugcggaaccugggacucaucauuaucagcaggaggaguauuuggaacaggaacaaaaguaacaguacua

SEQ ID NO: 48504 - RNA, 333 nt, Artificial Sequence
  derived and/or modified sequence opt6 from anti-HIV_048-142298_VR-Chain
caaucaguacuaacacaaccaccaucagcaucaggaacaccaggacaaagaguaacaauaucaugcucaggaucaucaucaacaauaggaaacaacuacauaucaugguaccaacuacuaccaggaacaccaccaaaacuacuaauauucaaaaacaacgaaagaccaucaggaauaccagacagauucucagcaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 48505 - RNA, 333 nt, Artificial Sequence
  derived and/or modified sequence opt6 from anti-HIV_048-142277_VR-Chain
caaucaguacuaacacaaccaccaucaguaucaggagcaccaggacaaagaauaacaauaucaugcacaggaucaucaucaaacauaggagcauacgacguacaaugguaccaacaccuaccaggaacagcaccaaaacuacuaauauacaaaaacacagaaagaccaucaggaauaccagacagauucagcggaucaaaaucaggaacaucagcaacacuagacauaacaggacuacaaacaggagacgaagcagacuacuacugcggaacaugggacacaucacuaucagcaggaggaguauucggaacaggaacaaaaguaacaguacua

SEQ ID NO: 48506 - RNA, 333 nt, Artificial Sequence
  derived and/or modified sequence opt6 from anti-HIV_048-141934_VR-Chain
caaucaguauuaacacaaccaccaagcguaagcggagcaccaggacaaagaguaacaauaagcuguacaggaaacucaagcaauauaggagcauaugacguacacugguaccaacaauuaccaggaacagcaccaaaacuaaugauauaugaaguaagcaaaagaccaagcggaauaccagacagauucucaggaucaaaaucaggaacaagcgcaacauuaggaauaacaggauuacaaacaggagacgaagcagauuacuauugcggaacaugggacacaucauuaagcgcaggaggaguauuuggaagcggaacaaaaguaacaguacua

SEQ ID NO: 48507 - RNA, 333 nt, Artificial Sequence
  derived and/or modified sequence opt6 from anti-HIV_048-141207_VR-Chain
caaucaguauuaacacaaccaccaucaguaucagcagcaccaggacaaaaaguaacaauagcaugcucaggaucaucaucaaacauaggaaacaacuacguaucaugguaccaacaacuaccaggaacagcaccaaaacuacuaauauacgcaaacaacagaagaccaucaggaauaccagacagauucucagcaucaaaaucaggaacaucagcaacacuaggaauaacaggacuacaaacaggagacgaagcagacuacuacugcggaacaugggacacaucauuaucagcaggaggaguauucggaacaggaacaaaaguaacaguacua

SEQ ID NO: 48508 - RNA, 333 nt, Artificial Sequence
  derived and/or modified sequence opt6 from anti-HIV_048-140796_VR-Chain
caaucaguacuaacacaaccaccaucaguaagcgcaacaccaggacaaaaaguaacaauaucaugcucaggaacaagaucaaacauaggaaacaacuacguaucaugguacagacaauucccaggaacagcaccaaaacuacuaauauacgaagacaacaaaagaccaucaggaauaccagcaagauucucaggaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 48509 - RNA, 333 nt, Artificial Sequence
  derived and/or modified sequence opt6 from anti-HIV_048-139893_VR-Chain
caaucaguauuaacacaaccaccaagcguaagcgcaacaccaggacaaaaaguaacauuuagcuguagcggaagcucaagcacaauaggaaaaaauuacguaagcugguaccaaguauuaccaggaacagcaccaaaacuauuaauauauaaaaauaacaaaagaccaagcggaauaccagacagauucucaggaucaaaaucaggaacaagcgcaacauuaggaauaacaggacuacaaacaggagacgaagcagauuacuauugcggaacaugggacucaagcuuaagcgcaggaggaguauuuggaacaggaacaaaaguaacaguacua

SEQ ID NO: 48510 - RNA, 333 nt, Artificial Sequence
  derived and/or modified sequence opt6 from anti-HIV_048-138820_VR-Chain
caaucaguacuaacacaaccaccaucaguaucaggagcaccaggacaaaaaguaacaauaucaugcucaggaucaggaucaaacauaggaaacacauacguaucaugguaccaacaccuaccaggaacagcaccaaaauuauuaauauacgaaaacaacaaaagaccaucaggaauaccagacagauucucaggaucaaaaucagcaacaucagcaacacuaggaauaacaggacuacaaacaggagacgaagcagacuacuacugcggaacaugggacacaucauuaucagcaggaggaguauucggaacaggaacaaaaguaacaguacua

SEQ ID NO: 48511 - RNA, 333 nt, Artificial Sequence
  derived and/or modified sequence opt6 from anti-HIV_048-135858_VR-Chain
caaagcguauuaacacaaccaccaagcgcaaguggaacaccaggacaaagaguaacaauaagcuguaguggaagcucgagcaauauaggaagcucauacguauacugguaccaacaauuuccaggaagaucaccaagacuauuaauauauagaaauaacgaaagaccaaguggaauaccagacagauucucaggaucaaaaucgggaacaagcgcaacauuaggaauaacaggacuacaaacaggagacgaagcagauuacuauugcggaacaugggacacaucauuaagcgcaggaggaguauuuggaacaggaacaaaaguaacaguacua

SEQ ID NO: 48512 - RNA, 333 nt, Artificial Sequence
  derived and/or modified sequence opt6 from anti-HIV_048-134968_VR-Chain
caaucaguacuaacacaaccaccaucaguaucagcagcaccaggacaaaaaguaacaauauucugcucaggaucaucaucaaacauaggaaaaaacuacguaucaugguaccaacaacuaccaggaacagcaccaaaacuacuaauauacgaaaacucaaaaagaccaucaggaauaccagacagauucucaggaucaaaaucaggaacaucagccacacuaggaauaacaggacuacaaacaggagacgaagcagacuacuacugcggaacaugggacacaucacuaucagcaggaggaguauucggaucaggaacaaaaguaacaguacua

SEQ ID NO: 48513 - RNA, 333 nt, Artificial Sequence
  derived and/or modified sequence opt6 from anti-HIV_048-134312_VR-Chain
caaucaguauuaacacaaccaccaucagcaucaggaacaccaggacaaagaguaacaauaucaugcucaggaucaucaucaaauauaggaaacaacuacguaucaugguacagacuauuaccaggaacagcaccaaaacuacuaauauacaaaaacgacaacagaccaucaggaauaccagacagauucucaggaucaaaaagcggaacaucagcaacacuaggaauaucaggacuacaaacaggagacgaagcagacuacuacugcggaacaugggacacaucacuaucaggaggaggaguauucggaacaggaacaaaaguaacaguacua

SEQ ID NO: 48514 - RNA, 330 nt, Artificial Sequence
  derived and/or modified sequence opt6 from anti-HIV_048-132253_VR-Chain
ucagcauuaacacaaccagcaucaguaucaggaucaccaggacaaucaauagcaauaucauguacaggaacaucaucagauguaggauacgaucuaguaucaugguaccaacaacauccaggaacagcaccaaaacuauuaauauaugacaauaacaaaagaccaucaggaauaccagacagauucucaggaucaaaaucaggaacaucagcaacauuaggaauaacaggacuacaaacaggagacgaagcagauuacuauugcggaacaugggacacaucauuaucagcaggaggaguauuuggaucaggaacaaaaguaacaguacua

SEQ ID NO: 48515 - RNA, 333 nt, Artificial Sequence
  derived and/or modified sequence opt6 from anti-HIV_048-130710_VR-Chain
caaucaguccuaacacaaccaccaucaguagcaggagcaccaggacaaagaguaacaauaucaugcacaggaaacacaucaaauauaggaggauacgacguacacugguaccaacaauuaccaggaacaccaccaaaacuacuaauauucaaaaacaacgaaagaccaucaggaauaccagacagauucucaggaucaaaaucaggaacaucagcaacauuaggaauaacaggacuacaaacaggagacgaagcagacuacuacugcggaacaugggacacaucacuaucagcaggaggagucuucggaacaggaacaaaaguaacaguauua

SEQ ID NO: 48516 - RNA, 333 nt, Artificial Sequence
  derived and/or modified sequence opt6 from anti-HIV_048-128564_VR-Chain
caaucaguacuaacacaaccaccaucagcaucaggaacaccaggacaaagaguaacaauaucaugcucaggaucaucaucaaacauaggaucaaacacaguaaacugguaccaacaacuaccaggaacagcaccaaaacuacuaauauacaaaaacacagaaagaccaucaggaauaccagacagauucucaggaucaaaaucaggaacaucagcaacacuagacauaacaggacuacaaacaggagacgaagcagacuacuacugcggaacaugggacacaucauuaucagcaggaggaguauucggaacaggaacaaaaguaacaguacua

SEQ ID NO: 48517 - RNA, 333 nt, Artificial Sequence
  derived and/or modified sequence opt6 from anti-HIV_048-126702_VR-Chain
caaucaguauuaacacaaccaccaucagcaucagcagcaccaggacaaagaguaacaauaucaugcucaggaucaaacucaaacauaggaaacaacuacguaucaugguaccaacaacuaccaggaacagcaccaaaacuacuaauauacgacaacucaaaaagaccaucaggaauaccagacagauucucagcaucaaaaucaggaacaucagcaacacuaggaauaacaggauuacaaacaggagacgaagcagacuacuacugcggaacaugggacacaucacuaucagcaggaggaguauucggaacaggaacaaaaguaacaguacua

SEQ ID NO: 48518 - RNA, 333 nt, Artificial Sequence
  derived and/or modified sequence opt6 from anti-HIV_048-124521_VR-Chain
caaaguguacuaacacaaccaccaaguguaucaggagcaccaggacaaagaguaacaauaucaugcacaggaucaaguucaacauuuggaggauacgacguauacugguaucaacaaauaccaggaacagcaccaaaauuauuaauauacgaaaacaauaaaagaccaucaggaauaccagacagauucagcggaagcaaaagcggaacaucagcaacacuagcaauaacaggauuacaaacaggagaugaagcagacuauuacugcggaacaugggacggaucacuaucaacaggaggaguaauaggaacaggaacaaaaguaacaguauua

SEQ ID NO: 48519 - RNA, 333 nt, Artificial Sequence
  derived and/or modified sequence opt6 from anti-HIV_048-122740_VR-Chain
caaucaguacuaacacaaccaccaucaaugucagcagcaccaggacaaucaguaacaauaucaugcagcggaucaacauucaacauagaaaaacaccaaguaacauggcuaagacaccuaccaggaacagcaccaacaucaguaauaauaaugaacucacaaagaccaucaggaacaccagacagauucucaggaucaaaaucaggaacaucagcaacacuagcaauaacaggacuacaaacaggagacgaagcagacuacuacugcggaacaugggacggaucacuaucaacaggaggaguaauaggaacaggaacaaaaguaacaguacua

SEQ ID NO: 48520 - RNA, 327 nt, Artificial Sequence
  derived and/or modified sequence opt6 from anti-HIV_048-119536_VR-Chain
gaauuaacacaaagcccaagcguaagcgcagcaccaggagaaaaaguaacaauaagcuguagcggaacaaauagcaauauaggauacuauuacguaagcugguaccaacaauuuccaggaacagcaccaaaaguaguaauauaugaaaauacaaaaagaccaagcggaauaccagacagauucucaggaucaaaaucaggaacaagcgcaacauuaggaauaacaggacuacaaacaggagacgaagcagauuacuauugcggaacaugggacacaucauuaagcgcaggaggaguauuuggaagcggaacaaaaguaacaguacua

SEQ ID NO: 48521 - RNA, 333 nt, Artificial Sequence
  derived and/or modified sequence opt6 from anti-HIV_048-116929_VR-Chain
caaucaguauuaacacaaccaccaucaguaucaggagcaccaggacaaagaguaacaauaucauguacaggaucaucaucaaauauaggagacuaugacguacacugguaccaacaacuaccaggaacagcaccaaaacuauuaauauauagaaauaaccaaagaccaucaggaguaccagacagauucucaggaucaaaaucaggaacaucagcaacauuaggaauaacaggacuacaaacaggagacgaagcagauuacuauugcggaacaugggacgcaucauuaucagcaggaggaguauuuggaacaggaacaaaaguaacaguacua

SEQ ID NO: 48522 - RNA, 333 nt, Artificial Sequence
  derived and/or modified sequence opt6 from anti-HIV_048-116577_VR-Chain
caaucaguacuaacacaaccaccaucagcaucaggaacaccaggacaaagaguaacaauaucauguucaggaagcucaucaaauauaggaucaaauuacguaucaugguaccaaguauuaccaggaacagcaccaaaacuacuaauauacaaaaauaacaaaagaccaucaggaauaccagacagauucucaggaucaaaaucaggaacaucagcaacacuaggaauaacaggacuacaaacaggagacgaagcagacuacuacugcgcaacaugggacacaucacuaucagcaggaggaguauucggaacaggaacaaaaguaacaguacua

SEQ ID NO: 48523 - RNA, 333 nt, Artificial Sequence
  derived and/or modified sequence opt6 from anti-HIV_048-116046_VR-Chain
caaagcguacuaacacaaccaccaucaguaucaggagcaccaggacaaagaguaacaauaucaugcacaggaucaagcucaaacauaggaggauacgauguacauugguaucaacaauucccaggaacagcaccaaaauuauuaauauacgauaacgauaaaagaccaucaggaauaccagauagauuuagcggaagcaaaagcggaacaucagcaacacuaggaauaacaggauuacaaacaggagaugaagcaaacuauuacuguggagcaugggauacaucacuaucagcaggaggaguauucggaacaggaacaaaaguaacaguauua

SEQ ID NO: 48524 - RNA, 333 nt, Artificial Sequence
  derived and/or modified sequence opt6 from anti-HIV_048-115875_VR-Chain
caaucaguauuaacacaaccaccaagcguaagcgcagcaccaggacaaagaguaacaguaagcuguagcggaagcucaagcaauauaggaaacaauuucguaagcugguaccaacacuuaccaggaacagcaccaaaacuauuaauauaugacaauagcaauagaccaagcggaauaccagacagauucucaggaucaaaaucaggaacaagcgcaacauuaggaauaacaggacuacauacaggagacgaagcagauuacuauugcggaacaugggacacaucauuaagcgcaggaggaguauuuggaagcggaacaaaaguaacaguacua

SEQ ID NO: 48525 - RNA, 333 nt, Artificial Sequence
  derived and/or modified sequence opt6 from anti-HIV_048-115599_VR-Chain
caaucaguauuaacacaaccaccaagcguaagcgcagcaccaggacaaaugguaacaauaagcuguagcggaagcucaagcaauauaggaagccauaguguaagcugguaccaacacuuuccaggaacagcaccaaaauuaguaauagaagaaaaugaccaaagaccaaguggaauaccagacagauucucaggaucaaaaucaggaacaagcgcaacauuaggaauaacaggacuacaaacaggagacgaaggagauuacuauugcggaacaugggacacaagccuaagcggaggaggaguauuuggaacaggaacaaaaguaacaguacua

SEQ ID NO: 48526 - RNA, 333 nt, Artificial Sequence
  derived and/or modified sequence opt6 from anti-HIV_048-113988_VR-Chain
caaucaguacuaacacaaccaccaucaguaucagcagcaccaggacaaaugguaacaauaucauguucaggaagcucacacaauauaggagaaaauuacguaucaugguaccaacacuuaccaggaacagcaccaaaacuauuaauauucaaaaauaacgaaagaccaucaggaauaccagacagauucagcggaucaaaaucaggaacaucagcaacauuaggaauaacaggacuacaaacaggagacgaagcagacuacuauugcggaacaugggacacaagucuaucagcaggaggaguauucggaacaggaacaaaaguaacaguacua

SEQ ID NO: 48527 - RNA, 333 nt, Artificial Sequence
  derived and/or modified sequence opt6 from anti-HIV_048-112989_VR-Chain
caaucaguauuaacacaaccaccaucagcaucaggaacaccaggacaaagaguaacacuaucaugcucaggaggaucaucaaacauaggaaacgacaacguauacugguaccaacaaagaccaggaacaacaccaaaacuauuaauauacaacgacaacagaagaccaucaggaacaccagacagauucucaggaucaaaaucaggaacaucagcaacacuagcaauaacaggacuacaaacaggagacgaagcagacuacuacugcggaacaugggacggaucacuaucaacaggaggaguaauaggaacaggaacaaaaguaacaguacua

SEQ ID NO: 48528 - RNA, 333 nt, Artificial Sequence
  derived and/or modified sequence opt6 from anti-HIV_048-112435_VR-Chain
caaucagucuuaacacaaccaccaagcguaagcgcagcaccaggacaaaaaguaagcauaagcuguagcggaagcucaagcaauauaggaaaaaauuacguaagcugguaccaacaacuaccaggaacagcaccaaaacuauuaauauuuaaaaauaacgaaagaccaagcggaauaccagacagauucucaggaucaaaaucaggaacaagcgcaacauuaggaauaacaggacuacaaacaggagacgaagcagauuacuauugcgcaacaugggacacaagcuuaagcgcaggaggaguauuuggaacaggaacaaaaguaacaguacua

SEQ ID NO: 48529 - RNA, 333 nt, Artificial Sequence
  derived and/or modified sequence opt6 from anti-HIV_048-111339_VR-Chain
caaucaguauuaacacaaccaccaucaguaucagcagcaccaggacaaaaaguaacaauaucauguacaggaucaucaucaaauauaggaggauaugcaguacacugguaccaacaaguaccagcaacagcaccaaaacuauuaauauaugaaaauaacgaaagaccaagcggaauaccagacagauucucaggaucaaaaucaggaacaucagcaacauuaggaauaacaggacuacaaacaggagacgaagcagauuacuauugcggaacaugggacacaucauuaucagcaggaggaguauuuggaacaggaacaaaaguaacaguauua

SEQ ID NO: 48530 - RNA, 333 nt, Artificial Sequence
  derived and/or modified sequence opt6 from anti-HIV_048-111055_VR-Chain
caaucagcauuaacacaaccagcaagcguaagcggaagcccaggacaaagcauaacaauaagcuguacaggaacaagaagcgauguaggauacaauuacguaaguugguaccaacaacauccaggaaaagcaccaaaacuauuaauauaugaaaauacaaaaagaccaagcggaauaccagacagauucucaggaucaaaaucaggaacaagcgcaacauuaggaauaacaggauuacaaacaggagacgaagcagauuacuauugcggaacaugggacacaaguuuaagcgcaggaggaguauuuggaucaggaacaaaaguaacaguacua

SEQ ID NO: 48531 - RNA, 333 nt, Artificial Sequence
  derived and/or modified sequence opt6 from anti-HIV_048-111027_VR-Chain
caaucaguacuaacacaaccaccaucaguaucagcagcaccaggacaaaaaguaacaauaucaugcucaggaucaaacucaaaccuaggaaacaacuacguaucaugguaccaacaccuaccaggaacagcaccaagacuacuaauauacgaagacaaaaaaagaccaucaggaauaccagacagauucucaggaucaaaaucaggagcaucagcaacacuagacauaacaggacuacaaacaggagacgaagcagacuacuacugcggaauaugggacacaucacuaucagcaggaggaguauucggaacaggaacaaaaguaacaguacua

SEQ ID NO: 48532 - RNA, 333 nt, Artificial Sequence
  derived and/or modified sequence opt6 from anti-HIV_048-109721_VR-Chain
caaucaguauuaacacaaccaccaucaguaucagcagcaccaggacaaaaaguaacaauaucaugcucaggaagcucaucagacauaggaucaaacuucguaucaugguaccaacacuuaccaggaacagcaccaagacuacuaauauacgaaaacaacagaagaccaucaggaauaccagacagauucucaggaucaaaaucaggaacaucagcaacacuagcaauaacaggacuacaaacaggagacgaagcagacuacuacugcggaacaugggacacaucacuaaacagaggaggaguauucggaacaggaaccaaaguaacaguacua

SEQ ID NO: 48533 - RNA, 333 nt, Artificial Sequence
  derived and/or modified sequence opt6 from anti-HIV_048-109666_VR-Chain
caaucaguauuaacacaaccaccaaguaugucagcagcaccaggagaaagaguaacaauaagcuguagcggaagcucaagcaauauaggaaaccaucacguaagcugguaccaacaaagaccaggaacagcaccaaaauuauuaauauaugaaaauaacgaaagaccaagcggaauaccagacagauucucaggaucaaaaucaggaucaagcgcaacauuagcaauaacaggacuacaaacaggagacgaagcagauuacuauugcggaacaugggacggaagauuaaacauaggaggaguaauaggaacaggaacaaaaguaacaguacua

SEQ ID NO: 48534 - RNA, 333 nt, Artificial Sequence
  derived and/or modified sequence opt6 from anti-HIV_048-109196_VR-Chain
caaucaguacuaacacaaccaccaucaguaucagcagcaccaggacaaaaaguaacaauaucaugcucaggaucaucaucaaacauaggaaacaacuacguaucaugguaccaacaauuaccaggaacagcaccaaaacuacuaauauacgaaacaaacaaaagaccaucaggaauaccagacagauucucaggaucaaaaucaggaacaucagcaacacuagcaauaacaggacuacaaacaggagacgaagcagacuacuacugcggaacaugggacacaucacuaucaggaggaggaguauucggaacaggaacaaaaguaacaguauua

SEQ ID NO: 48535 - RNA, 333 nt, Artificial Sequence
  derived and/or modified sequence opt6 from anti-HIV_048-109051_VR-Chain
caaucaguacuaacacaaccaccaucaguaucagcagcaccaggacaaaaaguaacaauaucaugcucaggaaacaacucaaacaugguaaacaacuacauaucaugguaccaacuacuaccaggaacaccaccaaaacuacuaauauucaaaaacaacgaaagaccaucaggaauaccagacagauucucaggaucaaaaucaggaacaucagcaacauuaggaauaacaggacuacaaacaggagacgaagcagacuacuacugcggaacaugggacacaucacuaucagcaggaggaguauucggaacaggaacaaaaguaacaguauua

SEQ ID NO: 48536 - RNA, 333 nt, Artificial Sequence
  derived and/or modified sequence opt6 from anti-HIV_048-108570_VR-Chain
caaucagcacuaacacaaccaccaucaguaucagcagcaccaggacaaaaaguaacaauaucaugcucaggaaaaucaucaaacauaggaacaaacuucguaucaugguaccaacaauucccagaagcagcaccaaaacuacuaauauacgacaacaacaaaagaccaucaggaauaccagacagauucucaggaucaaaaucaggaacaucagcaacauuaggaauaacaggacuacaaacaggagacgaagcagacuacuacugcggaacaugggacggaucacuaucaacaggaggaguaauaggaacaggaacaaaaguaacaguacua

SEQ ID NO: 48537 - RNA, 327 nt, Artificial Sequence
  derived and/or modified sequence opt6 from anti-HIV_048-108033_VR-Chain
gaauuaacacaaagcccaagcguaagcgcagcaccaggacaaagaguaacaauaagcuguagcggaaacagcagcaauauaggaaacaauuacguaagcugguaccaacuauuaccaggaacagcaccaaaacuacuaauauauaaaaaugacaaaagaccaagcggaauaccagacagauucucaggcucaaaaucgggaacaagcgcaacauuaggaauaacaggacuacaaacaggagacgaagcagauuacuauugcggaacaugggacacaucauuaagcacaggaggaguauuuggaacaggaacaaaaguaacaguacua

SEQ ID NO: 48538 - RNA, 333 nt, Artificial Sequence
  derived and/or modified sequence opt6 from anti-HIV_048-107279_VR-Chain
caaucaguacuaacacaaccaccaucaguaucagcagcaccaggacaaaaaguaauaauaucaugcucaggaucaucaucaaacauaggaaaaaacuacguaucaugguaccaacaccuacccggaacagcaccaaaauuacuaauauacgaaaacaacaaaagaccaucaggaauaccagacagauucucaggaucaaaaucaggaacaucagcaacacuaggaauaacaggacuacaaacaggagacgaagcagacuacuacugcggaacaugggacgcaucacuaucagcaggaggaguacuaggaacaggaacaaaaguaacaguacua

SEQ ID NO: 48539 - RNA, 333 nt, Artificial Sequence
  derived and/or modified sequence opt6 from anti-HIV_048-106271_VR-Chain
caaucaguacuaacacaaccaccaucaguauccgcagcaccaggacaaaaaguaaccauaucaugcucaggaagcagaucaaacauaggaucaaacuacauaucaugguaccaacaacuaccaggaacagcaccaaaacuacuaauauacaaaaacgacaaaagaccaucaggaauaccagacagauucucaggaucaaaaucaggaacaucagcaauacuaggaauaacaggacuacaaacaggagacgaagcagacuacuacugcggagcaugggacacaucacuaucagcaggaggaguauucggaacaggaacaaaaguaacaguacua

SEQ ID NO: 48540 - RNA, 333 nt, Artificial Sequence
  derived and/or modified sequence opt6 from anti-HIV_048-106054_VR-Chain
caaucaguacuaacacaaccaccaucaguaucagcagcaccaggacaacaaguaacaauaucaugcucaggaagcacaucaaacauaggaaacaacuacguaucaugguaccaacaaguaccaggaacagcaccaaaacuacuaauauacgacaacaacaacagaccaucaggaauaccagacagauucucaggaucaaaaucaggaacaucagcaacacuaggaauaucaggauuacaaacaggagacgaagcagacuacuacugcggaacaugggacacaucacuaucaggaggaggaguauucggaacaggaacaaaaguaacaguacua

SEQ ID NO: 48541 - RNA, 333 nt, Artificial Sequence
  derived and/or modified sequence opt6 from anti-HIV_048-104848_VR-Chain
caaucagcauuaacacaaccagcaucaguaucaggaucaccaggacaaucaauaacaauaucauguacaggaacaucaucagacguaggauacaauuacguaucaugguaccaacaauuaccaggaacagcaccaaaacuauuaauauucgacaaugacgacagaccaucagaaauaccagacagauucucaggaucaaaaucaggaacaucagcaacacuaggaauaacaggacuacaaccaggagacgaagcagauuacuauugcggaacaugggacucaucauuaucagcaggaggaguauuuggaacaggaacaaaaguaacaguacua

SEQ ID NO: 48542 - RNA, 333 nt, Artificial Sequence
  derived and/or modified sequence opt6 from anti-HIV_048-104638_VR-Chain
caaucaguauuaacacaaccaccaagcgcaagcggaacaccaggacauagaguaacaauaagcuguaguggaaacucaagcaauauaggaggaaaucacguauacugguaccaacaaguaccaggaacaacaccaaaacuauuaauauauagaaauaacgaaagaccaagcggaauaccagacagauucucaggaucaaaaucaggaacaagcgcaacauuaggaauaacaggacuacaaacaggagacgaagcagauuacuauugcggaacaugggacacaaguuuaagcgcaggaggaguauuuggaacaggaacaaaaguaacaguauua

SEQ ID NO: 48543 - RNA, 333 nt, Artificial Sequence
  derived and/or modified sequence opt6 from anti-HIV_048-104567_VR-Chain
caaucaguauuaacacaaccaccaagcgcaagcggaacaccaggacaaagaguaacaauaagcuguagcggaagcaauaguaauauaggaacaaauuucguaaacugguaccaacacguaccaggaagagcaccaaaacuauuaaucuauaaaaauacagaaagaccaagcggaauaccagacagauucucaggaucaaaaucaggaacaagcgcaacauuagacauaacaggacuacaaacaggagacgaagcagauuacuauugcggaacaugggacacaagcuuaagcgcaggaggaguauuuggaacaggaacaaaaguaacaguacua

SEQ ID NO: 48544 - RNA, 333 nt, Artificial Sequence
  derived and/or modified sequence opt6 from anti-HIV_048-102804_VR-Chain
caaucaguacuaacacaaccaccauccguaucaacagcaccaggacaaaaaguaacaauaucaugcucaggaucaucaucaaacauaggauacucauacguaucaugguuccaacaccuaccaggaacagcaccaaaacuacuaauauacggaaacucaaacagaccaucaggaguaccagacagauucucaggaucaaaaucaggaacaucagcaucacuagcaauaacaggacuacaaacaggagacgaagcagacuacuacugcggaacaugggacucaucacuaucagcaggaggaguauucggaacaggaacaaaaguaacaguacua

SEQ ID NO: 48545 - RNA, 333 nt, Artificial Sequence
  derived and/or modified sequence opt6 from anti-HIV_048-101676_VR-Chain
caaucaguacuaacacaaccaccaucaguaucaggagcaccaggacaaucaguaacaauaucaugcacaggaacaucaucaaacauaggagacuucgacguacacugguaccaacaacuaccaggaacagcaccaaaacuauuacuauacgaaaacaacaaaagaccaagcggaauaccagacagauucucaggaucaaaaucaggaacaucagcaacacuagcaauaacaggacuacaaacaggagacgaagcagacuacuacugcggaacaugggacggaucacuaucaacaggaggaguaauaggaacaggaacaaaaguaacaguacua

SEQ ID NO: 48546 - RNA, 333 nt, Artificial Sequence
  derived and/or modified sequence opt6 from anti-HIV_048-097603_VR-Chain
caaucaguacuaacacaaccaccaucaguaucagcagcaccaggacaaaaaguaacaauaucaugcucaggaucaucaucaaacauaggaaacaacuacguaucaugguaccaacaacuaccaggaacagcaccaaaacuacuaauauacgacacaguaaaaagaccaucaggaauaccagacagauucucaggaucaaaaucaggaacaucagcaacacuaggaauaacaggacuacaaacaggagacgaagcagacuacuacugcggaacaugggacucaucacuaucaggaggaggaguauucggaacaggaacaaaaguaacaguacua

SEQ ID NO: 48547 - RNA, 333 nt, Artificial Sequence
  derived and/or modified sequence opt6 from anti-HIV_048-097107_VR-Chain
caaucaguauuaacacaaccaccaucaguaucagcagcaccaggacaaaaaguaacaauaucaugcucaggaucaucaucaaacauagaaaacaacuacguaucaugguacagacaaguaccaggaacagcaccaaaacuacuaauauacaaaaacgacaacagaccaucaggaauaccagacagauucucaggaucaaaaucaggaacaucagcaacacuaggaauaacaggacuacaaacaggagacgaagcagacuacuacugcggaauaugggacacaucauuaucagcaggaggaguauucggaacaggaacaaaaguaacaguacua

SEQ ID NO: 48548 - RNA, 333 nt, Artificial Sequence
  derived and/or modified sequence opt6 from anti-HIV_048-096871_VR-Chain
caaccaguacuaacacaaccaccaucagcaucaggaacaccaggacaaagaguaacaauaucaugcucaggaucaucaucaaacauaggaucaaacuacguauacugguaccaacaauuaccaggaacaacaccaaaauuacuaauauacagaaacaaccaaagaccaucaggaauaccagacagauucucaggaucaaaaagcggaacaucagcaacauuaggcauaacaggacuacaaacaggagacgaagcagacuacuacugcggaacaugggacacaagccuaucaacaggaggaguauucggaacaggaacaaaaguaacaguacua

SEQ ID NO: 48549 - RNA, 333 nt, Artificial Sequence
  derived and/or modified sequence opt6 from anti-HIV_048-096668_VR-Chain
caaucaguacuaacacaaccaccaucaguaucagcagcaccaggacaaaaaguaacaauaucaugcucaggaagcggaucaaacauaggaaacaauuacguaucaugguaccaacaacuaccaggaacagcaccaaaacuauuaauauacaaaaacacagaaagaccaucaggaauaccagacagauucucaggaucaaaaucaggaacaucagcaacauuagacauaacaggacuacaaacaggagacgaagcagacuacuacugcggaacaugggacacaucacuaucagcaggaggaguauucggaacaggaacaaaaguaacaguacua

SEQ ID NO: 48550 - RNA, 333 nt, Artificial Sequence
  derived and/or modified sequence opt6 from anti-HIV_048-095236_VR-Chain
caaucaguauuaacacaaccaccaagcguaagcgcaccaccaggacaaaaaguaacaauaagcuguagcggaacaacaaguaauauaggaagcaauuacguagcaugguaccaacaauuaccaggaacagcaccaaaauuaguaauauaugaaaauagcaaaagaccaagcggaauaccagacagauucucaggaucaaaaucaggaacaagcgcaacauuaggaauaacaggacuacaaacaggagacgaagcagauuacuauugcggaacaugggacacaagccuaagugcaggaggaguauuuggaucaggaacaaaaguaacaguacua

SEQ ID NO: 48551 - RNA, 333 nt, Artificial Sequence
  derived and/or modified sequence opt6 from anti-HIV_048-094155_VR-Chain
caaucaguacuaacacaaccaccaucaguaucagcagcaccaggacaaaaaguaacaguaucaugcucaggaucaucaucagacauaggagaaaacuacguaucaugguaccaacaauucccagaaacagcaccaaaacuacuaauauacgacaacaacaaaagaccaucaggaauaccagacagauucucaggaucaaaaucaggaacaucagcaacacuagcaauaacaggacuacaaacaggagacgaagcagacuacuacugcggaacaugggacucaucacuaucagcaggaggaguauucggaacaggaacaaaaguaacaguacua

SEQ ID NO: 48552 - RNA, 333 nt, Artificial Sequence
  derived and/or modified sequence opt6 from anti-HIV_048-093219_VR-Chain
caaccacuauuaacacaaccaccagcaguaucagcaacaccaggacaaagaguaacaauaagcuguacaggaagcucaagcaauauaggaagaacauucguaaacugguaccaacaauuaccaggaacagcaccaaaacuauuaauauaugaaaauagcaaaagaccaagcggaauaccagacagauucucaggaucaaaaucaggaacaagcgcaacauuaggaauaacaggacuacaaacaggagacgaagcagauuacuauugcggaacaugggacacaagccuaagcgcaggaggaguauuuggaucaggaacaaaaguaacaguacua

SEQ ID NO: 48553 - RNA, 333 nt, Artificial Sequence
  derived and/or modified sequence opt6 from anti-HIV_048-092976_VR-Chain
caaucaguacuaacacaaccaccaucaguaucagcagcaucaggacaaaaaguaacaauaucaugcucaggaucaucaucaaacauaggaaacaacuacguaagcugguaccaacaccuaccaggaacagcaccaaaacuacuaauauacaaaaacgacaaaagaccaucaggaauaccagacagauucucaggaucaaaaucaggaacaucagcaacacuaggaauaacaggacuacaaacaggagacgaagcagacuacuacugcggaacaugggacacaucauuaucagcaggaggaguauucggaacaggaacaaaaguaacaguacua

SEQ ID NO: 48554 - RNA, 333 nt, Artificial Sequence
  derived and/or modified sequence opt6 from anti-HIV_048-090866_VR-Chain
caaucaguacuaacacaaccaccaucaguaucagcagcaccaggacaaaaaguaacaauaucaugcucaggaucaagaucaaacauaggauccaacuacauaucaugguaccaacaacuaccaggaacagcaccaaaacuacuaauauacgacaacaacaaaagaccaucaggaauaccagacagauucucaggaucaaaaucaggaacaucagcaacacuaggaauaacaggacuacaaacaggagacgaagcauacuacuacugcggaacaugggacacaucacuaucagcaggaggaguauucggaucaggaacaaaaguaacaguacua

SEQ ID NO: 48555 - RNA, 333 nt, Artificial Sequence
  derived and/or modified sequence opt6 from anti-HIV_048-090650_VR-Chain
caaagcgcauuaacacaaccagcaagcguaagcggaaguuuaggacaaagcauaacaauaagcuguagcggaagcucaagcacaauaggaaacaauuacguaagcugguaccaaguauuaccaggagcagcaccaaaacuauuaauauguaaaaauaacgaaagaccaagcggaauaccagacagauucucaggaucaaaaucaggaacaagcgcaacauuaggaauaacaggacuacaaacaggagacgaagcagauuacuauugcggaacaugggacacaucauuaagcgcaggaggaguauuuggaacaggaacaaaaguaacaguacua

SEQ ID NO: 48556 - RNA, 333 nt, Artificial Sequence
  derived and/or modified sequence opt6 from anti-HIV_048-089009_VR-Chain
caaagcguauuaacacaaccaccaagcguaagcgcagcaccaggacaaaaaguaacaauaagcuguagcggaggaucaagcaauauaggaaacaauuacguaagcugguaccaacaauuaccagaaacagcaccaaaacuaauaauauaugacaauaacaaaagaccaagcggaauacaugacagauucucaggaucaaaaucaggaacaagcgcaacauuagacauaacagcacuacaaacaggagacgaagcagauuacuauugcggaacaugggacacaucauuaagcgcaggaggaguauuuggaacaggaacaaaaguaacaguauua

SEQ ID NO: 48557 - RNA, 333 nt, Artificial Sequence
  derived and/or modified sequence opt6 from anti-HIV_048-088654_VR-Chain
caaucagcacuaacacaaccaagaucaguaucagcagcaccaggacaaaaaguaagcauaucaugcucaggaagaucaacaaaucuaggauacaacuacguaucaugguaccaacaccuaccaggagcagcaccaaaaguacuaauauacgaaaacaacaaaagaccaucaggaauaccagacagauucucaggaucaaaaucaggaacaagcgcaacacuaggaauaacaggacuacaaacaggagacgaagcagacuacuacugcggaacaugggacacaucacuaucagcaggaggaguauucggaucaggaacaaaaguaaccguacua

SEQ ID NO: 48558 - RNA, 333 nt, Artificial Sequence
  derived and/or modified sequence opt6 from anti-HIV_048-086513_VR-Chain
caaucagcauuaacacaaccaccaucaguaucagcagcaccaggacaaaaaguaacaauaucaugcucaggaucaacaucaaacauaggaaacaacuacguaucaugguaccaacaauuaccaggaacagcaccaaaacuacuaauauacaaaaacgacaacagaccaucaggaauaccagacagauucucaucaucaaaaucaggaacaucagcaacauuaggaauaacaggacuacaaacaggagacgaagcagacuacuacugcggaauaugggacacaucacuaucagcaggaggaguauucggaacaggaacaaaaguaacaguacua

SEQ ID NO: 48559 - RNA, 324 nt, Artificial Sequence
  derived and/or modified sequence opt6 from anti-HIV_048-086024_VR-Chain
uuagcacaaccaccaucaguaucaggaacaccaggacaaagaguaacaauaucauguucaggaucaucaucaaauauaggaucaaaugcaguaaacugguaccaacaauuuccaggaacagcaccaaaacuacuaauauaugacacagacaaaagaccaagcggaauaccagacagauucucaggaucaaaaucaggaacaucagcaauacuaggaauaacaggacuacaaacaggagacgaagcagacuacuacugcggagcaugggacacaucacuaucagcaggaggaguauucggaacaggaacaaaaguaacaguacua

SEQ ID NO: 48560 - RNA, 333 nt, Artificial Sequence
  derived and/or modified sequence opt6 from anti-HIV_048-085857_VR-Chain
caaagcgcauuaacacaaccaagaagcguaagcggaaguuuaggacaaagcguaacaauaagcuguacaggaacaacaagcgauguaggauucgauuacguaagcugguaccaaguauuaccaggaacagcaccaaaauuauuaauauauaaaaaugacaaaagaccaagcggaauaccagacagauucucaggaucaaaaucaggaacaagcgcaacauuaggaauaacaggacuacaaacaggagacgaagcagauuacuauugcggaacaugggacacaaguuuaagcacaggaggaguauuuggaacaggaacaaaaguaacaguacua

SEQ ID NO: 48561 - RNA, 333 nt, Artificial Sequence
  derived and/or modified sequence opt6 from anti-HIV_048-084277_VR-Chain
caaucaguauuaagacaaccaccaucauuaucaggagcaccaggacaaagaguaacauuaucauguacaggaucaucaucaaauauaggaggauaugacguacacugguaccaacacguaccaggaacagcaccaaaacuauuaauauaugaaaauacaaaaagaccaagcggaauaccagacagauucucaggaucaaaaucaggaacaucagcaacauuaggaauaacaggacuacaaacaggagacgaagcagauuacuauugcggaacaugggacacaucauuaucagcaggaggaguauuuggaucaggaacaaaaguaacaguacua

SEQ ID NO: 48562 - RNA, 333 nt, Artificial Sequence
  derived and/or modified sequence opt6 from anti-HIV_048-084245_VR-Chain
caaucaacacuaacacaaccaccaucaguaucagcagcaccaggacaaaaaguaacaauaucaugcucaggaucaaacucaaacauaggaaaacacuacguaucaugguaccaacaauucccaggagcaguaccaaaacuacuaauauacgaaaacaaaaaaagaccaucaggaauaccagacagauucucaggaucaaaaucagacacaucagcaacacuagacauaacaggacuacaaacaggagacgaagcagacuacuacugcggaacaugggacacaucacuaagcgcaggaggaguauucggaucaggaacaaaaguaacaguacua

SEQ ID NO: 48563 - RNA, 333 nt, Artificial Sequence
  derived and/or modified sequence opt6 from anti-HIV_048-082487_VR-Chain
caaucacuauuaacacaaccaccaagcguaagcgcagcaccaggacaaaaaguaacaauaaguuguagcggaagcucaagcacaauaggaaacaauuacguaaguugguaccaaguauuaccaggagcagcaccaaaacuauuaauauguaaaaauaacgaaagaccaagcggaauaccagacagauucucaggaucaaaaucaggaacaagcgcaacacuaggaauaacaggacuacaaacaggagacgaagcagauuacuauugcggaacaugggacaccagcuuaagcgcaggaggaguauuuggaucaggaacaaaaguaacaguacua

SEQ ID NO: 48564 - RNA, 333 nt, Artificial Sequence
  derived and/or modified sequence opt6 from anti-HIV_048-081787_VR-Chain
caaucaguauuaacacaaccaccaucaguaucaggagcaccaggacaaagaguaacaauaucauguacaggaucaucaucaaauauaggaucauacgacguacacugguaucaacaacuaccaggaacagcaccaaaacuauuaauauacgaaaacucaaaaagaccaucaggaauaccagacagauucucaggaucaaaaucaggaacaucagcaacauuaggaauaacaggacuacaaacaggagacgaagcagacuacuauugcggaacaugggacacaucauuaucaggaggaggaguauucggaacaggaacuaaaguaacaguacua

SEQ ID NO: 48565 - RNA, 333 nt, Artificial Sequence
  derived and/or modified sequence opt6 from anti-HIV_048-081062_VR-Chain
caaucaguauuaacacaaccaccaagcguaagcgcagcaccaggacaaaaaguaacaauaaguuguagcggaacaucaaguaauauaggagcaaauuacguaagcugguaccaacaaguaccaggaacagcaccaaaacuauuaauauaugaaaauaacaaaagaccaagcggaacaccagacagauucucaggaucaaaaucaggaacaagcgcaacauuaggaauaacaggacuacaaacaggagacgaagcagauuacuauugcggaacaugggacacaucauuaagcgcaggaggaguauuuggaagcggaacaaaaguaacaguacua

SEQ ID NO: 48566 - RNA, 333 nt, Artificial Sequence
  derived and/or modified sequence opt6 from anti-HIV_048-079639_VR-Chain
caaagcguacuaacacaaccaccaucaguaucagcagcaccaggacaaaaaguaacaauaucaugcucaggaucaucaucaaacauaggaaaaaacuacguaucaugguaccaacaccuaccaggaacagcaccaaaacuacuaauauacgaaaacaacaaaagaccaucaggaauaccagacagauucucaggaucaaaaucaggaacagcagcaacacuaggaauaacaggacuacaaacaggagacgaagcaggauacuacugcggaacaugggacacaucacuaucagcaggaggaguauucggaacaggaacaaaaguaacaguacua

SEQ ID NO: 48567 - RNA, 333 nt, Artificial Sequence
  derived and/or modified sequence opt6 from anti-HIV_048-079126_VR-Chain
caaucaguacuaacacaaccaccaucaguaucagcagcaccaggacaaaaaguaacaauaucaugcucaggaucaucaucaaacauaggaaacaacuacguaucaugguaccaacaccuaccaggaacaccaccaaaacuacuaauauucaaaaacaacgaaagaccaucaggaauaccagacagauucucaggaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 48568 - RNA, 333 nt, Artificial Sequence
  derived and/or modified sequence opt6 from anti-HIV_048-073118_VR-Chain
caaagcguauuaacacaaccaccaagcguaagcgcagcaccaagacauaacguaacaauaagcuguagcggaggaucaagcaauauaggaaacaauuucguaagcugguaccaauacuuaccaggaacagcaccaaaacuauuaauauaugacaauaacaaaagaccaaguggaauaccagacagauucucaggaucaaaaucaggaacaagcgcaacauuaggaauaacaggacuacaaacaggagacgaagccgauuacuauugcgcaacaugggacacaucauuaagcgcaggaggaguauuuggaacaggaacaaaaguaacaguacua

SEQ ID NO: 48569 - RNA, 333 nt, Artificial Sequence
  derived and/or modified sequence opt6 from anti-HIV_048-070264_VR-Chain
caaucaguacuaacacaaucaccaucaguaucagcagcaccaggacaaaaaguaacaauaucaugcucaggaacaucaucaaacauaggaaacacauacguaagcugguaccaacaacuaccaggaacagcaccaaaacuacuaauauacaaaaacgacaaaagaccaucaggaauaccagacagauucucaggaucaaaaucaggaacaucagcaacacuaggaauaacaggauuacaaacaggagacgaagcagacuacuacugcggaacaugggacucaucacuaucagcaggaggaguauucggaacaggaacaaaaguaacaguauua

SEQ ID NO: 48570 - RNA, 333 nt, Artificial Sequence
  derived and/or modified sequence opt6 from anti-HIV_048-069426_VR-Chain
caaucaguauuaacacaaccaccaucaguaagcgcagcaccaggacaaaaaguaacaauaucaugcucaggaucaucaucaacaauaggaaacaacuacguaucaugguaccaacaauuacccggaacagcaccaaaacuacuaauauacaaaaacaacaaaagaccaucaggaguaccagacagauucucaggaucaaaaucaggaacaucagcaacaccaggaauaacaggacuacaaacaggagacgaagcagacuacuacugcggaacaugggacacaucacuaucagcaggaggaguauucggaacaggaacaaaaguaacaguacua

SEQ ID NO: 48571 - RNA, 333 nt, Artificial Sequence
  derived and/or modified sequence opt6 from anti-HIV_048-068564_VR-Chain
caaucagcauuaacacaaccaagaucaguaucaggaucaccaggacaaucaguagcaauaucauguacaggaacaucaucagauguaggauacaauuacguaucaugguaccaaguauuaccaggaacagcaccaaaacuauuaauauauaaaaauaacgaaagaccaucaggaauaccagacagauucucaggaucaaaaucaggaacaucagcaacauuaggaauaacaggacuacaaacaggagacgaagcagacuacuauugcggaacaugggacacaucauuaucagcaggaggaguauucggaacaggaacaaaaguaacaguacua

SEQ ID NO: 48572 - RNA, 333 nt, Artificial Sequence
  derived and/or modified sequence opt6 from anti-HIV_048-068345_VR-Chain
caaucaguacuaacacaaacaccaucaguaucagcagcaccaggacaaagaguaacaauaucaugcucaggaucaacaucaaacauaggaaacaacuacguaucaugguaccaacaacuaccaggaacagcaccaaaacuacuaauauacgaaaacaacaaaagaccaucaggaauaagagacagauucucagcaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 48573 - RNA, 333 nt, Artificial Sequence
  derived and/or modified sequence opt6 from anti-HIV_048-067337_VR-Chain
caaucaguacuaacacaaccaccaucaguaucagcagcaccaggacaaaaaguaacaauaucaugcucaggagcaucauacaacauaggaaaaaacagcguaagcugguaccaacaacuaccaggaacagcaccaaaacuauuaauauacaaaaacgacaaaagaccaucaggaauaccagacagauucucaggaucaaaaucaggagcaucagcaacacuagacauaacaggacuacaaacaggagacgaagcagacuacuacugcggaauaugggacacaucacuaucagcaggaggaguauucggaacaggaacaaaaguaacaguacua

SEQ ID NO: 48574 - RNA, 333 nt, Artificial Sequence
  derived and/or modified sequence opt6 from anti-HIV_048-067180_VR-Chain
caaucaguacuaacacaaccaccaucaguaucagcagcaccaggacaaaaaguaacaauaucaugcucaggaucaucaccaaacauaggaaacaacuacguaucaugguaccaaagacuaccaggaacagcaccaaaacuacuaauauacgaaaacgaccaaagaccaucaggaauaccagacagaauaucaggaucaaaaucaggaacaucagcaacacuaggaauaacaggacuacaaacaggagacgaagcagacuacuacugcggaacaugggacacaucauuaucaacaggaggaguauucggaacaggaacaaaaguaacaguacua

SEQ ID NO: 48575 - RNA, 333 nt, Artificial Sequence
  derived and/or modified sequence opt6 from anti-HIV_048-063017_VR-Chain
caaagcguauuaacacaaccaccaagcguaagcgcagcaccaggacaaaaaguaacaauaagcuguagcggaagcucaagcaauauaggaaacaauuacguaagcugguaccaacaccauccaggaaaagcaccaaaacuaaugauauaugaaguaagcaaaagaccaagcggaauaccagacagauucucaggaucaaaaucaggaacaagcgcaacacuaggaauaacaggacuacaaacaggagacgaagcagauuacuauugcggaacaugggacacaucauuaaacagaggaggaguauuuggaacaggaacaaaaguaacaguacua

SEQ ID NO: 48576 - RNA, 333 nt, Artificial Sequence
  derived and/or modified sequence opt6 from anti-HIV_048-061885_VR-Chain
caaucaguacuaacacaaccaccaucaguaucagcagcaccaggacaaaaaguaacaauaucaugcucaggaucaucaucaaacauaggaucacacuacauaucaugguaccaacaauucccaggagcagcaccaaaacuacuaauauacgaaaacgacaaaagaccaucaggaauaccagacagauucucagcaucaaaaucaggaacaucagcaacacuaggaauaacaggacuacaaacaggagacgaagcagacuacuacugcggaacaugggacacaucauuaucagccggaggaguauucggaacaggaacaaaaguaacaguacua

SEQ ID NO: 48577 - RNA, 333 nt, Artificial Sequence
  derived and/or modified sequence opt6 from anti-HIV_048-061671_VR-Chain
caaucaguacuaacacaaccaccaucagcaucaggaacaccaggacaaagaguaacaauaucaugcucaggaagcagaucaaacauaggaucaaacuacguauacugguaccaacaauuuccaggaacagcaccaaaacuuuuaauauacgaaaacaacaaaagaccaucaggaauaccagacagauucucaggaucaaaaucaggaacaucagcaacacuaggaauaacaggacuacaaacaggagacgaagcagacuacuacugcgcaacaugggacacaucacuaucagcaggaggaguauucggaacaggaacaaaaguaacaguacua

SEQ ID NO: 48578 - RNA, 333 nt, Artificial Sequence
  derived and/or modified sequence opt6 from anti-HIV_048-060700_VR-Chain
caaucaguacuaacacaacuaccaucacuaucagcagcaccaggacaaaaaguaacaauaucaugcucaggaucaucaucaaacauaggaaacaacuacguaucaugguaccaacaacuaccaggaacagcaccaaaacuacuaauauacgaaaacaacaaaagaccaucaggaauaccagacagauucucaggaucaaaaucaggaacaucagcaacacuaggaauaacaggacuacaaacaggagacgaagcagaauacuacugcgcaacaugggacgcaucacuaucaggaggaggaguauucggaacaggaacaaaaguaacaguacua

SEQ ID NO: 48579 - RNA, 333 nt, Artificial Sequence
  derived and/or modified sequence opt6 from anti-HIV_048-060592_VR-Chain
caaucaguacuaacacaaccaccaucaguaucagcagcaccaggacaaaaaguaacaauaucaugcucaggaucaucaucaaacauaggaaaaaacuacguaucaugguaccaacaauucccaggaacagcaccaaaacuacuaauauacgaaaacaacaaaagaccaucaggaauaccagacagauucucagcaucaaaaagcgcaacaucagcaacacuaguaauaacaggacuacaaacaggagacgaagcaguauacuacugcggaacaugggacacaucacuaucagcaggaggaguauucggaagcggaacaaaaguaacaguacua

SEQ ID NO: 48580 - RNA, 333 nt, Artificial Sequence
  derived and/or modified sequence opt6 from anti-HIV_048-060300_VR-Chain
caaccaguacuaacacaaccaccaucagcaucaggaacaccaggacaaagaguaacaauaucauguucaggaucaucaucaaauauaggaaccaauacaguaaacugguaccaacaauuuccaggaacagcaccaaaacuauuaauauacaaaaauaacgaaagaccaucaggaauaccagacagauucucaggaucaaaaucaggaacaucagcaacauuaggaauaacaggacuacaaacaggagacgaagcagacuacuacugcggaacaugggacacaucacuaucaggaggaggaguauucggaacaggaacaaaaguaacaguacua

SEQ ID NO: 48581 - RNA, 333 nt, Artificial Sequence
  derived and/or modified sequence opt6 from anti-HIV_048-059141_VR-Chain
caaccaguacuaacacaaccaccaucagcaucaggaacaccaggacaaagaguaucaauaucaugcagcggaaacuucucaaacauaggaucaaaauacguauacugguaccaacaaauaccaggaacagcaccaaacguaauaauauacagaacaaaccuacgaccaucaggaauaccagacagauucucagcaucaaaaucaggaacaucagcaacacuaggaauaacaggauuacaaacaggagacgaagcagacuacuacugcggaacaugggacacaucacuaucagcaggaggaguauucggaacaggaacaaaaguaacaguacua

SEQ ID NO: 48582 - RNA, 333 nt, Artificial Sequence
  derived and/or modified sequence opt6 from anti-HIV_048-057777_VR-Chain
caaucaguacuaacacaaccaccaucacuaucagcagcaccaggacaaagaguaacaauaucaugcucaggaucaucaucaaacauaggaaacaacuacguaucaugguaccaacaauucccaggaacagcaccaacauuacuaauauacgaaaacgacaaaagaccaucaggaauaccagacagauucucagcaucaaaaucaggaacaucagcaacacuaggaauaacaggacuacaagcaggagacgaagcagacuacuacugcggaacaugggacacaucacuaucagcaggaggaguauucggaacaggaacaaaaguaacaguacua

SEQ ID NO: 48583 - RNA, 333 nt, Artificial Sequence
  derived and/or modified sequence opt6 from anti-HIV_048-056928_VR-Chain
caaucaguacucacacaaccaccaucaguaucagcagcaccaggacaaaaaguaacaauaucaugcagcggaucaaguucaacaauaggaaacaacuacguaucaugguaccaacuacuaccaggaacagcaccaaaacuacuaauauacgacaacgacaacagaccaucagacauaccagacagauucucaggaucaaaaucaggaacaucagcaacacuaggaauaacaggacuacaaacaggagacgaagcagacuacuacugcggagcaugggacacaucacuaucagcaggaggaguauucggaacaggaacaaaaguaacaguacua

SEQ ID NO: 48584 - RNA, 333 nt, Artificial Sequence
  derived and/or modified sequence opt6 from anti-HIV_048-056131_VR-Chain
caauucguacuaacacaaccagcaucaguaucaggaucaccaggacaaucaauaacaauaucaugcucaggaacaucaucagacguaggauacaacuacguaucaugguaccaacaacuaccaggaacagcaccaaaacuacuaauauacgaaaacacaaaaagaccaucaggaauaccagacagauucucaggaagcaaaucaggaacaucagcaacacuaggaauaacaggacuacaaacaggagacgaagcagacuacuacugcggaacaugggacacaucacuaucagcaggaggaguauucggaucaggaacaaaaguaacaguacua

SEQ ID NO: 48585 - RNA, 333 nt, Artificial Sequence
  derived and/or modified sequence opt6 from anti-HIV_048-055864_VR-Chain
caaucaguauuaacacaaccaccaucaguaucaguagcaccaggacaaaaaguaacaauauacuguucaggaucaucaucaaauauaggaaaaaacucaguaucaugguacguacaaguaccaggaacagcaccaaaauuccuaauauacgaaaauaaccaaagaccaaguggaauaucagacagauucucaggaucaaaaucaggaacaucagcaacacuaggaauaucaggacuacaaacaggagacgaagcagacuacuacugcggaacaugggacacaucacuaucaggaggaggaguauucggaacaggaacaaaaguaacaguacua

SEQ ID NO: 48586 - RNA, 333 nt, Artificial Sequence
  derived and/or modified sequence opt6 from anti-HIV_048-055094_VR-Chain
caaucaguauuaacacaaccaccaucaguaagcggagcaccaggacaaagaguaacaauaucauguucagcaucaucaucaucaauaggaaacgacuucguaucaugguaccaacaauuaccaggaacagcaccaaaacuacuaauaucagaaaauaacaaaagaccaucaggaauaccagacagauucucaggaucaaaaucaggaacaucagcaacauuaggcauaacaggacuacaaacaggagacgaagcagacuacuauugcggaacaugggacucaucauuaucagcaggaggaguauuuggaacaggaacaaaaguaacaguacua

SEQ ID NO: 48587 - RNA, 333 nt, Artificial Sequence
  derived and/or modified sequence opt6 from anti-HIV_048-054343_VR-Chain
caaucaguauuaacacaaccaccaagcguaagcggagcaccaggacaaagaguaacaauaagcuguacaggaagcucaaguaauauaggaggauaugacguaaacugguaccaacaauuaccaggaacagcaccaaaacuauuaauauuuaaaaauaacgaaagaccaagcggaauaccagacagauucucaggaucaaaaucaggaacaagcgcaacauuaggaauaacaggacuacaaacaggagacgaagcagauuacuauugcggaacaugggacacaagccuaagcgcaggaggaguauuuggaacaggaacaaaaguaacaguacua

SEQ ID NO: 48588 - RNA, 333 nt, Artificial Sequence
  derived and/or modified sequence opt6 from anti-HIV_048-054193_VR-Chain
caaagcguauuaacacaaccaccaagcguaagcgcagcaccaggacaaaaaguaacaauaagcuguaguggaggaucaagcaauauaggaaacaauuacgugagcugguaccaucaaguaccaggaacagcaccaaaacuauuaauauuugaaaauaacaaaagaccaagcggaauaccagacagauucucaggaucaaaaucaggaacaagcgcaacauuaggaauaacaggacuacaaacaggagacgaagcagauuacuauugcggaacaugggacacaucauuaagcggaggaggaguauuuggaacaggaacaaaaguaacaguacua

SEQ ID NO: 48589 - RNA, 333 nt, Artificial Sequence
  derived and/or modified sequence opt6 from anti-HIV_048-052521_VR-Chain
caaucaguauuaacacaaccaccaucaguaucagcagcaccaggacaaaaaguaacaauaucaugcucaggaucaucaucaaacauaggaagacacucaguaucaugguaccaacaacuaccaggaacagcaccaaaacuacuaauauacgacacagacaaaagaccaucaggaauaccagacagauucucaggaucaaaaucaggaacaucagcaacacuaggaauaacaggacuacaaacaggagacgaagcagacuacuacugcggaacaugggacacaucauuaucaggaggaggaguauucggaacaggaacaaaaguaacaguacua

SEQ ID NO: 48590 - RNA, 333 nt, Artificial Sequence
  derived and/or modified sequence opt6 from anti-HIV_048-049037_VR-Chain
caaucaguacuaacacaaccaccaucaguaucagcagcaccaggacaaaaaguaacaauaucaugcucaggaucaucauucaacauaggaaacaacuacguaucaugguaccaacaccuaccaggaacagcaccaaaacuacuaauauacgcagcaguaacaagaccaucaggaauaccagacagauucucaggaucaaaaucaggaacaucagcaacauuagacauaacaggacuacaaacaggagacgaagcagacuacuacugcggaacaugggacacaucacuaucagcaggaggaguauucggaacaggaacaaaaguaacaguacua

SEQ ID NO: 48591 - RNA, 333 nt, Artificial Sequence
  derived and/or modified sequence opt6 from anti-HIV_048-048720_VR-Chain
caaucaguacuaacacaaccaccagcaguaucagcagcaccaggacaaagaguagcaauaucaugcucaggaacaucaucaaacauaggaucaaacuuaguauccugguaccaacaauuaccaggaaaagcaccaagauuacuaauauacgacaacuacaaaagaccaucaggaauaccagacagauucucaggaucaaaaagcggaacaucagcaacacuaggaauaacaggacuacaaacaggagacgaagcagacuacuacugcggaacaugggacacaucacuaucaacaggaggaguauucggaacaggaacaaaaguaacaguacua

SEQ ID NO: 48592 - RNA, 333 nt, Artificial Sequence
  derived and/or modified sequence opt6 from anti-HIV_048-048542_VR-Chain
caaucaguacuaacacaaccaccaucaguaucagcagcaccaggacaaaaaguaacaauaucaugcucaggaucaucaucaaacauaggaaacaacuucguaucaugguaccaacaacuaccaggaacagcaccaaaacuacuaauauacaacaacgacagaagaccaucaggaguaccagacagauucucagcaucaaaauucggaacagcagcaacacuaggaauaacaggacuacaaacaggagacgaagcagacuacuacugcggaaccugggacucaucacuaucagcaggaggaguauucggaacaggaacaaaaguaacaguacua

SEQ ID NO: 48593 - RNA, 333 nt, Artificial Sequence
  derived and/or modified sequence opt6 from anti-HIV_048-047777_VR-Chain
caaucaguacuaacacaaccaccaucagcaucaggaacaccaggacaaagaguaacaauaucaugcucaggaucaucagcaaacauaggaacaaacuacguauucugguaccaacaccuaccaggaacagcaccaaaacuauuaauauacgaaaacaacaaaagaccaucaggaauaccagacagauucucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 48594 - RNA, 333 nt, Artificial Sequence
  derived and/or modified sequence opt6 from anti-HIV_048-046841_VR-Chain
caaucaguauuaacacaaccaccaagcguaagcgcagcauuaggacaaaaaguaacaauaacauguagcggagacaauggaaauauaggauaccauuacguaagcugguaccaacaaguaggaagagcagcaccaaaacuauuaauauaugcaaauaacaaaagaccaagcggaauaccagacagauucucaggaucaaaaucaggaacaagcgcaacauuaggaauaacaggacuacaaacaggagacgaagcagauuacuauugcggaacaugggacacaagcuuaagcgcaggaggaguauuuggaucaggaacaaaaguaacaguacua

SEQ ID NO: 48595 - RNA, 333 nt, Artificial Sequence
  derived and/or modified sequence opt6 from anti-HIV_048-046202_VR-Chain
caaucaguacuaacacaaccaccaucaguaucagcagcaccaggacaaaaaguaacaauaucaugcucaggaucaucaucaaacauaggaaacaacuacguaucaugguaccaacaccuaccaggaacagcaccaaaauuacuaauauacgacacauacaaaagacacucaggaguaccagacagauucucaaacucaaaaucaggaacaucagcaacacuagcaauaacaggacuacaaacaggagacgaaggagacuacuacugcggagcaugggacacaucacuaucagcaggaggaguauucggaacaggaacaaaaguaacaguacua

SEQ ID NO: 48596 - RNA, 333 nt, Artificial Sequence
  derived and/or modified sequence opt6 from anti-HIV_048-046059_VR-Chain
caaucaguacuaacacaaccaccaucaguaucagcagcaccaggacaaaauguaacaauaucaugcucaggaacaucaucaaacauagaaaacaacuacguaucaugguaccaaacacuaccaggaacagcaccaaaacuauuaauauacgacaacaacaaaagaccaucaggaauaccagacagauucucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 48597 - RNA, 333 nt, Artificial Sequence
  derived and/or modified sequence opt6 from anti-HIV_048-043568_VR-Chain
caaucaguacuaacacaaccaccaucaguaucagcagcaccaggacaaaaaguaacaauaucauguucaggaucagacucaaauauaggaucaaauuacguaucaugguaccaacaacuaccaggagcagcaccaaaacuacuaauauacaaaaauaacaacagaccaucaggaauaccagacagauucucaggaucaaaaucaggaacaucagcaacacuaggaauaagcggacuacaaacaggagacgaagcagacuacuacugcggaacaugggacacaucacuaucaggaggaggaguauucggaacaggaacaaaaguaacaguacua

SEQ ID NO: 48598 - RNA, 333 nt, Artificial Sequence
  derived and/or modified sequence opt6 from anti-HIV_048-042713_VR-Chain
caaagcguauuaacacaaccaccaagcguaagcgcagcaccaggacaaaaaguaacaauaagcuguagcggaagcucaagcaauauaggaagacauuacguaaguugguaccaacaauuaccaggaacagcaccaaaacuauuaauauaugacaauaacucaagaccaagcggaauaccagacagauucucaggaucaaaaucaggaacaagcgcaacauuaggaauaacaggacuacaaacaggagacgaagcagauuacuauugcggaacaugggacacaucauuaaacagaggaggaguauuuggaacaggaacaaaaguaacaguacua

SEQ ID NO: 48599 - RNA, 333 nt, Artificial Sequence
  derived and/or modified sequence opt6 from anti-HIV_048-042440_VR-Chain
caaucaguacuaacacaaccaccaucagcaucaggaacaccaggacaaagaguaacaauaucaugcucaggaucaucaucaaauauaggaacaaacacaguaaacugguaccaacaacuaccaggaacagcaccaaaacuauuaauauacgaaaacucaaaaagaccaucaggaauaccagacagauucucaggaucaaaaucaggaacaucagcaacauuaggaauaacaggacuacaaacaggagacgaagcagacuacuacugcggaacaugggacacaucacuaucagcaggaggaguauucggaucaggaacaaaaguaacaguacua

SEQ ID NO: 48600 - RNA, 333 nt, Artificial Sequence
  derived and/or modified sequence opt6 from anti-HIV_048-040511_VR-Chain
caaucaguauuaacacaaccaccaucaguaucagcagcaccaggacaaaaaguaacaauaucaugcucaggaucaucaucaaacauaggaaacaacuacguaucaugguaccaacacuuaccaggaacagcaccaaaacuacuaauauacgaaaacaacaaaagaucaucaggaauaccagaaagauucagcggaucacaaucaggaacaucagcaacauuaggaauaacaggacuacaaacaggagacgaagcagacuacuacugcggaacaugggacacaucacuaagcacaggaggaguauucggaacaggaacaaaaguaacaguacua

SEQ ID NO: 48601 - RNA, 333 nt, Artificial Sequence
  derived and/or modified sequence opt6 from anti-HIV_048-039195_VR-Chain
caaucaguacuaacacaaccaccaucaguaucagcagcaccaggacaaagaguaacaauaucaugcucaggaucaacaagcaacauaggaaaccacuacguaucaugguaccaacaacuaccaggaacagcaccaaaacuacuaauauacgacaacggaaacagaccaucaggaauaccagacagauucucaggaucaaaaucaggaacaucagcaacacuagacauaacaggacuacaaacaggagacgaagcagacuacuacugcggaacaugggacacaucacuaaacagaggaggaguauucggaacaggaacaaaaguaacaguacua

SEQ ID NO: 48602 - RNA, 333 nt, Artificial Sequence
  derived and/or modified sequence opt6 from anti-HIV_048-036935_VR-Chain
caaucaguauuaacacaaccaccaagcaugagcgcagcaccaggagaaagaguaacaauaagcuguacaggaagcucaaguaauauaggaggauaugacguacacugguaccaacaauuaccaggaauagcaccaaaaauauuaauauauagaaauagcauaagaccaagcggaauaccagacagauucucaggaucaaaaucaggaacaagugcaacauuaggaauaacaggacuacaaacaggagacgaagcagauuacuauugcggaacaugggacacaagccuaagcacaggaggaguauuuggaacaggaacaaaaguaacaguacua

SEQ ID NO: 48603 - RNA, 333 nt, Artificial Sequence
  derived and/or modified sequence opt6 from anti-HIV_048-034478_VR-Chain
caaucaguauuaacacaaccaccaagcguaagcgcagcaccaggacaaaaaguaacaauaagcuguacaggaagcggaagcaauauaggaaacaaugacguaagcugguaccaacaauuaccaggaacagcaccaagacuauuaauauauggagauaacaaaagaccaagcggaauaccagacagauucaguggaucaaaaucaggaacaagcgcaacauuaggaauaacaggacuacaaacaggagacgaagcagauuacuauugcggaacaugggacacaaguuuaagcgcaggaggaguauuuggaacaggaacaaaaguaacaguacua

SEQ ID NO: 48604 - RNA, 333 nt, Artificial Sequence
  derived and/or modified sequence opt6 from anti-HIV_048-031641_VR-Chain
caaucaguauuaacacaaccaccaaguguaagcgcagcaccaggacaaaaaguaacaauaagcuguagcggaaacaauagcaauauaggaaacaauuacguaagcugguaccaacaauuaccaggaacagcaccaaaacuauuaauauaugaaaauagcaaaagaccaagcggaauaccagacagauucucaggaucaaaaucaggaacaagcgcaacauuaggaauaacaggacuacaaacaggagacgaagcagauuacuauugcggaacaugggacacaucauuaagcgcaggaggaguauuuggaagcggaacaaaaguaacaguacua

SEQ ID NO: 48605 - RNA, 333 nt, Artificial Sequence
  derived and/or modified sequence opt6 from anti-HIV_048-029760_VR-Chain
caaucagcauuaacacaaccagcaagcguaagcggaagcucaggacaaagcauaacaauaagcuguacaggaacaaauagcgauguaggauacgauuacguaugcugguaccaacaauuaccaggaacagcaccaaaacuauuaauauaugaaaauaacaaaagaccaagcggaauaccagacagauucucaggaucaaaaucaggaacaagcgcaacauuaggaauaacaggacuacaaacaggagacgaagcagauuacuauugcggaacaugggacacaaguuuaagcgcaggaggaguauuuggaacaggaacaaaaguaacaguacua

SEQ ID NO: 48606 - RNA, 333 nt, Artificial Sequence
  derived and/or modified sequence opt6 from anti-HIV_048-027970_VR-Chain
caaagcguauuaacacaaccaccaagcguaagcgcaccaccaggacaaaaaguaacaauaagcuguagcggaacaacaagcaauauaggaagcaauuacguagcaugguaccaacaauuuccaggaacagcaccaaaacuauuaauauaugaaaauaacaaaagaccaagcggaauaccagacagauucucaggaucaaaaucaggaacaagcgcaacauuaggaauaacaggacuacaaacaggagacgaagcagauuacuauugcgcaacaugggacacaucauuaagcgcaggaggaguauuuggaacaggaacaaaaguaacaguacua

SEQ ID NO: 48607 - RNA, 333 nt, Artificial Sequence
  derived and/or modified sequence opt6 from anti-HIV_048-027337_VR-Chain
caaucaguacuaacacaaccaccaagcguaucagcagcaccaggacaaaaaguaacaauaucaugcucaggaucauacucaaacauaggaaacaacuaccuaucaugguaccaacaacuaccaggaacagcaccaaaacuacuaauauacaaaaacaacaaaagaccaucaggaguaccagacagauucucaggaagcaaaucaggagcaucagcaacacuagacauaacaggacuacaaacaggagacgaagcagacuacuacugcggaauaugggacacaucacuaucagcaggaggaguauucggaacaggaacaaaaguaacaguacua

SEQ ID NO: 48608 - RNA, 333 nt, Artificial Sequence
  derived and/or modified sequence opt6 from anti-HIV_048-027217_VR-Chain
caaucaguacuaacacaaccaccaucaguaucagcagcaccaggacaaaaaguaacaauaucaugcucaggaagcucaucaauaauaggaaacaacuacguaucaugguaccaacaacuaccaggaacagcaccaaaauuacuaauauacgaaaacaacaaaagaccaucaggaauaccagacagauucucaggaucaaaaucaggaacaucagcaacacuagcaauagcaggauuacaaacaggagacgaagcagacuacuacugcgcaacaugggacacaucacuaucagcaggaggaguauucggaacaggaacaaaaguaacaguacua

SEQ ID NO: 48609 - RNA, 333 nt, Artificial Sequence
  derived and/or modified sequence opt6 from anti-HIV_048-026760_VR-Chain
caaucaguacuaacacaaccaccaucaguaucagcagccccaggacaaaaaguaacaauaucaugcucaggaucaucaucaaacauaggaaacaacuacguaucaugguaccaacaccuaccaggaacagcaccaaaacuacuaauauacgacacaguaaaaagacacucaggaguaccagacagauucucaggaucaaaaucaggaacaucagcaacacuaggaauaucaggacuacaaacaggagacgaagcagacuacuacugcggaacaugggacacaucacuaucagcaggaggaguauucggaucaggaacaaaaguaacaguauua

SEQ ID NO: 48610 - RNA, 333 nt, Artificial Sequence
  derived and/or modified sequence opt6 from anti-HIV_048-024800_VR-Chain
caaagcguauuaacacaaccaccaaguguaagcgcagcaccaggacaaaaaguaacaauaagcuguagcggaagcuauagcaauauaggaaacaauuacguaagcugguaccaaguauuaccaggaacagcaccaaaacuauuaauauauaaaaauaacgaaagaccaagcggaauaccagacagauucucaggaucaaaaucaggaacaagcgcaacauuaggaauaacaggacuacaaacaggagacgaagcagauuacuauugcggaacaugggacacaucauuaagcgcaggaggaguauuuggaacaggaacaaaaguaacaguacua

SEQ ID NO: 48611 - RNA, 333 nt, Artificial Sequence
  derived and/or modified sequence opt6 from anti-HIV_048-024313_VR-Chain
caaucaguacuaacacaaccaccaucaguaucagcagcaccaggacaaaaaguaacaauaucaugcagcggaucaucaucaacaauaggaaacucacacguaucaugguaccaaauacuaccaggaacagcaccaaaacuauuaauauacaaagacgacaaaagaccaucaggaauaccagacagauucucaggaucaaaaucaggaacaucagcaacacuaggaauaaccggacuacaaacaggagacgaagcagacuacuacugcggaacaugggacacaucauuaaacagaggaggaguauucggaacaggaacaaaaguaacaguacua

SEQ ID NO: 48612 - RNA, 333 nt, Artificial Sequence
  derived and/or modified sequence opt6 from anti-HIV_048-021748_VR-Chain
caaucaguauuaacacaaccaccaagcguaagcgcagcaccaggacaaagaguaacaauaagcuguagcggaagcacaagcaauauaggaaacaauuacguaagcugguaccaacaauuaccaggaacagcaccaaaacuauuaauauaugaaaauaacaaaagaccaagcggaauaccagacagauucucaggaucaaaaucaggaacaagcgcaacauuaggaauaagcggacuacaaacaggagacgaagcagauuacuauugcggaacaugggacagcucauuaagcggaggaggaguauuuggaacaggaacaaaaguaacaguacua

SEQ ID NO: 48613 - RNA, 333 nt, Artificial Sequence
  derived and/or modified sequence opt6 from anti-HIV_048-020991_VR-Chain
caaucaguacuaacacaaccaccaucagcaucaggaacaccaggacaaaaaguaacaauaucaugcucaggaucaucaucaacaauaggaaacaacuacguaucaugguaccaaguauuaccaggaacagcaccaaaacuacuaauauacaaaaacgacaaaagaccaucaggaauaccagacagauucucaggaucaaaaucaggaacaucagcaacacuaggaauaacaggacuacaaacaggagacgaagcagacuacuacugcggaacaugggacacaucacuaucaacaggaggaguauucggaacaggaacaaaaguaacaguacua

SEQ ID NO: 48614 - RNA, 333 nt, Artificial Sequence
  derived and/or modified sequence opt6 from anti-HIV_048-020340_VR-Chain
caaagcguauuaacacaaccaccaagcguaagcgcagcaccaggacaaagaguaacaauaagcuguagcggaagcucaagcaauguaggaaacaauuauguaagcugguaccaacaauuaccaggaacagcaccaaaacuauuaauauaugaaaauaacaaaagaccaagcggaauaccagacagauucucaggaucaaaaucaggaacaagugcaacacuaggaauaacaggacuacaaacaggagacgaagcagauuacuauugcggaacaugggacgcaucauuaagcgcaggaggaguauuuggaacaggaacaaaaguaacaguacua

SEQ ID NO: 48615 - RNA, 333 nt, Artificial Sequence
  derived and/or modified sequence opt6 from anti-HIV_048-019993_VR-Chain
caaaguguauuaacacaaccaccaucaguaucaggagcaccaggacaaagaguaacaauaucauguacaggaucaucaucaucaauaggaggauuugacguacacugguaccaaagauuaccaggaacagcaccaagacuacuaauauaugaaaauaacaaacgaccaucaggaauaccagacagauucucaggaaguaaaucaggaacaucagcaacauuaggaauaacaggacuacaaacaggagacgaagcagauuacuauugcggaacaugggacucaucauuaucagcaggaggaguauuuggaacaggaacaaaaguaacaguacua

SEQ ID NO: 48616 - RNA, 333 nt, Artificial Sequence
  derived and/or modified sequence opt6 from anti-HIV_048-019947_VR-Chain
caaucaguacuaacacaaccaccaucaguaucagcagcaccaggacaaagaguaacaauauccugcucaggaucaucaucaaacauaggaucaaaauacguaucaugguaccaacaacuaccaggaacagcaccaaaacuacuaauauacgaaaacucaaaaagaccaucaggaauaccagacagauucucaggaucaaaaucaggaacaucagcaacacuaggaauaacaggacuacaaacaggagacgaagcagacuacuacugcggaacaugggacacaucacuaucaacaggaggaguauucggaacaggaacaaaaguaacaguacua

SEQ ID NO: 48617 - RNA, 333 nt, Artificial Sequence
  derived and/or modified sequence opt6 from anti-HIV_048-017871_VR-Chain
caaagcguauuaacacaaccaccaagcguaagcgcagcaccaggacaaaaaguaacaauaagcuguagcggaagcucaagcaauauaggaaacagauacguaagcugguaccaacaauuaccaggaacagcaccaaaacuauuaauauauaaaaauaacaaaagaccaagcggaauaccagacagauucucaggaucaaaaucaggaacaagcgcaacauuaggaauaacaggacuacaaacaggagacgaagcagauuacuauugcggaacaugggacggaucauuaagcacaggaggaguaauaggaacaggaacaaaaguaacaguacua

SEQ ID NO: 48618 - RNA, 333 nt, Artificial Sequence
  derived and/or modified sequence opt6 from anti-HIV_048-015931_VR-Chain
caaagcguacuaacacaaccaccaagcguaagcgcagcaccaggacaaaaaguaacaauaucaugcucaggaggaucaucaaacauaggaucaacauacguaucaugguaccaacaaguaccaggaacagcaccaaaacuacuaauauacgaaaacaacaaaagaccaucaggaauaccagacagauucucaggaagcaaaucaggaacaucagcaacacuagacauaacaggacuacaaacaggagacgaagcagacuacuacugcggaacaugggacacaucacuaucaggaggaggaguauucggaacaggaacaaaaguaacaguacua

SEQ ID NO: 48619 - RNA, 333 nt, Artificial Sequence
  derived and/or modified sequence opt6 from anti-HIV_048-015920_VR-Chain
caaagccuauuaacacaaccaccaaguguaagugcagcaccaggacaaaaaguaacaauaagcuguagcggaagcucaagcacaauaggaaacaauuacguaagcugguaccaaguauuaccaggaacagcaccaaaacuauuaauauauaaaaauaacgaaagaccaagcggaauaccagacagauucucaggaucaaaaucaggaacaagcgcaacauuaggaauaacaggacuacaaacaggagacgaagcagaauacuauugcgcaacaugggacgcaucauuaagcggaggaggaguauuuggaacaggaacaaaaguaacaguacua

SEQ ID NO: 48620 - RNA, 333 nt, Artificial Sequence
  derived and/or modified sequence opt6 from anti-HIV_048-013898_VR-Chain
caaucaguacuaacacaaccaccaucaguaucagcagcaccaggacaaaaaguaacaauaucauguucaggaucaucaaguaauauaggaaaacacucaguaucaugguaccaacaauuaccaggaacagcaccagaacuauuaauauacgacaauaacaauagaccaucaggaauaccagacagauucucaggaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 48621 - RNA, 333 nt, Artificial Sequence
  derived and/or modified sequence opt6 from anti-HIV_048-013429_VR-Chain
caaucaguauuaacacaaccaccaagcguaagcgcagcaccaggacaaaaaguaacaauaagcuguagcggaagcucaaguaauauaggaaacaauuacguaagcugguaccaacaauuaccaggaacagcaccaacacuauugauauaugaaaaugacaaaagaccaaguggaauaccagacagauucucaggaucaaaaucaggaacaagcgcaacauuaggaauaacaggacuacaaacaggagacgaagcagauuacuauugcggaacaugggacucaagccuaagcgcaggaggaguauuuggaacaggaacaaaaguaacaguacua

SEQ ID NO: 48622 - RNA, 333 nt, Artificial Sequence
  derived and/or modified sequence opt6 from anti-HIV_048-012358_VR-Chain
caaagcguauuaacacaaccaccaagcguaagcgcagcaccaggacaaaaaguaacaauaagcuguagcggaagcaauucagcaauaggaaacaauuacguaagcugguaccaaguauuaccaggaacagcaccaaaacuauuaauauauaaaaauaacgaaagaccaagcggaauaccagacagauucucaggaucaaaaucaggaacaagugcaacauuagacauaacaggacuacaaacaggagacgaagcagauuacuauugcggaacaugggacacaucauuaagcgcaggaggaguauuuggaacaggaacaaaaguaacaguacua

SEQ ID NO: 48623 - RNA, 333 nt, Artificial Sequence
  derived and/or modified sequence opt6 from anti-HIV_048-011158_VR-Chain
caaucaguacuaacacaaccaccaucaguaucagcagcaccaggacaaaaaguaacaauaucaugcucaggaauaucaucaaacauaggaaacaacgacguaucaugguaccaacaacuaccaggaacagcaccaaaacuacuaauauacgacaacgacaaaagaccaucaggaauaccagacagauucucaggaucaaaaucaggaacaucagcaacauuaggaauaacaggacuacaaacaggagacgaagcagacuacuacugcggaacaugggacucaucacuaucagcaggaggaguauucggaacaggaacaaaaguaacaguacua

SEQ ID NO: 48624 - RNA, 333 nt, Artificial Sequence
  derived and/or modified sequence opt6 from anti-HIV_048-010720_VR-Chain
caaucaguauuaacacaaccaccaucaguaucagcagcaccaggacaaaaaguaacaauaagcuguucaggaaguucaagcaauauaggaucacauuacguaucaugguaccaacaaguaccaggaacagcaccaagauuaguaauauaugaaaauucaaaaagaccaucaggaauaccagacagauucucaggaucaaaaucaggaacaucagcaacacuaggaauaacaggacuacaaacaggagacgaagcagauuacuauugcggaacaugggacacaucacuaucagcaggaggaguauuuggaucaggaacaaaaguaacaguacua

SEQ ID NO: 48625 - RNA, 333 nt, Artificial Sequence
  derived and/or modified sequence opt6 from anti-HIV_048-009445_VR-Chain
caaucaguacuaacacaaccaccaucaguaucagcagcaccaggacaaaaaguaacaauaucaugcucaggaucaucaucaaacauaggaaacaacuacguaagcugguaccaacaacuaccaggaacaguaccaaaacuacuaauauacgacacauacacaagaccaucaggaacaccagacagauucucaggaucaaaaucaggaacaucagcaacacuagcaauaacaggacuacaaacaggagacgaagcagacuacuacugcggaacaugggacggaucauuaucaacaggaggaguaauaggaacaggaacaaaaguaacaguacua

SEQ ID NO: 48626 - RNA, 324 nt, Artificial Sequence
  derived and/or modified sequence opt6 from anti-HIV_048-006126_VR-Chain
caaagcguauuaacacaaccaccaagcguaucaggagcaccaggacaaaaaguaacaauaucaugcucaggaauaagcucaaacuuuggaauaagcugguaccaacaaguaccaggaacagcaccaaaacuauuaauauaugaaaaugacaaaagaccaagcggaauaccagacagauucucaggaucaaaaucaggaacaagcgcaacauuaggaauaacaggacuacaaacaggagacgaagcagauuacuauugcggaacaugggacacaucauuaagcgcaggaggaguauuuggaacaggaacaaaaguaacaguacua

SEQ ID NO: 48627 - RNA, 333 nt, Artificial Sequence
  derived and/or modified sequence opt6 from anti-HIV_048-005652_VR-Chain
caaagcguauuaacacaaccaccaagcguaagcgcagcaccaggacaaaaaguaacaauaagcuguagcggaagcaauagcgcaauaggaaacaauuacguaagcugguaccaaguauuaccaggaacagcaccaaaacuauuaauauaugacacauacaaaagagcaagcggaauaccagacagauucucaggaucaaaaucaggaacaagcgcaacauuaggaauaacaggacuacaaacaggagacgaagcagauuacuauugcggaacaugggacacaucguuaagcggaggaggaguauuuggaacaggaacaaaaguaacaguacua

SEQ ID NO: 48628 - RNA, 333 nt, Artificial Sequence
  derived and/or modified sequence opt6 from anti-HIV_048-005532_VR-Chain
caaucaguacuaacacaaccaccaucaguaucagcagcaccaggacaaaaaguaacaauaucaugcucaggaacaucaucaaacauaggaaacacauacguaucaugguaccaacaacuaccaggaacagcaccaaacuaccuaauauacaaaauagacaaaagaccaucaggaauaccagacagauucucaggaucaaaaucaggaacaucagcaacacuaggaauaacaggacuacaaacaggagacgaagcagacuacuacugcggaacaugggacacaucacuaucagcaggaggaguauucggaacaggaacaaaaguaacaguacua

SEQ ID NO: 48629 - RNA, 333 nt, Artificial Sequence
  derived and/or modified sequence opt6 from anti-HIV_048-005189_VR-Chain
caaucaguauuaacacaaccaccaagcguaagcgcagcaccaggacaaaaaguaacaauaagcuguaguggaagcggaagcacaauaggaaacaaugacguaagcugguaccaacaacuaccaggagcagcaccaaaacuauuaauauaugaagauaacaaaagaccaagcggaauaccagcaagauucucaggaucaaaaucaggaacaagcgcaacauuaagaauaacaggacuacaaacaggagacgaagcagauuacuauugcggaacaugggacagcucauuaagcgcaggaggaguauuuggaacaggaacaagaguaagcguacua

SEQ ID NO: 48630 - RNA, 333 nt, Artificial Sequence
  derived and/or modified sequence opt6 from anti-HIV_048-005088_VR-Chain
caaucaguacuaacacaaccaccaucaguaucagcagcaccaggacaaaaaguaacaauaucaugcucaggaucaucaucaaacauaggaaaaaacuacguaucaugguaccaacaacuaccaggaacagcaccaaaacuacuaauauacgauaacaacaacagaccaucaggaauaccagacagauucucaggaucaaaaucaggaacaucagcaacacuaggaauaacaggacuacaaacaggagacgaagcagacuacuacugcggagcaugggacacaucauuaucagcaggaggagucuucggaacaggaacaaaaguaacaguacua

SEQ ID NO: 48631 - RNA, 333 nt, Artificial Sequence
  derived and/or modified sequence opt6 from anti-HIV_048-004023_VR-Chain
caaucaguacuaacacaaccaccaucaguaucagcaacaccaggacaaaaaguaacaauaucaugcucaggaggaucaucaaacauaggaaaaaacgacguaucaugguaccaacaacuaccaggaacagcaccaaaacuacuaauauacgacacaaacaaaagaccaucaggaauaccagacagauucucagcagcaagaucaggaacaucagcaacacuagacauaacaggauuacaaacaggagacgaagcagacuacuacugcggaacaugggacacaucacuaucagcaggaggaguauucggaacaggaacaaaaguaacaguacua

SEQ ID NO: 48632 - RNA, 333 nt, Artificial Sequence
  derived and/or modified sequence opt6 from anti-HIV_048-001580_VR-Chain
caaucaguacuaacacaaccaccaucaguaucagcagcaccaggacaaaaaguaacaauaucaugcucaggaagcucaucaaacauaggaaacaacuacguaucaugguaccaacaacuaccaggaacagcaccaaaacuacuacuauacgaaaacaacaaaagaccaucaggaauaccagacagauucucaggaucaaaaucaggaacaucagcaacacuagcaauaacaggacuacaaacaggagacgaagcagcauacuacugcggaacaugggacggaucacuaucaacaggaggaguaauaggaacaggaacaaaaguaacaguacua

SEQ ID NO: 48633 - RNA, 333 nt, Artificial Sequence
  derived and/or modified sequence opt6 from anti-HIV_038-221120_VR-Chain
caaucaguauuaacacaaccaccaagcguaagcgcagcaccaggacaaaaaguaacaauaagcuguagcggaagcacaaguaauauaggaaaaaauuacguaagcugguaccaacaacuaccaggaacagcaccaaaacuauuaauauaugacaauaacgaaagaccaagcggaauaccagacagauucucaggaucaaaaucaggaacaagcgcaacauuaggaauaacaggacuacaaacaggagacgaagcagauuacuauugcgcaacaugggacucaagccuaagcggaggaggaguauuuggaacaggaacaagaguaacaguacua

SEQ ID NO: 48634 - RNA, 333 nt, Artificial Sequence
  derived and/or modified sequence opt6 from anti-HIV_038-197677_VR-Chain
caaucaguauuaacacaaccaccaucaguaucagcagcaccaggacaaaaaguaacaguaucaugcucaggaucaaacucaaacauaggaaaccacuacguaucaugguaccaacaacuaccaggaacagcaccaaaacuacuaauauacgacaacaacaaaagaccaucaggaauaccagacagauucucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 48635 - RNA, 333 nt, Artificial Sequence
  derived and/or modified sequence opt6 from anti-HIV_038-196765_VR-Chain
caaucagcauuaacacaaccagcaucaguaucaggaucaccaggacaaucaauaacaauaucauguacaggaacaagcggagacguaggauacaaccuaguaucaugguaccaacaacuaccaggaacagcaccaaaaguacuaauauacgaaaauaacaaaagaccaucaggaauaccagacagauucucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 48636 - RNA, 333 nt, Artificial Sequence
  derived and/or modified sequence opt6 from anti-HIV_038-186200_VR-Chain
caaucaguauuaacacaaccaccaagcgcaagcggaacaccaggacaaagaauaacaauaagcuguagcggaacaucaagcaauauaggaagcaauauaguaagcugguaccaacacuuaccaggaacaacaccaaaauuaguaauauuuagaaauaaccaaagaccaagcggaauaccagacagauucucaggaucaaaaucaggaacaagcgcaacacuaggaauaacaggacuacaaacaggagacgaagcagauuacuauugcggaacaugggacucaaguuuaagcgcaggaggaguauuuggaacaggaacaaaaguaacaguacua

SEQ ID NO: 48637 - RNA, 333 nt, Artificial Sequence
  derived and/or modified sequence opt6 from anti-HIV_038-126170_VR-Chain
caaucaguacuaacacaaccaccaucaguaucagcaccaccaggacaaaaaguaacaauaucaugcucaggaacaacaucaaacauaggaucaaacuacguagcaugguaccaacaacuaccaggaacagcaccaaaacuauuaauauacgacaacguaaaaagaccaacaaacauaccagacagauucagcggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 48638 - RNA, 333 nt, Artificial Sequence
  derived and/or modified sequence opt6 from anti-HIV_038-108545_VR-Chain
caaucaguauuaacacaaccaccaagcgcaagcggaacaccaggacaaagaguaacaauaagcuguagcggaagcucaagcaauauaggauacaauacaguaagcugguaccaacaauuaccaggaacagcaccaaaacuauuaauauaugaaaauaacaaaagaccaagcggaauaccagacagauucucaggaucaaaaucaggaacaagcgcaacauuaggaauaacaggacuacaaacaggagacgaagcagauuacuauugcggaacaugggacagcucauuaagcgcaggaggaguauuuggaacaggaacaaaaguaacaguacua

SEQ ID NO: 48639 - RNA, 333 nt, Artificial Sequence
  derived and/or modified sequence opt6 from anti-HIV_038-107263_VR-Chain
caaucaguauuaacacaaccaccaucagcaagcggaacaccaggacaaagaguaacaauaagcuguaguggaagcucaagcaauauaggaagcaauacaguaaacugguaccaacaaguaccaggaacagcaccaaaucuauuaauauauagcaaugaccaaagaccaagcggaauaccagacagauucucaggaucaaaaucaggaacaagcgcaacauuaggaauaacaggacuacaaacaggagacgaagcagauuacuauugcggaacaugggacagcucauuaagcgcaggaggaguauuuggaacaggaacaaaaguaacaguacua

SEQ ID NO: 48640 - RNA, 333 nt, Artificial Sequence
  derived and/or modified sequence opt6 from anti-HIV_038-104530_VR-Chain
caaucaguacuaacacaaccaccaucaguaucagcagcaccaggacaaaaaguaacaauaucaugcucaggaucaucaagcaacaucggaucaaacuacguaucaugguaccaacaccuaccaggaaaagcaccaaaacuacuaauauacgacaacaacaaaagaccaucaggaauaccagacagauucucaggaucaaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 48641 - RNA, 333 nt, Artificial Sequence
  derived and/or modified sequence opt6 from anti-HIV_038-099169_VR-Chain
caaucaguauuaacacaaccaccaagcgcaagcggaacaccaggacaaagaguaagcauaagcuguagcggaauaacaagcucacuaggaagcaaucacaugagcugguaccaacaauuaccaggaacagcaccaaaacuauuaauauaugaaaauaacaaaagaccaagcggaauaccagacagauucucaggaucaaaaucaggaacaagcgcaacauuaggaauaacaggacuacaaacaggagacgaagcagauuacuauugcggaacaugggacagcucauuaagcgcaggaggaguauuuggaacaggaacaaaaguaacaguacua

SEQ ID NO: 48642 - RNA, 333 nt, Artificial Sequence
  derived and/or modified sequence opt6 from anti-HIV_038-075067_VR-Chain
caaucaguauuaacacaaccaccaagcguaagcggagcaccaggacaaagaguaacaauaagcuguagcggaagcucaagcacaauaggaaacaauuacguaagcugguaccaacuauuaccaggaacagcaccaaaacuauuaauauauaaaaauaacaaaagaccaagcggaauaccagacagauucucaggaucaaaaucaggaacaagcgcaacauuaggaauaacaggacuacaaacaggagacgaagcagauuacuauugcggaacaugggacacaagccuaucagcaggaggaguauuuggaacaggaacaaaaguaacaguauua

SEQ ID NO: 48643 - RNA, 333 nt, Artificial Sequence
  derived and/or modified sequence opt6 from anti-HIV_038-072368_VR-Chain
caaucaguauuaacacaaagcccaagcgcaagcggaacaccaggacaaagaguaacaauaagcuguagcggaaguucaagcaauauaggaaacaauuacguaaguugguaccaacaauuaccaggaacagcaccaaaacuacuaauauaugaaaauaacaaaagaccaagcggaauaccagacagauucucaggaucaaaaucaggaacaagugcaacauuaggaauaacaggacuacaaacaggagacgaagcagauuacuauugcggaacaugggacucaagccuaagcgcaggaggaguauuuggaacaggaacaaaaguaacaguacua

SEQ ID NO: 48644 - RNA, 333 nt, Artificial Sequence
  derived and/or modified sequence opt6 from anti-HIV_038-068503_VR-Chain
caaucaguacuaacacaaccaccaucaguaucagcagcaccaggacaaaugguaacaauaucaugcucaggaucaagaucaaacauagaaaaccacuacguaucaugguaccaacaccuaccaggagcagcaccaaaacuacuaauauacgacaacggaaaaagaccaucaggaauaccagacagauucucaggaagcaaaucaggaacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 48645 - RNA, 333 nt, Artificial Sequence
  derived and/or modified sequence opt6 from anti-HIV_038-068016_VR-Chain
caaucaguauuaacacaaccaccaagcgcaagcggaacaccaggacaaagaguaacaauaagcuguagcggaagcucaagcaauauagaaaguaauuucguauacugguaccaacaauuuccaggaacaacaccaaaacuauuaauauauagagauggacaaagaccaagcggaauaccagacagauucucaggaucaaaaucaggaacaagcgcaacauuaggaauaacaggacuacaaacaggagacgaagcagauuacuauugcggaacaugggacagcucauuaagcgcaggaggaguauuuggaacaggaacaaaaguaacaguacua

SEQ ID NO: 48646 - RNA, 333 nt, Artificial Sequence
  derived and/or modified sequence opt6 from anti-HIV_038-063958_VR-Chain
caaucaguauuaacacaaccaccaucaguaucaggagcaccaggacaaagaguaacaauaucaugcacaggaucaucaucaaauauaggaaacucaggaguacacugguaccaacaauuaccaggaacagcaccaaaacuauuaauauacgaaaacaacaaaagaccaucaggaauaccagacagauucucaggaucaaaaucaggaacaucagcaacauuaggaauaacaggacuacaaacaggagacgaagcagauuacuacugcggaaccugggacucaucauuaucagcaggaggaguauuuggaacaggaacaaaaguaacaguacua

SEQ ID NO: 48647 - RNA, 333 nt, Artificial Sequence
  derived and/or modified sequence opt6 from anti-HIV_038-033733_VR-Chain
caaucaguacuaacacaaccaccaucagcaucaggaacaccaggacaaagaguaacaauaucaugcucaggaucaucaucaaacauaggaucaaaauacguauacugguaccaacaauuaccaggaacagcaccaaaacuacuaauauacgacaacgacaaaagaccaucaggaauaccagacagaauaucagcaucaaaaucaggaacaucagcaacacuagacauaacaagacuacaaacaggagacgaagcagacuacuacugcggaacaugggacucaucacuaucagcaggaggaguauucggaacaggaacaaaaguaacaguacua

SEQ ID NO: 48648 - RNA, 333 nt, Artificial Sequence
  derived and/or modified sequence opt6 from anti-HIV_038-030557_VR-Chain
caaucaguacuaacacaaccaccaucaguaucagcagcaccaggacaaaaaguaacaauaucaugcucaggaucaucaucaacaauaggaaacaacuacguaucaugguaccaacuacuaccaggaacagcaccaaaacuacuaauauacaaaaacaacaaaagaccaucaggaauaccagacagauucucaggaucaaaaucaggaacaucagcaacacuaggaauaacaggauuacaaacaggagacggagcagacuacuacugcggaacaugggacacaucauuaucagcaggaggaguauucggaacaggaacaauaguaacaguacua

SEQ ID NO: 48649 - RNA, 333 nt, Artificial Sequence
  derived and/or modified sequence opt6 from anti-HIV_038-024298_VR-Chain
caaucaguacuaacacaaccaccaucaguaucagcagcaccaggacaaaaaguaacaauaucaugcucaggaucaucaucaaacauaggaaacucacacguaucaugguaccaacaauucccaggaacaggaccaaaacuacuaauauacgaaaacgcaaaaagaccaucaggaauaccagacagaauaucaggaagcaaaucagacacaucagcaacacuaggaauaacaggacuacaaacaggagacgaagcagacuacuacugcggaacaugggacucaucacuaucagcaggaggaguauucggaacaggaacaaaaguaacaguacua

SEQ ID NO: 48650 - RNA, 333 nt, Artificial Sequence
  derived and/or modified sequence opt6 from anti-HIV_038-011154_VR-Chain
caaucaguauuaacacaaccaccaucaguaagcgcagcaccaggacaaagaauaacaauaucaugcucaggaucaucaucaaauauaggaaacaacuacguaucaugguaccaacaacuaccaggaacagcaccaaaacuccuaauauacaaaaacaacaaaagaccaucaggaauaccagacagauucucaggaucaaaaucaggaacaucagcaacauuaggaauaacaggacuacaaacaggagacgaagcagacuacuacugcggaacaugggacacaucacuaucagcaggaggaguauucggaacaggaacaaaaguaacaguacua

SEQ ID NO: 48651 - RNA, 318 nt, Artificial Sequence
  derived and/or modified sequence opt6 from anti-HIV-1_LightChain
gaaauaguacuaacacaaucaccaggaacauuaagcuuaagcccaggagaaagagcaacauuaagcuguagagcaagccaaagcguaaguaauaacuuucuagcaugguaucaauauaaaccaggacaaccaccaagaguacuaauauacggaacaucaagaagagcaucaggaauaccagauagauuuagcggaagcggaagcggaacagauggaucacuaacaauaucaagauuagaagcagaagauuucgcaguauauuacugucaacaauacgaauucuuuggacaaggaacaagauuagaaaugaaaagaaca

SEQ ID NO: 48652 - RNA, 318 nt, Artificial Sequence
  derived and/or modified sequence opt6 from anti-HIV-1_LightChain
gaaguaguacuaacacaaucaccaggaacauuaaguuuaagcccaggagaaagagcaacauuaagcuguagagcaagccaaaguguaagcagaaacuaucuagcaugguaucaacaaaaauuaggacauggaccaagauuacuaguauacgcaacaucaagaagagcaacaggaauaccagauagauuuauaggaagccaaagcggaacagaauacaaucuaacaauaacaagauuagacccaggagauuucgcacaauauuucugucaacaauacgaauucuuuggaccaggaacaagauuagacauaaaaagaaca

SEQ ID NO: 48653 - RNA, 309 nt, Artificial Sequence
  derived and/or modified sequence opt6 from anti-HIV-1_LightChain
gaaguaguacuaacacaaucaccaggaacacuaucacuaucaccaggagaaagagcaucauucucaugcaaaucaucacaauacggacacacagcaugguaccaacaaaaacuaggacacggaccaagacuacuaauauacgcaacaucaagaagagcaacaggaauaccagaccgauucauaggaucacaaucaggaacagaauacaaccuaacaauaacaagacuagacccaggagacuucgcacacuacuucugccaacaaaacgaauucuucggaccaggaacaagacuagacaugaaaagaaca

SEQ ID NO: 48654 - RNA, 306 nt, Artificial Sequence
  derived and/or modified sequence opt6 from anti-HIV-1_LightChain
gaaauaguacuaacacaaucaccaagcagcuuaucauuaaguccaggagaaagagcaucauuaagcuguagaggaagccauggacauguagcaugguaucaacauaaaccaggacaaauaccaagauuacuaauauacgcaacaagcaaaagagcaucaggaauaagcgauagauuuagcggaaguggaagcggaacagaugcaacacuaucaauaucaagauuagaaccagaagauuucgcaguauauuucugucaacaauacgaauuuuucggacaaggaacaagauuagaaauaaaaagaaca

SEQ ID NO: 48655 - RNA, 306 nt, Artificial Sequence
  derived and/or modified sequence opt6 from anti-HIV-1_LightChain
gaaauaaugcuaacacaaucaccaggaacauuaucauuaagcccaggagaaagagcaacauuaagcuguagaggaagccauggacauguagcaugguaucaacaaaaaccaggaagaauaccaagauuacuaauauacggaacaagcaaaagagcaucaggaauaccagauagauuuagcggaagcggaagcggaacagaugcaacacuaacaauaucaagauuagaaucagaagauuucgcaguauauuucugucaacaauacgaauuuuucggacaaggaacaagauuagacauaaacagaaca

SEQ ID NO: 48656 - RNA, 309 nt, Artificial Sequence
  derived and/or modified sequence opt6 from anti-HIV-1_LightChain
gaaucaguacuaacacaaucaccaggaacacuaucacuaucaccaggagaaacagcaucacuaucaugcacagcagcacuauacggacacaugacaugguaccaaaaaaaaccaggacaaccaccaaaacuacuacuauacgcaucaucaaaaagagcaucaggaauaccagacagauucucaggaucacaauucggaaaacaauacacacuaauaauaacaaaaauggaaccagaagacuucgcagaauacuacugccaacaauucgaaguauucggacaaggaacaagacuagacaugagaagaaca

SEQ ID NO: 48657 - RNA, 306 nt, Artificial Sequence
  derived and/or modified sequence opt6 from anti-HIV-1_LightChain
gaaguaguacuaacacaaucaccaggaacauuaagcuuaagcccaggagaaagagcaacauuaagcuguagaggaagccauggacaucuaucaugguaucaauauaaaccaggacaaccaccaagaguacuaauauacggaacaucaagaagagcaucaggaauaccagauagauuuagcggaagcggaagcggaacagauggaucacuaacaauaucaagauuagaagcagaagauuucgcaguauauuacugucaacaauacgaauucuuuggacaaggaacaagauuagaaaugaaaagaaca

SEQ ID NO: 48658 - RNA, 309 nt, Artificial Sequence
  derived and/or modified sequence opt6 from anti-HIV-1_LightChain
gaaguaguacuaacacaaucaccaggaacacuaucacuaucaccaggagaaagagcaucacuaucaugcaaaucaucacaauacggacacacagcaugguaccaacaaaaacuaggacaaggaccaagacuacuaauauacgcaacaucaagaagagcaacaggaauaccagacagauucucaggaucacaaucaggaacagaauacaacuuaacaauaacaagacuagacccaggagacuucgcacaauacuucugccaacaauacgaauucuucggaccaggaacaagacuagacauaaaaagaaca

SEQ ID NO: 48659 - RNA, 306 nt, Artificial Sequence
  derived and/or modified sequence opt6 from anti-HIV-1_LightChain
gaaauaaugcuaacacaaucaccaggaacauuaaguuuaagcccaggagaacgagcaacauuaagcuguagaggaagccauggacauguagcaugguaucaacaaaaaccaggaagaauaccaagauuacuaauauacggaacaucaaaaagagcaucaggaauaccagauagauuuagcggaaguggaagcggaacagaugcaacacuaacaauaaguagauuagaaucagaagauuucgcaguauauuacugucaacaauacgaauuuuucggacaaggaacaagacuagacauaaaaagaaca

SEQ ID NO: 48660 - RNA, 309 nt, Artificial Sequence
  derived and/or modified sequence opt6 from anti-HIV-1_LightChain
gaaucaguacuaacacaaagcccaggaacacuaucacuaucaccaggagaaacagcaucacuaucaugcacagcagcaucauacggacacaugacaugguaccaaaaaaaaccaggacaaccaccaaaacuacuaauauucgcaacaucaaaaagagcaucaggaauaccagacagauucucaggaucacaauucggaaaacaauacacacuaacaauaacaagaauggaaccagaagacuucgccggauacuacugccaacaaguagaauucuucggacaaggaacaagacuagaaauaagaagaaca

SEQ ID NO: 48661 - RNA, 309 nt, Artificial Sequence
  derived and/or modified sequence opt6 from anti-HIV-1_LightChain
gacauacaaaugacacaaucaccaucaucacuaucagcaucaguaggagacagaguaacaauaacaugccaagcaucacaagacauaucaaacuaccuaaacugguaccaacaaaaaccaggaaaagcaccaaaacuacuaauauacgacgcaucaaaccuagaaacaggaguaccaucaagauucucaggaucaggauuccacacaacauucucacuaacaauaucaggacuacaaagagacgacuucgcaacauacuucugcgcaguacuagaauucuucggaccaggaacaaaaguagacuucaac

SEQ ID NO: 48662 - RNA, 309 nt, Artificial Sequence
  derived and/or modified sequence opt6 from anti-HIV-1_LightChain
gacauacaaaugacacaaucaccaucaucacuaucagcaucaguaggagacagaguaacaauaacaugccaagcaucacaagacauaacaaacuaccuaaacugguaccaacaaaaaccaggaagagcaccaaaacuacuaguacacggagcaucaaaccuacaaagaggaguaccaucaagauucucaggaucaggauuccacacaacauucacacuaacaauaucaucacuacaaccagacgacguagcaacauacuucugcgaaguauuccaaugguucggaccaggaacaagaguagacuucaac

SEQ ID NO: 48663 - RNA, 309 nt, Artificial Sequence
  derived and/or modified sequence opt6 from anti-HIV-1_LightChain
ggauuccaacuaacacaaucaccaucaucauuaucagcaucaguaggagacagaguaucaauaaacugucaagcaggagaaggaauaggaucaucauuaaacugguaccaacaaaaaccaggaagagcaccaaaacuauuaguacacggagcaucaaaucuacaaagaggaguaccaucaagauucucaggaucaggauuucacacaacauuuacauuaacaauaucaucacuacaaccagaugacguagcaacauacuuuugcgaaguauuucaaugguucggaccaggaacaagaguagacuucaau

SEQ ID NO: 48664 - RNA, 309 nt, Artificial Sequence
  derived and/or modified sequence opt6 from anti-HIV-1_LightChain
ggaauacaacuaacacaaucaccaucaucacuaucaguaucaguaggagacagaguaacaauaacaugcagagcaucacaaggaauaggaaacucacuaaacugguaccaacaaaaaccaggaaaagcaccaaaccuaaugguauucggaacaacaaaacuaaacagaggaguaccaucaagauucucaggaucaggaucaggaacaacagcaacacuaacaauaaacucacuacaaccagaagacauagcaacauacuucugccaaguauucgaauuccuaggaccaggaacaaaacuagacaugaaa

SEQ ID NO: 48665 - RNA, 309 nt, Artificial Sequence
  derived and/or modified sequence opt6 from anti-HIV-1_LightChain
gacauacaaaugacacaaucaccaucaucauuaucagcaucaguaggagacagaguaacaauaacaugucaagcaggacaaggaauaggaucaucauuaaaaugguaccaacaaaaaccaggaagagcaccaagacuauuaguacauggagcaucaaaucuacauagaggaguaccaucaagauucucaggaucaggauuucacacaacauuuucauuaacaauaucaggacuacaaagagaugacuuugcaacauacuuuugcgcaguauuagaauuuuucggaccaggaacaaaaguagauuucaau

SEQ ID NO: 48666 - RNA, 309 nt, Artificial Sequence
  derived and/or modified sequence opt6 from anti-HIV-1_LightChain
ggaauacaacuaacacaaucaccaucaucacuaucagcaucaguaggagacagaguaacaauaacaugucaagcaucacaaggaauaggaucaucacuacaaugguaccaacaaaaaccaggaagagcaccaaaccuacuaguacacggagcaucaaaucuacacagaggaguaccaucaagauucucaggaucaggauuccacacaacauucucacuaacaauaucaggacuacaaagagacgacuucgcaacauacuucugcgcaguacuagaauucuucggaccaggaacaaaaguagaaauaaaa

SEQ ID NO: 48667 - RNA, 309 nt, Artificial Sequence
  derived and/or modified sequence opt6 from anti-HIV-1_LightChain
ggaguacaacuaacacaaucaccaucaagcuuaagcgcaagcguaggagauagaguaagcauaaacugucaagcaggacaaggaauaggaucaagcuuaaacugguaccaacaaaaaagaggaaaagcaccaaaacuauuaguacauggagcaagcacacuacaaagaggaguaccaagcagauucucaggaucaggauuucacacaacauuuacauuaacaauaagcucacuacaaccagaugacguagcaacauacuuuugcgaaguauuucaaugguucggaccaggaacaagaguagauuucaau

SEQ ID NO: 48668 - RNA, 306 nt, Artificial Sequence
  derived and/or modified sequence opt6 from anti-HIV-1_LightChain
uauauacaacuaacacaaucaccaucaagcuuaagcgcaagcauaggagauagaguaacaauagcauguagagcaagccaaggaauaggauauguacauugguaucaacaaaaaagaggaaaaccaccaaaauuacuaauacacggagcaucaauauuagaaagaggaguaccaucaagauuuagcggaagcggaagcggaacacuauucaaucuaacaguaucaggauuacaaccagaagauuucgcaacauauaugugucaaguauucgaaagcuuuggaccaggaacaaaaguacaaaugaaa

SEQ ID NO: 48669 - RNA, 309 nt, Artificial Sequence
  derived and/or modified sequence opt6 from anti-HIV-1_LightChain
ggaauacaacuaacacaaucaccaucaucacuaucagcaucacuaggagacagaguaacaauaacaugccaagcaucacaaggaauaggaucaucacuacaaugguaccaacaaaaaccaggaaaagcaccaaaacuacuaguacacggagcaucaaaacuacacagaggaguaccaucaagauucucaggaucaggauuccacacaacauucucacuaacaauaucaucacuacaaccagaagacuucgcaacauaccuaugccaaguacuagaauucuucggaccaggaacaaaaguagacuucaac

SEQ ID NO: 48670 - RNA, 309 nt, Artificial Sequence
  derived and/or modified sequence opt6 from anti-HIV-1_LightChain
ggaauacaacuaacacaaucaccaucaucacuaucagcaucaguaggagacacaguaacaauaacaugccaagccucacaaggaauaggaucaucccuacaaugguaccaacaaaaaagaggaagagcaccaaaacuacuaguacacggagcaucaaaccuacaaggaggaguaccaucaagauucucaggaucaggauuccacacaacauucacacuagcaauaagaggacuacaaccagacgacuucgcaacauacuucugccaaucauuagaauucuucggaccaggaacaaaaguagacaugaaa

SEQ ID NO: 48671 - RNA, 306 nt, Artificial Sequence
  derived and/or modified sequence opt6 from anti-HIV-1_LightChain
uauauacaacuaacacaaucaccaucaaguuuaagcgcaagcguaggagauagaguaacaauaacauguagagcaagccaagacauaggauauguaucaugguaugcacaaaaaagaggaagagcaccaaaauuacuaauacacggagcaucaggauuagaaagaggaguaccaucaagauuuagcggaagcggaagcggaacauuauucacacuaacaauagaaagcuuacaaccagaagauuucgcaacauauaugugucaaguauucgaaagcuuuggaccaggaacaaaaguagaaaugaaa

SEQ ID NO: 48672 - RNA, 309 nt, Artificial Sequence
  derived and/or modified sequence opt6 from anti-HIV-1_LightChain
ggaauacaacuaacacaaucaccaucaagcuuaagcgcaagcguaggagauagaguaagcauaaacugucaagcaggacaaggaauaggaucaagcuuaaacugguaccaacaaaaaccaggaagagcaccaaaauuauuaguacauggagcaagcaaucuacaaagaggaguaccaagcagauucucaggaucaggauuucacacaacauuuacauuaacaauaagcucacuacaaccagaugacguagcaacauacuuuugcgcaguauuucaaugguucggaccaggaacaagaguagauuucaau

SEQ ID NO: 48673 - RNA, 366 nt, Artificial Sequence
  derived and/or modified sequence opt6 from anti-HIV-1_HeavyChain
ucacaacaauuaguacaaaguggaacacaaguaaaaaaaccaggagcaaguguaagaauaaguugucaagcaaguggauauacauuuacagauuauguauuacauugguggagacaagcaccaggacaaggauuagaauggaugggauggauaaaaccaguauauggagcaagaaauuaugcaagaagauuucaaggaagaauagauuuuaguagagauauauauagagaaauagcauauauggauuuaaguggauuaagaagugaugauacagcauuauauuuuugugcaagagauggaaguggagaugauacaaguuggcauuuagauccauggggacaaggaacauuaguaauaguaucagca

SEQ ID NO: 48674 - RNA, 366 nt, Artificial Sequence
  derived and/or modified sequence opt6 from anti-HIV-1_HeavyChain
agccaacaauuaguacaaaguggaacacaaguaaaaaaaccaggagcaaguguaagaauaaguugucaagcaaguggauauacauuuacagauuauuuauuacauugguggagacaagcaccaggacaaagauuagaauggaugggauggauaaaaccaguauauggagcaagaaauuaugcacauagauuucaaggaagaauaaauuuugauagagauauauauagggaaauagcauuuauggauuuaaguggacuaagaagugaugauacagcaguauauuuuugugcaagagauggaggaggagaugauagaacauggcuauuagauacauggggacaaggaacauuaguaguaguaaguagu

SEQ ID NO: 48675 - RNA, 366 nt, Artificial Sequence
  derived and/or modified sequence opt6 from anti-HIV-1_HeavyChain
caaguacauuuagaacaaccaggaaguguaguaagauggccaggagcaaguuuaacacuaaguuguacagcaagcggauauauauuuguaaauuaucauauacauugguuaagacaagcaccaggacaaagauuagaauuauuaggaacaauaaauccaguaggaggagcaacaaguuaugcacaaaaauuuagaggaagauuaguauuaacaagagauauaggaucaaguacaguaacauuauuacuaaaucauuuaagaagagacgauagugcaguauauuuuugugcaagagaaucaaaugcaagcggaagaggaagaucaauggaucauuggggaagaggaucaagaguaauaguaagucaa

SEQ ID NO: 48676 - RNA, 366 nt, Artificial Sequence
  derived and/or modified sequence opt6 from anti-HIV-1_HeavyChain
caaguacaauuaguacaaaguggagcagaaguaaaaaaaccaggagcaaguguaagaguaagcugucaagcaaguggauauacauuuacaaauuauauauuacauugguggagacaagcaccaggacaaggauuagaauggaugggauuaauaaaaccaguauauggagcaguaaauuaugcaagacaauuucaaggaagaauacaauuaacaagagauauauauagagaaauagcauuuuuagauuuaucaggauuaagaucagaugauacagcaguauauuauugugcaagagaugaaaguggagaugauuuaaaauggcauuuacauccauggggacaaggaacacaaguaauaguaagucca

SEQ ID NO: 48677 - RNA, 366 nt, Artificial Sequence
  derived and/or modified sequence opt6 from anti-HIV-1_HeavyChain
caaguacaauuaguacaaaguggagcagaaguaaaaaaaccaggagcaagcguaagaauaaguugucaagcaaguggauauacauuuacagauuauguauuacauugguggagacaagcaccaggacaaggauuagaauggaugggauggauaaaaccaguauauggagcaagaaauuaugcaagaagauuucaaggaagaauaaauuuugauagagauauauauagagaaauagcauauauggauuuaaguggauuaagaagugaugauacagcaagauauuuuugugcaagagauggaaguggagaugauacaaguuggcauuuacauccauggggacaaggaacauuaguaauaguaagugca

SEQ ID NO: 48678 - RNA, 366 nt, Artificial Sequence
  derived and/or modified sequence opt6 from anti-HIV-1_HeavyChain
agucaacaacuaguacaaaguggaacacaaguaaaaaaaccaggagcaaguguaagaguaagcugucaagcaagcggauauacauuuacaaauuauauauuacauugguggagacaagcaccaggacaaggauuagaauggaugggauuaauaaaaccaguauauggagcuguaaauuaugcaagacaauuucaaggaagaauacaauuaacaagagauauauauagagaaauagcauuuuuagauuuaaguggauuaagaacagaugauacagcaguauauuauugugcaagagaugaaaguggagaugauuuaaaauggcauuuacauccauggggacaaggaacacaaguaauaguaagccca

SEQ ID NO: 48679 - RNA, 366 nt, Artificial Sequence
  derived and/or modified sequence opt6 from anti-HIV-1_HeavyChain
caaguacauuuagaacaaaguggaaguguaguaagauggccaggagcaaguuuaacacuaaguuguacagcaagcggauauauauuuguaaauuaucauauacauugguuaagacaagcaccaggacaaagauuagaauuaaugggaacaauaaauccaguaggaggagcaacaaguuauacacaaagauuuagaggaagauuaguauuaacaagagauauaggaucaaauacaguaacauuauuauuaaaucauuuaagaucagaugauagugcaguauauuuuugugcaagagaaucaaaugcaaguggaagaggacgaucaauggaucauuggggaagaggaucacauguaauaguaagucca

SEQ ID NO: 48680 - RNA, 366 nt, Artificial Sequence
  derived and/or modified sequence opt6 from anti-HIV-1_HeavyChain
ucacaacaucuaguacaaucaggaacacaaguaaaaaaaccaggagcaucaguaagaguaucaugccaagcaucaggauauacauuuacaaauuacauauuacauugguggagacaagcaccaggccaaggauuagaauggaugggacuaauaaaaccaguauauggagcaguaaauuacgcaagacaauuccaaggaagaauacaauuaacaagagauauauauagagauauagcauucuuagacuuaucaggacuaagaagcgaugacacagcaguauacuauugcgcaagagaugaaucaggagaugacuuaaaauggcacuuacacccauggggacaaggaacacaaguaauaguaucacca

SEQ ID NO: 48681 - RNA, 366 nt, Artificial Sequence
  derived and/or modified sequence opt6 from anti-HIV-1_HeavyChain
agucaacaauuaguacaaaguggaacacaaguaaaaaaaccaggagcaaguguaagaauaaguugucaagcaaguggauauacauuuacagauuauguauuacauugguggagacaagcaccaggacaaggauuagaauggaugggauggauaaaaccaguauauggagcaagaaauuaugcaagaagauuucaaggaagaauaaauuuugauagagauauauauagagaaauagcauauauggauuuaaguggauuaagaagugaugauacagcaagauauuuuugugcaagagauggaaguggagaugauacaaguuggcauuuacauccauggggacaaggaacauuaguaauaguaagugca

SEQ ID NO: 48682 - RNA, 366 nt, Artificial Sequence
  derived and/or modified sequence opt6 from anti-HIV-1_HeavyChain
caaguacauuuagaacaaccaggaucaguaguaagauggccaggagcaucauuaacacuaaguugcacagcaucaggauauauauuuguaaauuaccauauacauugguuaagacaagcaccaggacaaagauuagaauuacuaggaacaauaaacccaguaggaggagcaacaucauacgcacaaaaauucagaggaagauuaguacuaacaagagauauaggaucaucaacaguaacacuacuauuaaaccauuuaagaagagaugacucagcaguauacuuuugcgcaagagaaucaaaugcaucaggaagaggaagaucaauggaccauuggggaagaggaaaaccaguaauaguaucacca

SEQ ID NO: 48683 - RNA, 321 nt, Artificial Sequence
  derived and/or modified sequence opt6 from anti-HIV-1_HeavyChain
gaaauaguaaugacacaaucaccagcaauauuaagcguaagcccaggagauagagcaacauuuagcuguagagcaagccaaagcguaaaaaauaaccuagcaugguaccaaaaaagaccaggacaagcaccaagacuauuaauauuugacgcaagcucaagagcaagcggaauaccagcaagauucucaggaggaggaucaggaacagaauuuacauuaacaguaaacucaaugcaaagcgaagacuuugcaacauacuauugccaacaauaugaagaauggccaagaacauucggacaaggaacaaaaguagaaauaaug

SEQ ID NO: 48684 - RNA, 321 nt, Artificial Sequence
  derived and/or modified sequence opt6 from anti-HIV-1_HeavyChain
caaauaguacuaacacaaucaccaccaacacuaucacuaucaccaggagaaagagcaacacuaucaugcagagcaucacaaucaguaaaaaacaaccuagcaugguaccaaaaaagaccaggacaagcaccaagauuacuaauauucgacacaucaucaagagcaucaaacauaccagcaagauucucaggaggaggaucaggaacagaauucacacuaacaguaaacucaaugcaaucagaagacuucgcaacauacuacugccaacaauacgaagaauggccaagaacauucggacaaggaacaaaaguagaaauaaua

SEQ ID NO: 48685 - RNA, 321 nt, Artificial Sequence
  derived and/or modified sequence opt6 from anti-HIV-1_HeavyChain
gaaauaguaaugacacaaucaccagcaguacuaucaguaucaccaggcgacagagcaacacuaucaugcagagcaucacaaagcguaaaaaacaaccuagcaugguaccaaaaaagaccaggacaagcaccaagacuacuaauauucgacacaucaucaagagcaucaaacauaccagcaagauucucaggaggaggaagcggaacagaauucacacuaacaguaaacucaaugcaaucagaagacuucgcaacauacuacugccaacaauacgaagaauggccaagaacauucggacaaggaacaaaaguagaaauaaac

SEQ ID NO: 48686 - RNA, 321 nt, Artificial Sequence
  derived and/or modified sequence opt6 from anti-HIV-1_HeavyChain
gaaauaguacuaacacaaucaccaccaacauuaagcguaagcccaggagaagcagcaacauuaagcuguagagcaagccaaagcguaaaaaauaacuuagcaugguaccaucuaaaagcaggacaagcaccaagacuauuaauauuugacgcaagcucaagagcaggagaugcaccagcaagaguaucaggaucaggauauggaacagaauuuacauuaacaguaaacucaguacaaagcgaagacuuuggagauuacuauugccaacaauaugaagaauggccaagaacauucggacaaggaacaaaaguagaucuaaga

SEQ ID NO: 48687 - RNA, 321 nt, Artificial Sequence
  derived and/or modified sequence opt6 from anti-HIV-1_HeavyChain
gaaauaguaaugacacaaucaccaccaacauuaagcguaagcccaggagaaacagcaacauuaagcuguagagcaagccaaaacguaaaaaauaacuuagcaugguaccaacuaaaaccaggacaagcaccaagacuauuaauauuugacgcaagcucaagagcaggaggaauaccagacagauucucaggaucaggauauggaacagacuuuacauuaacaguaaacucaguacaaagcgaagacuuuggagauuacuuuugccaacaauaugaagaauggccaagaacauucggacaaggaacaaaaguagaucuaaga

SEQ ID NO: 48688 - RNA, 321 nt, Artificial Sequence
  derived and/or modified sequence opt6 from anti-HIV-1_HeavyChain
gaaauaguaaugacacaaucaccagcaguacuaucaguaucaccaggagacagagcaacacuaucaugccgagcaucacaaucaguaaaaaacaaccuagcaugguaccaaaaaagaccaggacaagcaccaagacuacuaauauucgacacaucaucaagagcaucaaacauaccagcaagauucucaggaggaggaucaggaacagaauucacacuaacaguaaacucaaugcaaucagaagacuucgcaacauacuacugccaacaauacgaagaauggccaagaacauucggacaaggaacaaaaguagaaauaaua

SEQ ID NO: 48689 - RNA, 399 nt, Artificial Sequence
  derived and/or modified sequence opt6 from anti-HIV-1_HeavyChain
gaaguacauuuacaagaaaguggaccaggauuaguaagaccauuagaaacauuaagucuaacauguacagcaaguggagcaaguauaagaggaggagaauggggagauaaugauuaucauuggggauggguaagacauagcccagaaaaaggauuagaauggauaggaaguauacauuggagaggaacaacacauuauaaugcaccauuuagaggaagagcaacauuaaguauagauacaagcagaaaucaauuuuuuuuaagauuaacaaguaugacagcagaugauacagcaguauauuauuguguaaaacauaaauaucaugauauaguaaugguaguaccaauagcaggaugguuugauccauggggacaaggacuacaaguaacaguaagugca

SEQ ID NO: 48690 - RNA, 399 nt, Artificial Sequence
  derived and/or modified sequence opt6 from anti-HIV-1_HeavyChain
gaaguacauuuacaagaaaguggaccaggauuaguaagaccauuagaaacauuaaguuuaacauguacagcaaguggagcaaguauaagaggaggagaauggggagauaaugauuaucauuggggauggguaagacauaguccagaaaaaggauuagaauggauaggaaguauacauuggagaggaacaacacauuauaaugcaccauuuagaggaagagcaacauuaaguauagauacaaguagaaaucaauuuuuuuuaagauuaacaaguaugacagcagaugauacagcaguauauuauuguguuaaacauaaauaucaugauauaguaaugguaguaccaauagcaggaugguuuaauccauggggacaaggauuacaagcaacaguaccaagu

SEQ ID NO: 48691 - RNA, 399 nt, Artificial Sequence
  derived and/or modified sequence opt6 from anti-HIV-1_HeavyChain
caaguacaacuaaaagaaucaggaccaggauuaguaaaaccaucagaaacauuaucacuaacaugcacaguaucaggaggaagcaugagaggaacagauuggggagaaaaugacuuucauuauggauggauaagacacucaagcgcagaaggacuagaauggauaggaucaauacauuggagaggaacaacacauuacaaaaugucauucagaaguagagcaacaauaucaauagauacaucaaacaauagauuuagccuaauguuuagcuuuguaacagcagaagacacagcaguauacuauugcgcaagacauaaauaucaugauauauuuagaguaguaccaguagcaggaugguucgauccauggggacaaggacuauuaguaacaguaaguuca

SEQ ID NO: 48692 - RNA, 399 nt, Artificial Sequence
  derived and/or modified sequence opt6 from anti-HIV-1_HeavyChain
gaaguacauuuacaagaaaguggaccaggauuaguaagaccauuagaaacauuaucacuaacauguacagcaaguggagcaaguauaagaggaggagaauggggagauaaugauuaucauuggggauggguaagacauagcccagaaaaaggauuagaauggauaggaaguauacauuggagaggaacaacacauuauaaugcaccauuuagaggaagagcaacacuaaguauagauacaaguaaaaaucaauuuaguuuaagauuaacaaguaugacagcagaugauacagcaguauauuauuguguaaaacauaaauaucaugauauaguaaugguaguaccauuugcaggaugguuugauccauggggacaaggauuaagagugacaguaagugca

SEQ ID NO: 48693 - RNA, 399 nt, Artificial Sequence
  derived and/or modified sequence opt6 from anti-HIV-1_HeavyChain
gaaguacauuuacaagaaaguggaccaggauuaguaagaccauuagaaacauuaaguuuaacauguacagcaaguggagcaucaauaagaggaggagaauggggagauaaugauuaucauuggggauggguaagacauaguccagaaaaaggauuagaauggauaggaaguauacauuggagaggaacaacacauuauaaugcaccauuuagaggaagagcaacacuaaguauagauacaaguaaaaaucaauuuuuuuuaagauuaacaucaaugacagcagaugauacagcaguauauuauuguguaaaacauaaauaucaugauauauguaugguaguaccaauagcaggaugguuugauccauggggacaaggacuacaaguaacaguaucacaa

SEQ ID NO: 48694 - RNA, 399 nt, Artificial Sequence
  derived and/or modified sequence opt6 from anti-HIV-1_HeavyChain
caaguacauuuacaagaaaguggaccaggauuaguaagaccauuagaaacauuaaguuuaacauguacagcaaguggagcaaguauuagaggaggagaauggggagauaaugauuaucauuggggauggguaagacauaguccagaaaaaggauuagaauggauaggaaguauacauuggagaggaacaacacauuauaaugcaccauuuagaggaagagcaacauuaaguauagauacaaguagaaaucaauuuuuuuuaagauuaacaagcaugacagcagaugauacagcaguauauuauuguguaaaacauaaauaucaugauauaguaaugguaguaccaauagcaggaugguuugauccauggggacaaggauuacaaguaacaguaucaagu

SEQ ID NO: 48695 - RNA, 399 nt, Artificial Sequence
  derived and/or modified sequence opt6 from anti-HIV-1_HeavyChain
caaguacauuuacaagaaaguggaccaggguuaguaagaccauuagaaacauuaaguuuaacauguacagcaagcggagcaucaauaagaggaggagaauggggagauaaugauuaucauuggggauggguaagacauaguccagaaaaaggauuagaauggauaggaaguauacauuggagaggaacaacacauuauaaugcaccauuuagaggaagagcaacauuaaguauagauacaaguagaaaucaauuuuuuuuaagauuaacaaguaugacagcagaugauacagcaguauauuauuguguaaaacauaaauaucaugauauaguaaugguaguaccaauagcaggaugguuugauccauggggacaaggauuaagaguaacaguaagucaa

SEQ ID NO: 48696 - RNA, 399 nt, Artificial Sequence
  derived and/or modified sequence opt6 from anti-HIV-1_HeavyChain
caaguacauuuacaagaaaguggaccaggacuaguaagaccauuagaaacauuaaguuuaacauguacagcaaguggagcaucaauaagaggaggagaauggggagauaaugauuaucauuggggauggguaagacauaguccaggaaaaggauuagaauggauaggaaguauacauuggagaggaacaacacauuauaaugcaccauuuagaggaagagcaacauuaaguauagauacauuuagaaaucaauuuuuuuuaagauuaacaaguaugacugcagaugauacagcaguauauuauuguguaaaacauaaauaucaugauauaguaaugguaguaccaauagcaggaugguuugauccauggggacaaggauuacaaguaacaguaucacaa

SEQ ID NO: 48697 - RNA, 399 nt, Artificial Sequence
  derived and/or modified sequence opt6 from anti-HIV-1_HeavyChain
gaaguacauuuacaagaaaguggaccaggauuaguaagaccauuagaaacauuaagcuuaacauguacagcaaguggagcaaguauaagaggaggagaauggggagauaaugauuaucauuggggauggguaagacauaguccagaaaaaggauuagaauggauaggaaguauacauuggagaggaacaacacauuauaaugcaccauuuagaggaagagcaacauuaaguauagauacaaguagaaaucaauuuuuucuaagauuaacaaguaugacagcagaugauacagcaguauauuauuguguaaaacauaaauaucaugauauaguaaugguaguaccaauagcaggaugguuugauccauggggacaaggauuaagaggaacaguaagugca

SEQ ID NO: 48698 - RNA, 393 nt, Artificial Sequence
  derived and/or modified sequence opt6 from anti-HIV-1_HeavyChain
caaguacaauuaguucaaaguggagcaguaauaaaaacaccaggaaguaguguaaaaauaaguuguagagcaaguggauauaauuuuagagauuauaguauacauuggguaagauuaauaccagauaaaggauuugaauggauaggauggauaaaaccauuauggggagcaguaaguuaugcaagacaauuacaaggaagaguaaguaugacaagacaauuaaguagagauccagaugauccagauuggggaguagcauauauggaauuuagcggauuaacaccagcagauacagcagaauauuuuuguguaagaagaggaaguugugauuauuguggagauuuuccauggcaauauuggggacaaggaacaguaguaguaguaaguagugca

SEQ ID NO: 48699 - RNA, 393 nt, Artificial Sequence
  derived and/or modified sequence opt6 from anti-HIV-1_HeavyChain
caaguacaauuaguacaaaguggagcaguaauaaaaacaccaggaucaaguguaaaacuaaguuguagagcaaguggauauaauuuuagagauuauaguauacauuggguaagauuaauaccagauaaaggauuugaauggauaggauggauaaaaccuuuauggggagcaguaagcuaugcaagacaauuacaaggaagaguaaguaugacaagacaauuaagucaagauccagaugauccagauuggggaguagcauauauggaauuuaguggauuaacaccagcagauacagcagaauauuuuuguguaagaagaggaucaugugauuauuguggagauuuuccauggcaauauuggggacaaggaacaguaguaguaguaaguucagca

SEQ ID NO: 48700 - RNA, 303 nt, Artificial Sequence
  derived and/or modified sequence opt6 from anti-HIV-1_LightChain
acagcaggacuaacacaaucaccaggaacacuaucacuaucaccaggagaaagagcaauacuaucaugcagaacaucacaauacggaucacuagcaugguaccaacaaagaccaggacaagcaccaagauuaguaauauacgcaggacuaacaagagcaacaggaauaccagacagauucucaggaucaagauggggagcagaauacaaccuaacaauaucaaaccuagaaucagaagacuucggaguauacuacugccaacaauacgacuucuucggacaaggaacaaaaguacaaguagac

SEQ ID NO: 48701 - RNA, 378 nt, Artificial Sequence
  derived and/or modified sequence opt6 from anti-HIV-1_HeavyChain
caaguacaauuaguacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagggauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugca

SEQ ID NO: 48702 - RNA, 384 nt, Artificial Sequence
  derived and/or modified sequence opt6 from anti-HIV-1_HeavyChain
caaguacaauuaguacaaaguggaaguggaguaaaaaaauuaggagcaaguguaagaguaagcuguuggacaagugaagauauauuugaaagaacagaauuaauacauuggguaagacaagcaccaggacaaggauuagaauggauaggauggguaaaagcaguaacaggaacaguaaauuuuggaaguuuaaauuuuagacaaagaguaaguuuaacaagagauagagauuuauuuacagcacauauggauauaagaggauuaacacaaggagauacagcaacauauuucugugcaagacaaaaauuugaaaaauauacaggaggacaaggaugguauuuugauuuauggggaagaggaacauuaauaguaguaaguagugca

SEQ ID NO: 48703 - RNA, 378 nt, Artificial Sequence
  derived and/or modified sequence opt6 from anti-HIV-1_HeavyChain
caaguacaauuaguacaaaguggaagugcaaugaaaaaaccaggagcaaguguaagaguaagcuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaagcagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagugca

SEQ ID NO: 48704 - RNA, 387 nt, Artificial Sequence
  derived and/or modified sequence opt6 from anti-HIV-1_HeavyChain
caaguacaauuaguacaaaguggagcagaaguaaaaaaaccaggagcaaguguaagaguaaguuguuggacaagugaagauauauuugauacaacagaauuaauauauuggguaagacaagcaccaggacaaggacuagaauggauaggauggguaaaaauaguaaguggaacaguaaauuuugcaaguuuagauuuuagaaauagaauaaguuuaaguagagauagagauuuaaguacagcacauauggauauaagaggauuaacacaagaugauacagcaacauauuuuugugcaagacaaaaauuugaaucaagauauacaggaggacaaggaugguauuuugauuuauggggaagaggaacacauauaguaguaaguagugca

SEQ ID NO: 48705 - RNA, 387 nt, Artificial Sequence
  derived and/or modified sequence opt6 from anti-HIV-1_HeavyChain
caaguacaauuaguacaaaguggaagugcaaugaaaaaaccaggagcaaguguaagaguaaguuguuggacaagugaagauauauuugaaagaacagaacuaauauauuggguaagacaagcaccaggaagaggauuagaauggauaggauggguaaaaacaguaaguggaacaguaaauuuuggaaguagugauuuuagaaauagaauaaguuuaacaagagauagagauuuaaguacagcacauauggauauaagaggauuaacacaagaugauacagcaacauauuuuugugcaagacaaaaauuugaaaguuuauauagugaugaucaaggaaguuauuuugauuuauggggaagaggaacauuaauaauaguaaguagugca

SEQ ID NO: 48706 - RNA, 387 nt, Artificial Sequence
  derived and/or modified sequence opt6 from anti-HIV-1_HeavyChain
caaguacaauuaguacaaaguggacuagaaguaaaaaaaccaggagcaaguguaagaguaaguuguuggacaagugaagauauauuugauacaacagaauuaauauauuggguaaggcaagcaccaggacaaggauuagaauggauaggauggguaaaaauaguaaguggaacaguaaauuuugcaaguuuagauuuuagaaauagaauaaguuuaaguagagauagagauuuaaguacagcacauauggauauaagaggauuaacacaagaugauacagcaacauauuuuugugcaagacaaaaauuugcaaguagauauaguggagaucaaggaaguuauuuugauuuauggggaagaggaacauuaauaauaguaaguagugca

SEQ ID NO: 48707 - RNA, 387 nt, Artificial Sequence
  derived and/or modified sequence opt6 from anti-HIV-1_HeavyChain
caaguacaauuaguacaaagugcaaguggaguaagaagaccaggagcaaguguaagaguaaguuguuggacaagugaagauauauuugaaagaagugaauuaauauauuggguaagacaagcaccaggaagaggauuagaauggauaggauggauaaaauuaguaaguggagcaguaaauuuuggaaguguagauuuuagagauagaguaaguuuaacaagagauagagaucuauuuacagcacauauggauauaagaggauuaacacaagaugauacagcaacauauuuuugugcaagacaaaaauuugcaagccgauauaguggagaucaaggaaguuauuuugauuuauggggaagaggaacauuaauaauaguaaguagugca

SEQ ID NO: 48708 - RNA, 375 nt, Artificial Sequence
  derived and/or modified sequence opt6 from anti-HIV-1_HeavyChain
caaguacaauuaguacaaaguggaaguggaguaaaaaaaccaggagcaaguguaagaguaaguuguuggacaagugaaggaauauuugaaaaaagugaauuaauacauuggguaagacaagcaccaggacaaggauuagaauggauaggauggguaaaaacaguaacaggagcaguaaauuuuggacaucaaauaucagauagaguaucauuaacaagagauagagauuuauuuacagcacauauggauauaagaggauuaacacaaggggauacagcaacauauuuuugugcaagacaaaaauuugaaagaggaggacaaggauggauauuugauuuauggggaagaggaacauuaauagcaguaaguagugca

SEQ ID NO: 48709 - RNA, 378 nt, Artificial Sequence
  derived and/or modified sequence opt6 from anti-HIV-1_HeavyChain
caaguacaauuaguacaaaguggagcagaaguaaaaaaaccaggagcaaguguaagaguaagcuguuggacaagcgaagauauauuugaaaaaucagaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagugca

SEQ ID NO: 48710 - RNA, 378 nt, Artificial Sequence
  derived and/or modified sequence opt6 from anti-HIV-1_HeavyChain
caaguacaauuaguacaaaguggagcagaaguaaaaagaccaggagcaaguguaaaaguaaguuguuggacaagugaagauauauuugaaagaacagaacuaauacauuggguaagacaagcaccaggacaaggauuagaauggauaggauggguaaaaacaguaaguggagcaguaaauuuuggaaguccaaauuuuagacauagaguaaguuuaacaagggauagagauuuauuuacagcacauauggauauaagaggauuaacacaaggagauacagcaacauauuuuugugcaaggcaaaaauuugaaagaggaggacaaggaugguauuuugauuuauggggaagaggaacauuaauaguaguaaguagugca

SEQ ID NO: 48711 - RNA, 378 nt, Artificial Sequence
  derived and/or modified sequence opt6 from anti-HIV-1_HeavyChain
caaguacaauuagugcaaaguggaaguggaguaaaaaaaccaggagcaaguguaagaguaaguuguuggacaagugaagauauauuugaaggaagugaauuaauacauuggguaagacaagcaccaggacaaggauuagaauggauaggauggguaaaaacaguaacaggagcaguaaauuuuggaagugcauauuuuagacauagaguaaguuuaacaagagauagagauuuauuuacagcacauauggauauaagaggauuaacacaaggagauacagcaacauauuuuugugcaagacaaaaauuuaugaguggaggacaaggaugguauuuugaucuauggggaagaggaacaguaauaguaguaaguagugca

SEQ ID NO: 48712 - RNA, 387 nt, Artificial Sequence
  derived and/or modified sequence opt6 from anti-HIV-1_HeavyChain
caaguacaauuaguaccaaguggaaguggaguaaaaaaaccaggagcaaguguaagaguaagcuguuggacaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguucagca

SEQ ID NO: 48713 - RNA, 378 nt, Artificial Sequence
  derived and/or modified sequence opt6 from anti-HIV-1_HeavyChain
caaguacaauuaguacaaaguggaaguggaguaaaaaaaguaggagcaaguguaagaguaaguuguuggacaagugaagauauauuugaaagaacagaacuaauacauuggguaagacaagcaccaggacaaggacuagaauggauaggauggguaaaagcaguaaguggagcaguaaauuauggaaguuuagauuuuagacauagaguaucauuaacaagagauagagaucuauuuacagcacauauggauauaagaggauuaacacaagaugauacagcaauauauuuuugugcaagacaaaaauuuuaugcaggaggacaaggaugguauuuugauuuauggggaagaggaacauuaauaguaguaaguagugca

SEQ ID NO: 48714 - RNA, 387 nt, Artificial Sequence
  derived and/or modified sequence opt6 from anti-HIV-1_HeavyChain
caaguacaauuaguacaaaguggagcagaaguaaaaaaaccaggaaguaguguaagaguaaguuguuggacaagcgaagauauauuugaaagaacagaauuaauacauuggguaagacaagcaccaggacaaggauuagaauggauaggauggguaaaaacaguaacaggagcaguaaauuuuggaaguccaaauuuuagacauaggguaaguuuaacaagagacagagauuuauuuacagcacauauggauauaagaggauuaacacaaggagauacagcaacauauuuuugugcaagacaaaaauuugaaaguagauauaguggagaucaaggaagcuauuuugauuuauggggaagaggaacauuaauaauaguaaguagugca

SEQ ID NO: 48715 - RNA, 375 nt, Artificial Sequence
  derived and/or modified sequence opt6 from anti-HIV-1_HeavyChain
caaguacaauuaguacaaaguggagcagaaguaaaaaaaccaggagcaaguguaaaaguaaguuguaaagcaagcggauauacauuuacaaguuauuauaugcauuggguaagacaagcaccaggacaaggacuagaauggauaggauggguaaaaccaguaacaggagcaguaaauuuuggaucaccaaauuuuagacauagaguaucacuaacaagagauagagauuuauuuacagcacauauggauauaagaggacuaacacaaggagauacagcaacauauuuuugugcaagacaaaaauauuaugcaggaggacaaggaugguauuuugauuuauggggaagaggaacauuaauaguaguaaguucagca

SEQ ID NO: 48716 - RNA, 375 nt, Artificial Sequence
  derived and/or modified sequence opt6 from anti-HIV-1_HeavyChain
caaguacaauuaguacaaaguggagcagaaguaaaaaaaccaggagcaaguguacaaguaaguuguaaagcaaguggauauccauuuacaaaauauuauaugcauuggguaagacaagcaccaggacaaggauuagaauggauaggauggguaaaagcaguaaguggagcaguaaauuauggaucauuagauuuuagacauagaguaucauuaacaagagauagagauuuaucaacagcacauauggauauaagaggauuaacacaagaugacacagcaacauauuuuugugcaagacaaaaauuugcaagaggagaucaaggaugguuuuuugauuuauggggaagaggaacauuaauaguaguaaguucagca

SEQ ID NO: 48717 - RNA, 375 nt, Artificial Sequence
  derived and/or modified sequence opt6 from anti-HIV-1_HeavyChain
caaguacaauuaguacaaaguggagcagaaguaaaaaaaccaggagcaaguguaaaaguaaguuguaaagcaaguggauauacauuuacaggauauuauaugcauuggguaagacaagcaccaggacaaggacuagaauggauaggauggguaaaaacaguaagcggagcaguaaauuuuggaucauuaaauuuuagacauagaguaucauuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguucagca

SEQ ID NO: 48718 - RNA, 402 nt, Artificial Sequence
  derived and/or modified sequence opt6 from anti-HIV-1_HeavyChain
caaguacaauuaguacaaucaggaucaggaguaaaaaaaccaggagcaucaguaagaguaucaugcagagcaucagaagaucuauuuggagaugaaauaauauaugacgaugaaguaauacauugguuaagacaaguaccaggacaaagaccagaauggaugggauggauaagaccaaaaacaggagcaagaaaucaagcaagacaauuccaaccaagaauaucacuaacaagagauagagcacuaucaacagcguacuuagacuuaaacucauuaacaagcgcagacucaggaacauacuuuugcgcaagacaaacauuuaaaccagacuuuuacuuugcagaucaaggauggucauucaaucuauggggaagaggagcacacuuuauaguaagcucagca

SEQ ID NO: 48719 - RNA, 381 nt, Artificial Sequence
  derived and/or modified sequence opt6 from anti-HIV-1_HeavyChain
caaguacaauuaguacaaaguggaggaggaguaaaaaaaccaggagcaagugcaaguuuuaguuguagaacaagugaagauccauuugauaaugaauuuuuugauucagaauuuaugcauuggguaagauuaacaccaggacaaagaccagaauggaugggauggaugaauccaagaucaggaggaguaaauuaugcaggacaauuuagaccaagaaugucaauguggagagauagagaauuaucaacagcauauauggaauuaagagauuuaacauuugcagauacaggauuauauuuuugugcaagaagaaaagaagaugauuaugauugguauuaugauuuauggggaagaggagcacauauaauaguaagugcagca

SEQ ID NO: 48720 - RNA, 384 nt, Artificial Sequence
  derived and/or modified sequence opt6 from anti-HIV-1_HeavyChain
caaguacaauuaguacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauaggacaagagaauuaggaauagcauauauggaucuaagaaauuuaagauuugaugauacagcaguauauuuuugugcaagaaaaacagcaggagauguaaguggagauaaaagaggauuuuuuuuugauuuauggggaagaggaaguagaguaauaguaaguagcgca

SEQ ID NO: 48721 - RNA, 384 nt, Artificial Sequence
  derived and/or modified sequence opt6 from anti-HIV-1_HeavyChain
caaguacaauuaguacaaaguggagcagaaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaaggaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagugca

SEQ ID NO: 48722 - RNA, 384 nt, Artificial Sequence
  derived and/or modified sequence opt6 from anti-HIV-1_HeavyChain
caaguacaauuaguacaaagcgaagcagaaguaaaaaaaccaggagcaagcaugacaguaagcugugaaacagcagaugaagauauauuugacgcagcauauaugcauuggguaagacaagcaccaggacaaacauuugaauggcuaggauggaugaaaccaguaacaggagcaguaaauuacgcaagaaaauuccaaggaagaauaucauuuuauagaacaagagaauuagcaauagcauacauggacuuaagagaucuaagauucgaugacacagcaguauacuuuugugcgagaaaaacagcaggagauguaaguggagauaacagaggauauuuuuuugacuuauggggaagaggaagcagaguaauaguaucaagugca

SEQ ID NO: 48723 - RNA, 420 nt, Artificial Sequence
  derived and/or modified sequence opt6 from anti-HIV-1_HeavyChain
caaucacacuuagaacaaagcggaagugcaaugaaaaaaccaggagcaucaguaagaguaagcuguuggacaagcgaagacauauucgauacaacagaauugcuauggguaagacaagcaccaggacaaggacuagaauggauaggauggguaaaaauaguaagcggaacaguaaacuuugcaucauuagauuucagaaacagaauaucacuaucaagagauagagaucuaucaacagcacacauggauauaagaggacuaacacaagaugacacagcaacauacuauugcgcaagacaaaaauuugcaucaagauauaguggagaccaaggaucauacuuugacuuauggggaagaggaacauuaauaauaguaucaagcgcaagcacaaaaggaccaucaguauuuccacaugacuua

SEQ ID NO: 48724 - RNA, 417 nt, Artificial Sequence
  derived and/or modified sequence opt6 from anti-HIV-1_HeavyChain
caaagccauuuagaacaaaguggaagcgcaaugaaaaaaccaggagcaaguguaagaguaaguuguuggacaagugaagauauauuugaaagaacagaauuaauauauuggguaagacaagcaccaggaagaggauuagaauggauaggauggguaaaaacaguaaguggaacaguaaauuuuggaaguagugauuuuagaaauagaauaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagugcaaguacaaauggaccaauaggauuaccaccaagaagugca

SEQ ID NO: 48725 - RNA, 423 nt, Artificial Sequence
  derived and/or modified sequence opt6 from anti-HIV-1_HeavyChain
caagcacauuuagaacaaucaggaaguggaguaaaaaaaccaggagcaaguguaagaguaaguuguuggacaagugaagauauauuugaaaaaagugaauuaauacauuggguaaggcaagcaccaggacaaggauuagaauggauaggauggguaaaaacaguaacaggagcaguaaauuuuggaaguagcgauuuuagacaaagaguaucauuaacaagagauagagauuuauuuacagcacauauggauauaagaggauuaacacaaggagauacagcaacauauuuuugugcaagacaaaaauuugaaucauuauauagcgaugaucaaggaaguuauuuugaucuauggggaagaggaacacuaauaauaguaaguagugcaaguacaaaaggaccaaguaguucaccaacaauaugu

SEQ ID NO: 48726 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaaggguaaguugcuggacaagugaagauauauucgaaagaacagaauuaauacauuggguaagacaagcaccaggacaaggauuagaauggauaggauggguaaaaacaguaaguggagcaguaaauuuuggaaguccaaauuuuagacauagaguaagcuuaacaagagauagagauuuauuuacagcacauauggauauaagaggguuaacacaaggagauacagcaacauauuuuugugcaagacaaaaauuugaaagaggaggacaaggaugguauuuugauuuauggggaagaggaacauuaauaguaguaaguagugcaaguacaaaaggaccaaguguauuuccacaugauuuaaga

SEQ ID NO: 48727 - RNA, 411 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauugacacaaggagauacagcaacauauuuuugugcaagacaaaaauuugaaagaggaggacaaggaugguauuuugauuuauggggaagaggaacauuaauaguaguaaguucaaguuuacaucaaggaccaaguggauuaccacaugau

SEQ ID NO: 48728 - RNA, 417 nt, Artificial Sequence
  derived and/or modified sequence opt6 from anti-HIV-1_HeavyChain
caagcacauuuagaacaaaguggaagcggaguaaaaaaaccaggggcaaguguaagaguaaguuguuggacaagugaagauauauuugaaaaaagugaauuaauacauuggguaagacaagcaccaggacaaggacuagaauggauaggauggguaaaaacaguaacaggagcaguaaauuuuggaaguagugauuucagacaaagaguaaguuuaacaagagauagagauuuauuuacagcacauauggauauaagaggauuaacgcaaggagauacagcaacauauuuuugugcaagacaaaaauuuuaugcaggaggacaaggaugguauuuugauuuauggggaagaggaacauuaauaguaguaaguagugcaaguacaaaaggaccaaguguauuuccacaugauuuaaga

SEQ ID NO: 48729 - RNA, 426 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagacagagauuuauuuacagcacauauggauauaagaggauuaacacaaggagauacagcaacauauuauugugcaagacaaaaauuugaaaguuuauauagugaugaucaaggaucauauuuugauuuauggggaagaggaacauuaauaauaguaaguagugcaucaacaaaaggaccaagcguauuuccacaugaucuaaga

SEQ ID NO: 48730 - RNA, 384 nt, Artificial Sequence
  derived and/or modified sequence opt6 from anti-HIV-1_HeavyChain
caaguacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcgacauauuuuugugcaagacaaaaauuugaaaguagauauacaggaggacaaggaugguauuuugauuuauggggaagaggaacacauauaguaguaaguagu

SEQ ID NO: 48731 - RNA, 423 nt, Artificial Sequence
  derived and/or modified sequence opt6 from anti-HIV-1_HeavyChain
caaguauauauggaacaagcaggagcaggaguaaaaaaaccaggagcaaguguaacauuaagcuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaagcuuuuauagaacaagagaacuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagugcaaguacaaaaggaccaaguguauuuccacaugauuuaaga

SEQ ID NO: 48732 - RNA, 414 nt, Artificial Sequence
  derived and/or modified sequence opt6 from anti-HIV-1_HeavyChain
caagcacauuuagaacaaucaggaucaggaguaaaaaaaccaggaacaucaguaagaguaucauguuggacaucagaagauauauuugaaagaacagaauuaauacauuggguaagacaagcaccaggacaaggauuagaauggauaggauggguaaaaacaguaacaggagcaguaaauuuuggaucaccaaauuuuagacauagaguaucauuaacaagagauagagauuuauuuacagcacauauggauauaagaggacuaacacaaggagauacagcaacauauuuuugugcaagacaaaaauuugcaagaggagaucaaggaugguuuuuugauuuauggggaagaggaacauuaauaguaguaaguucagcaucaacaaaaggaccaaguguauuuccaacaauaugu

SEQ ID NO: 48733 - RNA, 411 nt, Artificial Sequence
  derived and/or modified sequence opt6 from anti-HIV-1_HeavyChain
caaguacaauuaguacaaaguggagcagaaguaaaaaaaccaggagcaaguguaaaaguaaguuguaaagcaaguggauauacauuuacaaguuauuauaugcauuggguaagacaagcaccaggacaaggauuagaauggauaggauggguaaaaccagugacaggagcaguaaauuuuggaucaccaaauuuuagacauagaguaucauuaacaagagauagagauuuauuuacagcacauauggauauaagaggauuaacacaaggagauacagcaacauauuuuugugcaagacaaaaauauuaugcaggagggcaaggaugguauuuugaucuauggggaagaggaacacuaauaguaguaaguucagcaucaacaaaaggaccaguaguauuuccaacaauaugu

SEQ ID NO: 48734 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaccagggcaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 48735 - RNA, 384 nt, Artificial Sequence
  derived and/or modified sequence opt6 from anti-HIV-1_HeavyChain
caagcacauuuagaacaaaguggaaguggaguaaaaaaaccaggagcaagcguaagaguaagcuguuggacaagugaagauauauuugaaagaacagaauuaauacauuggguaagacaagcaccaggacaaggauuagaauggauaggauggauaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 48736 - RNA, 420 nt, Artificial Sequence
  derived and/or modified sequence opt6 from anti-HIV-1_HeavyChain
caaagccauuuagaacaaucaggaucagcaaugaaaaaaccaggagcaucaguaagaguaucaugcuggacaucagaagauauauuugaaagaacagaauuaauauacuggguaagacaagcaccaggaagaggacuagaauggauaggauggguaaaaacaguaagcggaacaguaaacuuuggaucaagugauuucagaaacagaauaucacuaacaagagauagagaucuaaguacagcacacauggacauaagaggacuaacacaagaugacacagcaacauauuuuugcgcaagacaaaaauuugaaagaggaggacaaggaugguauuucgaucuauggggaagaggaacacuaauaguaguaaguucagcaucaacagaaggaccaagcagaaguuuuccacaaauauuaaga

SEQ ID NO: 48737 - RNA, 414 nt, Artificial Sequence
  derived and/or modified sequence opt6 from anti-HIV-1_HeavyChain
caagcacauuuagaacaaucaggaucaggaguaaaaaaaccaggagcaucaguaagaguaucauguuggacaucagaagauauauuugaaaaaagugaauuaauacauuggguaagacaagcaccaggacaaggauuagaauggauaggauggguaaaaacaguaacaggagcaguaaauuuuggaucaagugauuuuagacaaagaguaucauuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauauguguaaguucagcaucaccaagagcacauagaucaagcccaagaucagca

SEQ ID NO: 48738 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacagugacaggagcaguaaauuuuggaagucuagauuuuagacauagaauaaguuuaacaagagauagagauuuauuuacagcacauauggauauaagaggauuaacaagaggagauacagcaacauauuauugugcaagacaaaaauuugaaaguagauauacaggaggacaaggaugguauuuugauuuauggggaagaggaacacauauaguaguaaguagu

SEQ ID NO: 48739 - RNA, 384 nt, Artificial Sequence
  derived and/or modified sequence opt6 from anti-HIV-1_HeavyChain
caagcacauuuagaacaaagcgggaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaauaguaaguagu

SEQ ID NO: 48740 - RNA, 423 nt, Artificial Sequence
  derived and/or modified sequence opt6 from anti-HIV-1_HeavyChain
caaagccaucuagaacaaucaggaucagcaaugaaaaaaccaggagcaucaguaagaguaucaugcuggacaucagaagauauauuugacacaacaucaauauuuauaggaugcgauagaccacuagauaaagauuggucaggauuaggaggaagcaaacuaucacuagcaccaucuauauuugcaucacuagauuucagaaacagaauaucacuaucaagagauagagauuuaucaacagcauacauggacauaagaggacuaacacaagaugacacagcaacuuacuucugcgcaagacaaaaauuugcaucaagauauagcggagaccaaggaucauacuuugacuuauggggaagaggaacauuaauaguaguaucaagcgcaagcacaaaaggaccaucaguauuuccacaugacuua

SEQ ID NO: 48741 - RNA, 399 nt, Artificial Sequence
  derived and/or modified sequence opt6 from anti-HIV-1_HeavyChain
agagaauauuuagaacaaagugggggaggaguaaaaaaauuaggagcaaguguaagaguaaguuguagagcaagugaagauuuauuuggagaugaaguaauauaugaugaugaauuaauacauugguuaagacaaguaccaggacaaagaccagaauggaugggauggauaagaccaaaaacaggagcaagaaaucaagcaagacaauuucaaccaagaauaaauuuaaguagagauagagcauuaaauacagcauauuuagauuuaaguaguuuaacaagugcagauagugcaacauauuuuugugcaagacaaacauuuaaaccagauuuuuauuuugcagaucaaggauggaguuuuaauuuauggggaagaggagcaagaguaauaguaaguagu

SEQ ID NO: 48742 - RNA, 384 nt, Artificial Sequence
  derived and/or modified sequence opt6 from anti-HIV-1_HeavyChain
caaguacauuuaguacaaaguggagcagaaguaaaaaaaccaggaaguaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagacagagauuuauuuacagcacauauggauauaagaggauuaacacaaggagauacagcaacauauuuuugugcaagacaaaaauuugaaaguagauauaguggagaucaaggaaguuauuuugaucuauggggaagaggaacauuaauaauaguaagcagu

SEQ ID NO: 48743 - RNA, 414 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggacaagugaagauauauuugaaagaacagaacuaauacauuggguaagacaagcaccaggacaaggauuagaauggauaggauggguaaaaauaguaaguggagcaguaaauuuuggaagcccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcgguaaguagugcaaguacaaaaggaccaaguguauuuccaacaauaugu

SEQ ID NO: 48744 - RNA, 441 nt, Artificial Sequence
  derived and/or modified sequence opt6 from anti-HIV-1_HeavyChain
agagaauuucuagaacaaucaggaggaggaguaaaaaaacuaggagcaucacuaagaguaucaugcagagcaucagaagaucuauuuggagaugaauuuauauaugacgaugaaguaauacauugguuaagacaaguaccaggacaaagaccagaauggaugggauggauaagaccaaaaacaggagcaagaaaucaagcaacacaauuccaaccaagaauaucgcuaacaagagauagagcacuaucaacagcauacuuagacuuaaacucacuaacaagcgcagacucaggaacauacuuuugcgcaagacaaacauuuaaaccagacuuuuacuuugcagaucaaggauggucauucaauuuauggggaagaggagcacacuucauaguaaguucagcaucaacaaaaggaccaagcguauucccacacgauagcgca

SEQ ID NO: 48745 - RNA, 399 nt, Artificial Sequence
  derived and/or modified sequence opt6 from anti-HIV-1_HeavyChain
agagaauaucuagaacaaucaggaggaggaguaaaaaaacuaggagcaucacuaagaguaucaugcagagcaucagaagaucuauuuggagaugaaauaauauaugacgaugaaguaauacauugguuaagacaaguaccaggacaaagaccagaauggaugggauggauaagaccaaaaacaggagcaagaaaucaagcaagacaauuccaaccaagaauaucacuaacaagagauagagcacuaaguacagcauacuuagacuuaaacucauuaacaagugcagacucaggaacauacuuuugcgcaagacaaacauuuaaaccagacuuuuacuuugcagaucaaggauggucauucaaucuauggggaagaggagcacacuuuauaguaagcuca

SEQ ID NO: 48746 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 48747 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 48748 - RNA, 414 nt, Artificial Sequence
  derived and/or modified sequence opt6 from anti-HIV-1_HeavyChain
caagcacauuuagaacaaucaggaacaggaguaaaaaaaccaggggcaucaguaagaguaucauguuggacaucagaagauauauuugaaaaaagugaauuaauacauuggguaagacaagcaccaggacaaggauuagaauggauaggauggguaaaaauaguaaguggagcaguaaauuuuggaucaccaaauuuuagacaaagaguaucauuaacaagagauagagauuuauuuacagcacaaauggauauaagaggauuaacacaaggagauacagcaacauauuuuugugcaagacaaaaauuugaaagaggaggacaaggauggauauuugaucuauggggaagaggaacauuaauagcaguaaguucagcaucaacaaaaggaccaaguguauuuccacaugaucua

SEQ ID NO: 48749 - RNA, 399 nt, Artificial Sequence
  derived and/or modified sequence opt6 from anti-HIV-1_HeavyChain
caagcacauuuagaacaaaguggaaguggaguaaaaaaauuaggggcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcgcauauggauauaagaggauuaacacaagaugauacagcaacauauuuuugugcaagacaaaaauuugcaagaggagaucaaggaugguuuuuugauuuauggggaagaggaacauuaauaguaguaaguagcgcaaguacaaaaggaccaagugga

SEQ ID NO: 48750 - RNA, 414 nt, Artificial Sequence
  derived and/or modified sequence opt6 from anti-HIV-1_HeavyChain
caagcacauuuagaacaaucaggaucaggaguaaaaaaaccaggagcaucaguuagaguaucauguuggacaucagaagauauauuugaaagaacagaauuaauacauuggguaagacaagcaccaggacaaggauuagaauggauaggauggguaaaaacaguaacaggagcaguaaauuuuggaagcccaaauuuuagacauagaguaucauuaacacaugauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauauguguaaguucagcaucaacaaaaggaccaaguggauuaccaccaagaagu

SEQ ID NO: 48751 - RNA, 426 nt, Artificial Sequence
  derived and/or modified sequence opt6 from anti-HIV-1_HeavyChain
caagcacauuuagaacaaagcggaaguggaguaaaaaaauuaggggcaucaguaagaguaaguuguuggacaagugaagauauauuugaacgaacagaauuaauacauuggguaagacaagcaccaggacaaggauuagaauggauaggauggguaaaagcaguaucaggagcaguaaauuauggaagcuuagauuuuagacauagaguaagucuaacaagagauagagauuuaagcacagcacauauggauauaagaggauuaacacaagaugauacagcaacauauuuuugugcaagacaaaaauuugaaaguuuauauagugaugaucaaggaaguuauuuugauuuauggggaagaggaacauuaauaauaguaaguagugcaaguacaaaaggaccaaguguauuuccacaugauuuaaga

SEQ ID NO: 48752 - RNA, 414 nt, Artificial Sequence
  derived and/or modified sequence opt6 from anti-HIV-1_HeavyChain
caagcacauuuagaacaaaguggaagcggaguaaaaaaaccaggagcaagcguaagaguaagcuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaagccuaacaagagauagagauuuauuuacagcacauauggauauaagaggauuaacacaaggagauacagcaacauauuauugugcaagacaaaaauuugaaagaggaggacaaggaugguauuuugauuuauggggaagaggaacauuaauaguaguaaguagugcaagcacaaaaggaccaaguguauuuccaacaauauau

SEQ ID NO: 48753 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuauugugcaagacaaaaauuugaaaguagauauacaggaggacaaggaugguauuuugauuuauggggaagaggaacacauauaguaguaaguagu

SEQ ID NO: 48754 - RNA, 414 nt, Artificial Sequence
  derived and/or modified sequence opt6 from anti-HIV-1_HeavyChain
caagcacaucuagaacaaaguggaaguggaguaaaaaaaccaggagcaaguguaagaguaaguuguuggacaagugaagauauauuugaaggaagugaauuaauacauuggguaagacaagcaccaggacaaggauuagaauggauaggauggguaaaaacaguaacaggagcaguaaauuuuggaagugcauauuuuagacauagaguaagcuuaacaagagauagagauuuauuuacagcacauauggauauaagaggauuaacacaaggagauacagcaacauauuauugugcaagacaaaaauuuuauaaaggaggacaaggaugguauuuugauuuauggggaagaggaacauuaauaguaguaaguagugcaagcacaaaaggaccaaguguauuuccaacaauaugu

SEQ ID NO: 48755 - RNA, 399 nt, Artificial Sequence
  derived and/or modified sequence opt6 from anti-HIV-1_HeavyChain
agagaauaucuagaacaaucaggaggaggaguaaaaaaaccaggagcaucaguaagaguaucaugcagagcaucagaagaucuauuuggagaugaaauaauauaugacgaugaaguaauacauugguuaagacaaguaccaggacaaagaccagaauggaugggauggauaagaccaaaaaauggaggaagaaaucaagcaagacaauuccaaccaagaauaucacuaacaagagauagagcacuaaauacagcauacuuagacuuaaacucauuaacaagcgcagacucaggaacauacuuuugcgcaagacaaacauuuaaaccagacuuuuacuuugcagaucaaggauggucauucaaucuauggggaagaggagcaagaguaauaguaaguuca

SEQ ID NO: 48756 - RNA, 375 nt, Artificial Sequence
  derived and/or modified sequence opt6 from anti-HIV-1_HeavyChain
caagcacauuuagaacaaaguggaaguggaguaaaaaaauuaggagcaagcguaagaguaaguuguuggacaagugaagauauauuugaaagaacagaauuaauacauuggguaagacaagcaccaggacaaggauuagaauggauaggauggguaaaagcaguaagcggagcaguaaauuauggaaguuuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagc

SEQ ID NO: 48757 - RNA, 420 nt, Artificial Sequence
  derived and/or modified sequence opt6 from anti-HIV-1_HeavyChain
caaguauauauggaacaagcaggaggaggaguaaaaaaaccaggagcaaguguaacacuaagcuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagugcaaguacaaaaggaccaaguguauuuccgacaauaugu

SEQ ID NO: 48758 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaggaagugaacuaauacauuggguaagacaagcaccaggacaaggacuagaauggauaggauggguaaaaacaguaacaggagcaguaaauuuuggaagcgcauauuuuagacauagaguaaguuuaacaagagauagagauuuauuuacagcacauauggauauaagaggauuaacacaaagugauacagcaacauauuuuugugcaagacaaaaauuuuaugcaggaggacaaggaugguauuuugauuuauggggaagaggaacauuaauaguaguaaguagugcaaguacaaaaggaccaaguguauuuccacaugauuuaaga

SEQ ID NO: 48759 - RNA, 426 nt, Artificial Sequence
  derived and/or modified sequence opt6 from anti-HIV-1_HeavyChain
caaagccaucuagaacaaucaggaucagcaaugaaaaaaccaggagcaucaguaagaguaucaugcuggacaucagaagauauauuugaaagaacagaacuaauauacuggguaagacaagcaccaggaagaggacuagaauggauaggauggguaaaaacaguaagcggaacaguaaacuuuggcucaagcgauuucagaaacagaauaucacuaacaagagauagagaucuaucaacagcacacauggacauaagaggacuaacacaagaugacacagcaacauacuuuugcgcaagacaaaaauuugaaucacuauauagugaugaccaaggaucauacuuugacuuauggggaagaggaacauuaauaauaguaucaagcgcaaguccaaaaggaccaucaggauuaccaccaagaucagca

SEQ ID NO: 48760 - RNA, 411 nt, Artificial Sequence
  derived and/or modified sequence opt6 from anti-HIV-1_HeavyChain
caaguacaauuaguacaaucaggagcagaaguaaaaaaaccaggagcaucaguaaaaguaucauguaaagcaucaggauauacauuuacaacauauggaauaucauggguaagacaagcaccaggacaaggauuagaauggauaggauggguaaaaacaguaacaggagcaguaaauuuuggacaucaaauaucagauagaguaucauuaacaagagauagagauuuauuuacagcacauauggauauaagaggauuaacacaaggagauacagcaacauauuuuugugcaagacaaaaauucuaugcaggaggacaaggaugguauuuugauuuauggggaagaggaacauuaauaguaguaaguucagcaucaacaaaaggaccaaguguauuuccacaugauuuaaga

SEQ ID NO: 48761 - RNA, 417 nt, Artificial Sequence
  derived and/or modified sequence opt6 from anti-HIV-1_HeavyChain
caagcacaauuagaacaaaguggaaguggaguaaaaaaaccaggagcaaguguaagaguaaguuguuggacaagugaagauauauuugaaagaacagaauuaauacauuggguaagacaagcaccaggacaaggacuagaauggauaggauggguaaaaacaguaacaggagcaguaaauuuuggaaguagugauuuuagacaaagaguaaguuuaacaagagauagagauuuauuuacagcgcauauggauauaagaggauuaacacaaggagauacagcaacauauuuuugugcaagacaaaaauuuuaugcaggaggacaaggaugguauuuugauuuauggggaagaggaacauuaauaguaguaaguagugcaagcacaaaaggaccaaguguauuuccacaugauuuaaga

SEQ ID NO: 48762 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuacugugcaagacaaaaauuugaaagaggaggacaaggaugguauuuugauuuauggggaagaggaacauuaauaguaguaaguagu

SEQ ID NO: 48763 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggguuagaauggauaggauggguaaaaacaguaacaggagcaguaaauuuuggaaguagugauuuuagacaaagaguaagucuaacaagagauagagauuuauuuacagcacauauggauauaagaggacuaacacaaggagauacagcaacauauuauugugcaagacaaaaauuugaaaguagguauacaggaggacaaggaugguauuuugauuuauggggaagaggaacacauauaguaguaaguagu

SEQ ID NO: 48764 - RNA, 414 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaacaguaacaggagcaguaaauuuuggaaguccaaacuuuagacauagaguaagcuuaacaagagauagagauuuauuuacagcacauauggauauaagaggauuaacacagggagauacagcaacauauuuuugugcaagacaaaaauuugaaagaggaggacaaggaugguauuuugauuuauggggaagaggaacauuaauaguaguaaguagugcaaguacaaaaggaccaaguguauuuccaacaauaugu

SEQ ID NO: 48765 - RNA, 381 nt, Artificial Sequence
  derived and/or modified sequence opt6 from anti-HIV-1_HeavyChain
caaguacaauuaguacaaucaggagcagaaguacaaaaaccaggagcaucaguaacaguaucaugcaaagcaucaggauauacacuaauaucauacggaauaucaugggugagacaagcaccaggacaaggaccagaauggaugggauggauaagaccaaaaacaggagcaagaaaucaagcaagacaauuccaaccaagaauaucacuaacaagagauagagcacuaucaacagcauacuuagacuuaaacucacuaacaagcgcagacucaggaacauacuuuugcgcaagacaaacauuuaaaccagacuuuuacuuugcagaucaaggauggucauucaauuuauggggaagaggagcacacuuuauaguaagcuca

SEQ ID NO: 48766 - RNA, 414 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuaagaaaaaaagaauuaauacauuggguaagacaagcaccaggacaaggauuagaauggauaggauggguaaaaacaguaacaggaacaguaaauuuuggaaguagugauuuuagacaaagaguaucacuaacaagagauagagauuuauuuacagcacauauggauauaagaggauuaacacaaggagauacagcaacauauuuaugugcaagacaaaaauuugaaaggggaggacaaggauggauauuugaucuauggggaagaggaacauuaauagcaguaaguagcgcaagcacaaaaggaccaaguguauuuccacaugauuua

SEQ ID NO: 48767 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggucaagcgaagauauauuugaaagaacagaauuaauacauuggguaagacaagcaccaggacaaggauuagaauggauaggauggguaaaaacaguaacaggagcaguaaauuuuggaagcuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagugcaaguacaaauggaccaauaggauuaccacauagaagugca

SEQ ID NO: 48768 - RNA, 384 nt, Artificial Sequence
  derived and/or modified sequence opt6 from anti-HIV-1_HeavyChain
caagcacaucuagaacaaaguggaucaggaguaaaaaaaccaggagcaaguguaagaguaaguuguuggacaagugaagauauauuuggaaaaagugaauuaauacauuggguaagacaagcaccaggacaaggauuagaauggauaggauggguaaaaacaguaacaggagcaguaaauuuuggaagcagcgauuuuagacaaagaguaaguuuaacaagagauagagauuuauuuacagcacauauggauauaagaggauuaacacaaggagauacagcaacauauuuuugugcaagacaaaaauuugaaaguuuauauagugaugaucaagggaguuauuuugauuuauggggaagaggaacacuaauaauaguaaguagu

SEQ ID NO: 48769 - RNA, 417 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggacaagugaagauauauuugaaagaacagaauuaauacauuggguaagacaagcaccaggacaaggacuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacguauuuuugugcaagacaaaaauuugaaagaggaggacaaggaugguauuuugauuuauggggaagaggaacauuaauaguaguaaguagugcaaguacaaaaggaccaaguggauuaccacauggaagugca

SEQ ID NO: 48770 - RNA, 423 nt, Artificial Sequence
  derived and/or modified sequence opt6 from anti-HIV-1_HeavyChain
caaguacaauauggaagagaagcaggagcaggaaugaaaaagccaggagcaaguaugacaguaaguuguaaaacagcagaugaagauauauuugaugcagcauauaugcauagaguaagacaagcaccaggacaaacauuugaaugguuaggauggaugaaaccaguaacaggagcaguaaauuaugcaagacaauuucaaggaaggguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagcgcaagcacaaaaggaccaaguguauuuccaacaauauau

SEQ ID NO: 48771 - RNA, 426 nt, Artificial Sequence
  derived and/or modified sequence opt6 from anti-HIV-1_HeavyChain
caagcacauuuagaacaaagcggaagcggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaagucuaacaagagauagagauuuauuuacagcacauauggauauaagaggauuaacacaaggagauacagcaacauauuuuugugcaagacaaaaauuugaaaguagauauacaggaggacaaggaugguauuuugaucuauggggaagaggaacacauauaguaguaaguucagcaaguacgaaaggaccaaguguauuuccacaugauuuaaga

SEQ ID NO: 48772 - RNA, 423 nt, Artificial Sequence
  derived and/or modified sequence opt6 from anti-HIV-1_HeavyChain
caaguacaacuaguacaaucagaagcagaauuaaaaaaaccaggagcaucaguaucaguaucaugcaaagcaucaggauauucauuuacaucauacggaauaucauggguaagacaaguaccaggacaaggacuagaauggauagcauggauaagaccaaaaacaggagcaagaaaucaagcaagacaauuccaaccaagaauaucacuaacaagagauagagcacuauccacagcauacuuagacuuaaacucacuaacaucagcagacucaggaacauacuuuugcgcaagacaaacauuuaaaccagacuuuuacuuugcagaucaaggauggucauucaaucuauggggaagaggagcacauuuuauaguaucaucagcaucaacaaaaggaccaagcguuuucccacacgaucuaaga

SEQ ID NO: 48773 - RNA, 414 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaagaacagaauuaauacauuggguaagacaagcaccaggacaaggacuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuauugcgcaagacaaaaauuugaaagaggaggacaaggaugguauuuugaucuauggggaagaggaacacuaauaguaguaaguagugcaaguacaaaaggaccaaguguauuuccacaugauuua

SEQ ID NO: 48774 - RNA, 381 nt, Artificial Sequence
  derived and/or modified sequence opt6 from anti-HIV-1_HeavyChain
caaguacaauuaguacaaucaggagcagaaguacaaaaaccaggagcaucaguaacaguaucaugcaaagcaucaggauauacacuaauaucauacggaauaucauggguaagacaagccccaggacaaggaccagaauggaugggauggauaagaccaaaaacaggagcaagaaaucaagcaagacaauuccaaccaagaauaucauuaacaagagauagagcacuaucaacagcauaccuagacuuaaacucacuaacaagcgcagacucaggaacauacuauugcgcaagacaaacauuuaaaccagacuuuuacuuugcagaucaaggauggucauucaauuuauggggaagaggagcacacuuuauaguaagcuca

SEQ ID NO: 48775 - RNA, 414 nt, Artificial Sequence
  derived and/or modified sequence opt6 from anti-HIV-1_HeavyChain
caagcacauuuagaacaaagcggaaguggaguaaaaaaauuaggagcaaguguaaggguaagcuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagcgcaaguacgaaaggaccaaguguauuuccacaaauaugu

SEQ ID NO: 48776 - RNA, 378 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauauguguaaguagcgca

SEQ ID NO: 48777 - RNA, 438 nt, Artificial Sequence
  derived and/or modified sequence opt6 from anti-HIV-1_HeavyChain
caaggauacuuagcacaaagcggaggaggaguaaaaaaaccaggaacaagcgcaagcuuuagcuguagaacaagugaugacauauacgauaacgaauucuuugacucagcauuuaugcauuggguaagauuaauaccaggacaaagaccagaauggaugggauggaugaacccaagaucaggagcaguaaauuacgcaagacaauuacaaccaagaguaucaauguauagagauagagaucuaucaacagcauacuuagacuuaaacucauuaacaagcgcagacucaggaacauacuuuugcgcaagacaaacauuuaaaccagacuuuuacuuugcagaucaaggauggucauucaauuuauggggaagaggagcacacuuuauaguaagcucagcaucaacaaaaggaccaagcguauuaccacacgauuuaaga

SEQ ID NO: 48778 - RNA, 414 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaacacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagugcaaguacaaaaggaccaaguguauuuccaagaagugca

SEQ ID NO: 48779 - RNA, 414 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggacaagugaagauauauuugaaaaaaaagaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagugcaaguacaaaaggaccaaguguauuuccacaugauuua

SEQ ID NO: 48780 - RNA, 384 nt, Artificial Sequence
  derived and/or modified sequence opt6 from anti-HIV-1_HeavyChain
caagcacaucuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaagucuagauuuuagacauagaauaaguuuaacaagagauagagauuuauuuacagcacauauggauauaagaggauuaacacaaggagauacagcaacauauuauugugcaagacaaaaauuugaaaguagauauacaggaggacaaggaugguauuuugauuuauggggaagaggaacacauauaguaguaaguagu

SEQ ID NO: 48781 - RNA, 414 nt, Artificial Sequence
  derived and/or modified sequence opt6 from anti-HIV-1_HeavyChain
caagcacauuuagaacaaucaggaucaggaguaaaaaaaccaggagcaucaguaagaguaucaugcuggacaucagaagauauauuugaaaaaagugaauuaauacauuggguaagacaagcaccaggacaaggauuagaauggauaggauggguaaaaacaguaacaggagcaguaaauuuuggaucaagugauuucagacaaagaguaucauuaacaagagauagagauuuauuuacagcacauauggauauaagaggguuaacacaaggagauacagcaacauauuauugugcaagacaaaaauuuuaugcaggaggacaaggaugguauuuugauuuauggggaagaggaacauuaauaguaguaaguucagcaucaacaaaaggaccaaguguauuuccaacaauaugu

SEQ ID NO: 48782 - RNA, 384 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaacuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggacuaacacaagaugauacagcaacauauuuuugugcaagacaaaaauuugaaaguuuauauagugaugaucaaggaaguuauuuugauuuauggggaagaggaacauuaauaauaguaaguagu

SEQ ID NO: 48783 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaggaucagaauuaauacauuggguaagacaagcaccaggacaaggauuagaauggauaggauggguaaaaacaguaacaggagcaguaaauuuuggaagugcauauuuuagacauagaguaaguuuaacaagagauagagauuuauuuacagcacauauggauauaagaggacuaacacaaggagauacagcaacauauuuuugugcaagacaaaaauuugaaaguagauauacaggaggacaaggaugguauuuugaucuauggggaagaggaacacauauaguaguaucaucagcaucaacaaaaggaccaaguguauuuccacaugaucuaaga

SEQ ID NO: 48784 - RNA, 408 nt, Artificial Sequence
  derived and/or modified sequence opt6 from anti-HIV-1_HeavyChain
caaguacaauuaguacauaguggagcagaaguaaaaaaaccaggagcaagcaugaaaguaagcuguaaaacaaguggauacucauucacaggauauuacaugcacuggguaagacaagcaccaggacaaggacuagaauggaugggauggauaaauccaucaagcaaugacacaaacuaugcacaaaaauuucaaggaagaguaacaaugacaagagacacaagcauaaacacagcauauauggaauuaucaagauuaagaucaggagauacagcgauauauuucugugcaagacaaaaauucuaugcaggaggacaaggaugguacuuugacuuauggggaagaggaacauuaauaguaguaucaagcgcaaguacaaaaggaccaucaguauuuccaacaauaugu

SEQ ID NO: 48785 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaagauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 48786 - RNA, 414 nt, Artificial Sequence
  derived and/or modified sequence opt6 from anti-HIV-1_HeavyChain
caaggaacauuagaacaaaguuggagugaaguaaaaaaauuaggagcaaguguaagaguaaguuguuggacaagugaagauauauuuaaaacagaauuaauacauuggguaagacaagcaccaggacaaggacuagaauggauaggaggaaugaaagcaguaaguggagcaguaaauuauggaucauuagauuucagacauagaguaucauuaacaccagauagagauuuaucaacagcacauauggauauaagaggacuaacacaagaugauacagcaacauauuuuugugcaagacaaaaauuugcaagaggagaucaaggaugguuuuuugauuuauggggaagaggaacauuaauaguaguaaguucagcaucaacaaaaggaccaaguguauuuccacaugauuuaaga

SEQ ID NO: 48787 - RNA, 423 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaucagaauuaauacauuggguaagacaagcaccaggacaaggauuagaauggauaggauggguaaaaacaguaacaggagcaguaaauuuugcaaguuuagauuuuagaaauagaauaagcuuaagcagagacagagauuuaaguacagcauauauggauauaagaggauuaacacaagaugauacagcaacauauuuuugugcaagacaaaaauuugcaagcagauauucaggagaucaaggaagcuauuuugauuuauggggaagaggaacauuaauauguguaagcagugcaucaacaagagcacauagacuaccaccaagaucagca

SEQ ID NO: 48788 - RNA, 414 nt, Artificial Sequence
  derived and/or modified sequence opt6 from anti-HIV-1_HeavyChain
caagcacaucuagaacaaagcggaaguggaguaaaaaaaccaggagcaaguguaagaguaaguuguuggacaagugaagauauauuugaaagaacagaauuaauacauuggguaagacaagcaccaggccaaggacuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugcaagaggagaucaaggaugguuuuuugacuuauggggaagaggaacauuaauaguaguaaguagcgcaaguccaagagcacauagaaguucaccaagaagugca

SEQ ID NO: 48789 - RNA, 417 nt, Artificial Sequence
  derived and/or modified sequence opt6 from anti-HIV-1_HeavyChain
caagcacauuuagaacaaucaggaucaggaguaaaaaaaccaggagcaucaguaagaguaucauguuggacaucagaagauauauuugaaaaaagugaauuaauacauuggguaagacaagcaccaggacaaggauuagaauggauaggauggguaaaaacaguaacaggagcaguaaauuuuggaaguagugauuuuagacaaagaguaucauuaacaagagauagagauuuauuuacagcacauauggauauaagaggauuaacacaaggagauacagcaacauauuuuugugcaagacaaaaauuuuaugcaggaggacaaggaugguauuuugauuuauggggaaggggaacauuaauaguaguaaguucagcaucaacuaaaggaccaaguguauuuccacaugauagugca

SEQ ID NO: 48790 - RNA, 414 nt, Artificial Sequence
  derived and/or modified sequence opt6 from anti-HIV-1_HeavyChain
caagcacauuuaguacaaaguggaaguggaguaaaaaaaccaggagcaaguguaagaguaagcuguuggacaagugaagauauauuuaaaagugaauuaauacauuggguaaggcaagcaccaggacaaggauuagaauggauaggauggguaaaaacaguaacaggagcaguaaauuuuggaucaagugauuuuagacaaagaguaucacuaacaagagauagagauuuauuuacagcacauauggauauaagaggauuaacacaaggagauacagcaacauauuuuugugcaagacaaaaauuuuaugcaggaggacaaggaugguauuuugaucuauggggaagaggaacauuaauaguaguaaguucagcaucaacaaaaggaccaaguguauuuccacaugauuuaaga

SEQ ID NO: 48791 - RNA, 414 nt, Artificial Sequence
  derived and/or modified sequence opt6 from anti-HIV-1_HeavyChain
caagcacaauuagaacaaaguggaaguggaguaaaaaaaccaggagcaagcguaagaguaaguuguuggacaagugaagauauauuuaaaacagaauuaauacauuggguaagacaagcaccaggacaaggauuagaauggauaggauggguaaaaacaguaacaggagcaguaaauuuuggaucaccaaauuuuagacauaggguaucauuaacaagagauagagauuuauuuacagcacauauggauauaagaggauuaacacaaggagauacagcaacauauuuuugugcacgacaaaaauuugaaagaggaggacaaggaugguauuuugauuuauggggaagaggaacauuaauaguaguaaguucagcaaguacaaaaggaccaaguguauuuccacaugauuuaaga

SEQ ID NO: 48792 - RNA, 417 nt, Artificial Sequence
  derived and/or modified sequence opt6 from anti-HIV-1_HeavyChain
caagcacauuuagaacaaucaggaagagaaguaaaaaaaccaggagcaucaguaagaguaucauguuggacaucagaagauauauuugaaaaaagugaauuaauacauuggguaagacaagcaccaggacaaggauuagaauggauaggauggguaaaaacaguaacaggagcaguaaacuuuggaucaagugauuuuagacaaagaguaucacuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguucagcaucaacaaaaggaccaaguguauuuccacaugauuuaaga

SEQ ID NO: 48793 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaagcggagcaguaaauuuuggaagcccaaauuuuagacauagaauaaguuuaacaagagauagagauuuauuuacagcacauauggauauaagaggauuaacacaaggagauacagcaacauauuauugugcaagacaaaaauuugaaaguagauauacaggaggacaaggaugguauuuugauuuauggggaagaggaacacauauaguaguaaguagu

SEQ ID NO: 48794 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaggaagugaauuaauacauuggguaagacaagcaccaggacaaggauuagaauggauaggauggguaaaaacaguaacaggagcaguaaauuuuggaagcgcauauuuuagacauagaguaaguuuaacaagagauagagauuuauuuacagcacauauggauauaagaggauuaacacaaggagauacagcaacauauuauugugcaagacaaaaauuuuauaaaggaggacaaggaugguauuuugauuuauggggaagaggaacauuaauaguaguaaguagu

SEQ ID NO: 48795 - RNA, 381 nt, Artificial Sequence
  derived and/or modified sequence opt6 from anti-HIV-1_HeavyChain
caaguacaauuaguacaaucaggagcagaaguaaaaaaaccaggagcaucaguaaaaguaagcuguaaagcaucaggauauacauuuacagauuauuauuuacacuggguaagacaagcaccaggacaaggacuagacuggguaggauggauaaauccaaauucaggaggaacaaauuaugcacaaaaauuucaaggaagaguagcaaugacaagagacacaucauuaucaaguguauaucuagauuuaaauucauuaacaucagcagacucaggaacauauuucugugcaagacaaacauuuaaaccagauuuuuauuucgcagaccaaggauggucauuuaauuuauggggaagaggagcacauuuuauaguaucauca

SEQ ID NO: 48796 - RNA, 414 nt, Artificial Sequence
  derived and/or modified sequence opt6 from anti-HIV-1_HeavyChain
caagcagauuuagaacaaaguggaaguggaguaaaaaaaccaggagcaaguguaagaguaaguuguuggacaucagaagauauauuugaaagaacaaauuauguacauuggguaagacaagcaccaggaagaggauuagaauggauaggauggaguaaaacaguaacaggagcaguaaauuuuggaaguccaaauuuuagacauagaguaagcuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguucagcaaguacaaaaggaccaaguguauuuccacaugauuua

SEQ ID NO: 48797 - RNA, 381 nt, Artificial Sequence
  derived and/or modified sequence opt6 from anti-HIV-1_HeavyChain
caaguauauauggaacaagcaggaggaggaaugaaaaaaccaggagcaaguaugacaguaaguuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaauuugaugauacagcaguauauuuuugugcaagaaaaacaaaaggagauguaagcggagaugauagaggauuuuuuuuugauuuauggggaagaggaacaagaguaauaguaaguagu

SEQ ID NO: 48798 - RNA, 384 nt, Artificial Sequence
  derived and/or modified sequence opt6 from anti-HIV-1_HeavyChain
caaagccaucuagaacaaucaggaucagcaaugaaaaaaccaggagcaucaguaagaguaucaugcuggacaucagaagauauauuugaaaggacagaacuaauauacuggguaagacaagcaccaggaagaggacuagaauggauaggauggguaaaaacaguaagcggaacaguaaacuuuggaucaagugauuucagaaacagaauaucacuaacaagagauagagauuuaucaacagcacacauggacauaagaggauuaacacaagaugacacagcaacauacuuuugcgcaagacaaaaauuugaaucauuauauagcgaugaccaaggaucauacuuugacuuauggggaagaggaacauuaauaauaguaucaagc

SEQ ID NO: 48799 - RNA, 414 nt, Artificial Sequence
  derived and/or modified sequence opt6 from anti-HIV-1_HeavyChain
caagcacauuuagaacaaaguggaagcggaguaaaaaaacuaggagcaaguguaagaguaaguuguuggacaagugaagauauauuugaaagaacaaauuuaauacauuggguaagacaagcaccaggacaaggauuagaauggauaggauggguaaaagcaguaaguggagcaguaaauuauggaagccuagauuuuagacauagaguaagcuuaacaagagauagagauuuaaguacagcacauauggacauuagaggacuaacacaagaugauacagcaacauauuuuugugcaagacaaaaauuugcaagaggagaucaaggaugguuuuuugaucuauggggaagaggaacauuaauaguaguaucaagugcaaguacaaaaggaccaucaguauuuccacaugauuua

SEQ ID NO: 48800 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcaggagaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 48801 - RNA, 384 nt, Artificial Sequence
  derived and/or modified sequence opt6 from anti-HIV-1_HeavyChain
caaagucauuuagaacaaucaggaucagcaaugaaaaaaccaggagcaucaguaagaguaucaugcuggacaucagaagauauauuugaaagaacagaacuaauauacuggguaagacaagcaccaggaagaggauuagaauggauaggauggguaaaaacaguaagcggaacaguaaacuuuggaucaagcgauuucagaaacagaauaucauuaacaagagauagagaucuaucaacagcacacauggacauaagaggacuaacacaagaugacacagcaacauacuuuugcgcaagacaaaaauuugaaucacuauauagugaugaccaaggaucauacuuugacuuauggggaagaggaacauuaauaacaguaucaagu

SEQ ID NO: 48802 - RNA, 429 nt, Artificial Sequence
  derived and/or modified sequence opt6 from anti-HIV-1_HeavyChain
caagcacauuuagaacaaucaggaucaggaguaaaaaaaccaggagcaucaguaagaguaucaugcuggaguucagaagauauauuugaaagaacagaauuaauacacuggguaagacaagcaccaggacaaggauuagaauggauaggauggguaaaaacaguaacaggagcaguaaauuuuggaucauuagauuuuagacacagaauaaguuuaacaagagauagagauuuauuuacagcacauauggacauaagaggauuaacacaaggagauacagcaacauauuuuugugcaagacaaaaauuugaaucaagauauacaggaggacaaggaugguauuuugacuuauggggaagaggaacacauauaguaguaucaagcgcaaguacaaaaggaccaucaggauuaccaccaacaauauguaga

SEQ ID NO: 48803 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaagcagugauuuuagacaaagaguaagucuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagugcaaguacaaaaggaccaaguguauuuccacaugauuuaaga

SEQ ID NO: 48804 - RNA, 417 nt, Artificial Sequence
  derived and/or modified sequence opt6 from anti-HIV-1_HeavyChain
caagcacauuuagaacaaaguggaaguggaguaaaaaaaccaggaacaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagugcaaguacaaaaggaccaaguguauuuccacaugauuuaaga

SEQ ID NO: 48805 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagaggaagagaucuauuuacagcacauauggauauaagaggauuaacacaaggagauacagcaacauauuauugugcaagacaaaaauuugaaagaggaggacaaggaugguauuuugauuuauggggaagaggaacauuaauaguaguaaguagugcaaguacaaaaggaccaaguguauuuccacaugauuuaaga

SEQ ID NO: 48806 - RNA, 411 nt, Artificial Sequence
  derived and/or modified sequence opt6 from anti-HIV-1_HeavyChain
caagcacauuuaggagcaaauuggaguggaguaaaaaaauuaggagcaaguguaagaguaaguuguuggacaagugaagauauauuugaaagaacagaacuaauacacuggguaagacaagcaccaggacaaggauuagaauggauaggauggguaaaagcaguaaguggagcaguaaauuauggaaguuuagauuuuagacauagaguaagucuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcaaguacaaaaggaccaaguguauuuccacaaaua

SEQ ID NO: 48807 - RNA, 375 nt, Artificial Sequence
  derived and/or modified sequence opt6 from anti-HIV-1_HeavyChain
caagcacaucuagaacaaucaggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaacuuuggaaguagugauuuuagacaaagaguaaguuuaacaagagauagagauuuauucacagcacauauggauauaagaggauuaacacaaggagauacagcaacauauuuuugugcaagacaaaaauuuuaugcaggaggacaaggaugguauuuugauuuauggggaagaggaacacuaauaguaguaaguagu

SEQ ID NO: 48808 - RNA, 423 nt, Artificial Sequence
  derived and/or modified sequence opt6 from anti-HIV-1_HeavyChain
caagcacaauuagaacaaagcgggguaggaguaaaaaaaccaggagcaagcguaagaguaagcugucuagcaagcgaagacauauuuaaaacagaauuaauacacuggguaagacaagcaccaggacaaggacuagaauggauaggauggguaaaaacaguaacaggagcaguaaacuuuggaucacaaauauucagacacagaauaucacuaacaagagauagagaucuauuuacagcacacauggacauaagaggacuaacacaaggagacacagcaacauacuuuugcgcaagacaaaaauuugaaucaagauauacaggaggacaaggaugguacuuugacuuauggggaagaggaacacauauaguaguaucaagcgcaaguacaaaaggaccaucaguauuuccacaugacuuacga

SEQ ID NO: 48809 - RNA, 411 nt, Artificial Sequence
  derived and/or modified sequence opt6 from anti-HIV-1_HeavyChain
caagcacacuuagaacaaagcggaaguggaguaaaaaaaccaggagcaaguguaagaguaaguuguuggacgagugaagacauauuugaaaaaucagaauuaauacauuggguaagacaagcaccaggacaaggauuagaauggauaggauggguaaaaacaguaacaggagcaguaaauuuugcacaucaaauaucagacagaguaucauuaacaagagauagagauuuauuuacagcacauauggauauaagaggauuaacacaaggagauacagcaacauauuuuugugcaagacaaaaauuuuacgcaggaggacaaggaugguauuuugauuuauggggaagaggaacauuaauaguaguaagcucagcaucaacaaaaggaccaaguguauuuccaacaauaugu

SEQ ID NO: 48810 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaagugaauuaauacauuggguaagacaagcgccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauauuaugcaggaggacaaggaugguauuuugauuuauggggaagaggaacauuaauauguguaaguagu

SEQ ID NO: 48811 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaagcagu

SEQ ID NO: 48812 - RNA, 375 nt, Artificial Sequence
  derived and/or modified sequence opt6 from anti-HIV-1_HeavyChain
caagcacauuuagaacaaaguggaagcggaguaaaaaaauuaggagcaaguguaagaguaaguuguuggacaagugaagauauauuugaaagaacagaauuaauacauuggguaagacaagcaccaggaagaggauuagaauggauaggauggguaaaagcgguaaguggagcaguaaauuauggaaguuuagauuuuagacauaggguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48813 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaaggaguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 48814 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaggaagugaauuaauacauuggguaagacaagcaccaggacaaggauuagaauggauaggauggguaaaaacaguaacaggagcaguaaauuuuggaagugcauauuuuagacauagaguaaguuuaacaagagauagagauuuauuuacagcacauauggauauaagaggauuaacacaaggagauacagcaacauauuuuugugcaagacaaaaauauuaugcaggaggacaaggaugguauuuugauuuauggggaagaggaacauuaauaguaguaaguagu

SEQ ID NO: 48815 - RNA, 378 nt, Artificial Sequence
  derived and/or modified sequence opt6 from anti-HIV-1_HeavyChain
caaguauauauggaacaaccaggaguagaaguaacaaaaccaggagcaaguguaacauuaaguuguaaaacagcagaagacguauuugaugcagcauauaugcauuggguaagacaagcaccaggacaaacauuugaaugguuaggauggauaaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaagcagu

SEQ ID NO: 48816 - RNA, 375 nt, Artificial Sequence
  derived and/or modified sequence opt6 from anti-HIV-1_HeavyChain
caagcacaucuagaacaaaguggaaguggaguaaaaaaaccaggagcaaguguaagaguaaguuguuggacaagugaagauauauuugaaaaaagugaauuaauacauuggguaagacaagcaccaggacaaggacuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaaggggaacauuaauaauaguaaguagu

SEQ ID NO: 48817 - RNA, 384 nt, Artificial Sequence
  derived and/or modified sequence opt6 from anti-HIV-1_HeavyChain
caagcacauuuaguacaaaguggaagugaaguaaaaaaaccaggagcauuuguaagaguaaguuguuggacaagugaagauauauuugaagaaacagaauuaauacauuggguaaggcaagcaccaggacaaggacuagaauggauaggauggguaaaaacaguaacaggagcaguaaauuuuggaaguuuagauuuuagacauagaauaagcuuaacaagagauagagauuuauuuacagcacauauggauauaaggggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 48818 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguaaagcaagugaagauauauuugaaaggacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugaucuauggggaagaggaacauuaauaguaguaaguagu

SEQ ID NO: 48819 - RNA, 375 nt, Artificial Sequence
  derived and/or modified sequence opt6 from anti-HIV-1_HeavyChain
caagcacauuuagaacaaucaggaagugaaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagacagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagc

SEQ ID NO: 48820 - RNA, 375 nt, Artificial Sequence
  derived and/or modified sequence opt6 from anti-HIV-1_HeavyChain
caagcacauuuaguacaaaguggaaguggaguaaaaaaaccaggagcaaguguaagaguaaguuguuggacaagugaagauauauuugaaaaaagcgaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48821 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaagcuguuggacaagugaagauauauuugaaagaacagaauuaauacauuggguaaggcaagcaccaggacaaggauuagaauggauaggauggguaaaagcaguaaguggagcaguaaauuauggaagucuagauuuuagacauagaguaaguuuaacaagagauagagauuuaaguacagcacauauggauauaagaggauuaacacaagaugauacagcaacauauuuuugugcaagacaaaaauuugaaagaggaggacaaggaugguauuuugauuuauggggaagaggaacauuaauauguguaaguagu

SEQ ID NO: 48822 - RNA, 375 nt, Artificial Sequence
  derived and/or modified sequence opt6 from anti-HIV-1_HeavyChain
caagcacaucuagaacaaagcggaaguggaguaaaaaaaccaagagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugaucuauggggaagaggaacauuaauaguaguaaguuca

SEQ ID NO: 48823 - RNA, 381 nt, Artificial Sequence
  derived and/or modified sequence opt6 from anti-HIV-1_HeavyChain
caaguacaauuagaacaagcaggagcaggaguaaaaaaaccaggaccaaguguaacauuaucauguaaaacagcagaugaagauguauuugaugcagcauauaugcauuggguaagacaagcaccaggacaaacauucgaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaucaagaguaauaguaaguagu

SEQ ID NO: 48824 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaacaguaaguggagcaguaaauuuuggaaguccaaauuuuagacaaagaguaaguuuaacaagagauagagauuuauuuacagcacauauggauauaagaggacuaacacaaggagauacagcaacauauuuuugugcaagacaaaaauuuuaugcaggaggacaaggaugguauuuugauuuauggggaagaggaacauuaauaguaguaaguagu

SEQ ID NO: 48825 - RNA, 381 nt, Artificial Sequence
  derived and/or modified sequence opt6 from anti-HIV-1_HeavyChain
caaguauuuauggaacaagcaggagcaggaaugaaaaaaccaggagcaaguaugacaguaaguuguaaaacagcagaugaagauguauuugaugcagcguauaugcauuggguaagacaagcaccaggacaaacauuugaaugguuaggauggaugaaaccaguaacaggagcaguaaauuaugcaagaaaauuucaaggaagaguaaguuuuuauagaacaagagaacuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 48826 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagagcaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauucacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 48827 - RNA, 381 nt, Artificial Sequence
  derived and/or modified sequence opt6 from anti-HIV-1_HeavyChain
caaguauacauggaacaagcaggaggaggaaugaaaaaaccaggagcaaguaugacaguaaguuguaaaacagcagaugaagauauauuugaugcagcauauaugcauuggguaagacaagcaagaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagu

SEQ ID NO: 48828 - RNA, 384 nt, Artificial Sequence
  derived and/or modified sequence opt6 from anti-HIV-1_HeavyChain
caagcacauuuagaacaaaguggagcaggaguaaaagaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagggauagagauuuauuaacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 48829 - RNA, 384 nt, Artificial Sequence
  derived and/or modified sequence opt6 from anti-HIV-1_HeavyChain
caaguacaauuaguacaaaguggaagcgcaaugaaaaaaccaggagcaaguguaagaguaaguuguuggacaagugaagauauauuugaaaggacagaauuaauauauuggguaagacaagcaccaggaagaggauuagaauggauaggauggguaaaaacaguaaguggaacaguaaauuuuggaaguagugauuuuagaaauagaauaaguuuaacaagagauagagauuuaaguacagcacauauggauauaagaggauuaacacaagaugauacagcaacauauuuuugugcaagacaaaaauuugaaaguuuauauagugaugaucaaggaaguuauuuugauuuauggggaagaggaacacuaauaauaguaaguagu

SEQ ID NO: 48830 - RNA, 384 nt, Artificial Sequence
  derived and/or modified sequence opt6 from anti-HIV-1_HeavyChain
caagcacauuuaguacaaagugcaagcggaguaaaaagaccaggagcaagcguaagaguaaguuguuggacaagugaagauauauuugaaagaacagaacuaauauauuggguaagacaagcaccaggacaaggauuagaauggauaggauggguaaaaacaguaaguggagcaguaaauuuuggaagucaagauuuuagacauagaauaaguuuaacaagagauagagauuuauuuacagcacauauggauauaaggggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 48831 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaaaagaggauuuuuuuuugauuuauggggaagaggaagcagaguaauaguaaguagu

SEQ ID NO: 48832 - RNA, 372 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaggauauaugauacauuggguaagacaagcaccaggacaaggauuagaauggauaggauggguaaaaacaguaacaggagcaguaaauuuuggaucagcauauuuuagacauagaguaucauuaacaagagauagagauuuauuuacagcacauauggauauaagaggauuaacacaaggagauacagcaacauauuuuugugcaagacaaaaauuuuauaaaggaggacaaggaugguauuuugauuuauggggaagaggaacauuaauaguaguaaguuca

SEQ ID NO: 48833 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggaagaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaaggggagaucaaggaugguuuuuugauuuauggggaagaggaacauuaauauguguaaguagu

SEQ ID NO: 48834 - RNA, 375 nt, Artificial Sequence
  derived and/or modified sequence opt6 from anti-HIV-1_HeavyChain
caagcacauuuaguacaaaguggaaguggaguaaaaaaaaguggagcaaguguaagaguaaguuguuggacaagugaagauauauuugaaaaaagugaauuaauacauuggguaagacaagcaccaggacaaggauuagaauggauaggauggguaaaaacaguaacgggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48835 - RNA, 378 nt, Artificial Sequence
  derived and/or modified sequence opt6 from anti-HIV-1_HeavyChain
caaguauauauggaaagagcaggagcaggaguaaaaaaaccaggagcaaguguaacauuaaguuguaaaacagcagaugaagauguauuuggagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagc

SEQ ID NO: 48836 - RNA, 375 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaggaagugaauuaauacauuggguaagacaagcaccaggacaaggauuagaauggauaggauggguaaaaacaguaacaggagcaguaaauuuuggaagcgcauauuuuagacauagaguaaguuuaacaagagauagagauuuauuuacagcacauauggauauaagaggauuaacacaaggagauacagcaacauauuuuugugcaagacaaaaauuuuauaaaggaggacaaggaugguauuuugauuuauggggaagaggaacauuaauaguaguaaguagu

SEQ ID NO: 48837 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugaaagaacagaauuaauauauuggguaagacaagcaccaggaagaggauuagaauggauaggauggguaaaaacaguaaguggaacaguaaauuuuggaaguagugauuuuagaaauagaguaaguuuaacaagggauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48838 - RNA, 384 nt, Artificial Sequence
  derived and/or modified sequence opt6 from anti-HIV-1_HeavyChain
caagcacauuuaguacaaaguggaaguggaguaaaaaaaccaggagcaaguguaagaguaagcuguuggacaagugaagauauauuugaaagaacagaauuaauacauugggugagacaagcaccaggacaaggauuagaauggauaggauggguaaaaacaguagcaggagcaguaaauuuuaguaguuuagauuuuagacauagaauaaguuuaacaagagauagagauuuauuuacagcacauauggauauaagaggauuaacacaaggagauacagcaacauauuuuugugcaagacaaaaauuugaaaguagguauacaggaggacaaggaugguauuuugauuuauggggaagaggaacacauauaguaguaaguagu

SEQ ID NO: 48839 - RNA, 384 nt, Artificial Sequence
  derived and/or modified sequence opt6 from anti-HIV-1_HeavyChain
caagcacauuuagaacaaaguggaaguggagugaaaaaaaguggagcaagugcaagaguaaguuguuggaguagugaagauauauuugaaaggacagaauuaauacauuggguaagacaagcaccaggacaaggauuagaauggauaggauggguaaaaacaguaacaggagcaguaaauuuuggaaguuuagauuuuagacauagaauaagcuuaacaagagauagagauuuauuuacagcgcauauggauauaagaggacuaacgcaaggagauacagcaacauauuuuugugcaagacaaaaauuugaaaguagauauacaggaggacaaggaugguauuuugauuuauggggaagaggaacacauauaguaguaaguagu

SEQ ID NO: 48840 - RNA, 369 nt, Artificial Sequence
  derived and/or modified sequence opt6 from anti-HIV-1_HeavyChain
uuauuacaauuaguacaaucaggagcagaaguaaaaaaaccaggagcaucaguaaaaguaacauguaaagcaucaggauauacauuuacaggauauauacauuggguaagacaagcaccaggacaaggauuagaauggauaggauggguaaaagcaguaaguggagcaguaaauuauggaucauuagauuuuagacauagaguaucauuaacacaugauagagauuuaucaacagcacauauggauauaagaggauuaacacaagaugauacagcaacauauuuuugugcaagacaaaaauuugcaagaggagaucaaggaugguuuuuugauuuauggggaagaggaacauuaauaguaguaaguuca

SEQ ID NO: 48841 - RNA, 369 nt, Artificial Sequence
  derived and/or modified sequence opt6 from anti-HIV-1_HeavyChain
caaguacaauuaguacaaaguggagcagaaguaaaaaaaccaggagcaaguguaaaaguaaguuguaaagcaaguggauguacauuuacaggauauuauaugcauuggguaagacaagcaccaggacaaggacuagaauggaugggauggauaaauccaaauaguggaggaacaaauuaugcacaaaaauuucaaggaagaguaacaaugacaagagauacaaguauaaguacagcauauauggaauuaaguagauuaagaagugaugauacagcaguauauuauugugcaagacaaaaauuugcaagaggagaucaaggaugguuuuuugauuuauggggaagaggaacauuaauaguaguaaguagu

SEQ ID NO: 48842 - RNA, 369 nt, Artificial Sequence
  derived and/or modified sequence opt6 from anti-HIV-1_HeavyChain
caaguacaauuaguacaaagcggaacagaauuaagaaaaccaggagcaaguguaaaaguaaguuguaaagcaagcggauauacauucucaggaucauacauacacuggguaagacaagcaccagggcaaggacuagaauggguaggauggauaaauccaucaagcggagcaacacaaugugcaaaaaaauuucaagauaaaguaacaaugacaagagacacaacaaauaacacaguauauauggaaguaaacagauuaauaagugacgauacagcaacauauuucugugcaagacaaaaauucgcaagaggagaccaaggaugguuuuuugacuuauggggaagaggaacauuaauaguaguaucaagc

SEQ ID NO: 48843 - RNA, 372 nt, Artificial Sequence
  derived and/or modified sequence opt6 from anti-HIV-1_HeavyChain
caaguauuauuaguacaaaguggagcagaaguaaaaaaaccaggaaguaguguaaaaguaaguuguaaaacaaguggagauaguuuaacaaaauaugcauuacauugggcaagacaagcaccagggcaaggauuagaauggauaggauggguaaaaacaguaacaggagcaguaaauuuuggaagcagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaagcagu

SEQ ID NO: 48844 - RNA, 372 nt, Artificial Sequence
  derived and/or modified sequence opt6 from anti-HIV-1_HeavyChain
caaguacaauuaguacaaaguggaacagaaguaaaaacaccaggagcaaguguaaaaguaaguuguaaagcaaguggauauacauuuacaaauuaugauauaaauuggguaagacaagcaccaggacaaggauuagaauggauaggauggguaaaaacaguaacaggagcaguaaauuuuggaaguagugauuucagacaaagaguaucauuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguuca

SEQ ID NO: 48845 - RNA, 372 nt, Artificial Sequence
  derived and/or modified sequence opt6 from anti-HIV-1_HeavyChain
caaguacaauuaguacaaaguggagaugaaguaaaaaaaccaggagcaaguguaaaaguaaguuguaaagcaaguggaaaaggauuuccaacaucauuaguaacauggguaagacaagcaccaggacaaggauuagaauggauaggauggguaaaagcaguaaguggagcaguaaauuauggaucauuagauuuuagacauagaguaucacuaacaagagauagagaucuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguuca

SEQ ID NO: 48846 - RNA, 372 nt, Artificial Sequence
  derived and/or modified sequence opt6 from anti-HIV-1_HeavyChain
caaguacaauuaguacaaaguggagcagaaguaaaaaaaccaggaaguaguguaaaaguaaguuguaaaacaagcggagauauauuaacaaauuauggauuaaauuggguaagacaagcaccaggacaaggauuagaauggauaggauggguaaaagcaguaagcggagcaguaaauuauggaagucuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48847 - RNA, 372 nt, Artificial Sequence
  derived and/or modified sequence opt6 from anti-HIV-1_HeavyChain
caaguacaacuaguacaaaguggagcagaaguaaaaaaaccgggagcaaguguaagaguaaguuguaaaacaaguggauauccauuuucaagauauggaauaaguuggguaagacaagcaccaggacaaggauuaguauggauggcauggguaaaagcaguaagcggagcaguaaauuauggaucauuagauuuuagacauagaguaucauuaacaagagauagagauuuaucaacagcacauauggauauaagaggauuaacacaagaugauacagcaacauauuuuugugcaagacaaaaauuugcaagaggagaucaaggaugguuuuuugauuuauggggaagaggaacauuaauaguaguaaguuca

SEQ ID NO: 48848 - RNA, 372 nt, Artificial Sequence
  derived and/or modified sequence opt6 from anti-HIV-1_HeavyChain
agagaacaauuaguacaaaguggagcagaaguaaaaaaaccaggagcaaguguaaaaguaagcuguaaaacaaguggaaauacauuuggaaguuaugauuuuaauuggguaagacaagcaccaggacaagggcuagaauggauaggauggguaaaaauaguaagcggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaaggggaggacaaggauggauauuugauuuauggggaagaggaacauuaauagcaguaaguagu

SEQ ID NO: 48849 - RNA, 372 nt, Artificial Sequence
  derived and/or modified sequence opt6 from anti-HIV-1_HeavyChain
caaguacaauuaguacaaagcggagcagaaguaaaaaaaccaggagcaaguguaaaaguaaguuguaaagcaaguggauauacauuuacaagcuauuauaugcauuggguaagacaagcaccaggacaaggauuagaauggauaggauggguaaaaacaguaacaggagcaguaaauuuuggaucaccaaauuuuagacauagaguaucauuaacaagagauagagauuuauuuacagcacauauggauauaagaggauuaacacaaggagauacagcaacauauuuuugugcaagacaaaaauauuaugcaggaggacaaggaugguauuuugauuuauggggaagaggaacguuaauaguaguaaguuca

SEQ ID NO: 48850 - RNA, 372 nt, Artificial Sequence
  derived and/or modified sequence opt6 from anti-HIV-1_HeavyChain
caaguacaacuaguacaaaguggagcagaaguaaaaaaaccaggagcaaguguaaaaguaaguuguaaagcaaguggauauacauuuacaaguuauuauaugcauuggguaagacaagcaccaggacaaggauuagaauggauaggauggguaaaaacaguaacaggaacaguaaauuuuggaucauuaaauuuuagacaaagaguaucauuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguuca

SEQ ID NO: 48851 - RNA, 372 nt, Artificial Sequence
  derived and/or modified sequence opt6 from anti-HIV-1_HeavyChain
caaguacaauuaggacaaaguggagcagaaaugaaaaaaccaggaaguaguguaaaaguaaguuguaaagcaaguggaggaacauuuagacauaguccaauaaguuggguaagacaagcaccaggacaaggacuagaauggauaggauggguaaaagcaguaaguggagcaguaaauuauggaaguuuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaagcagu

SEQ ID NO: 48852 - RNA, 369 nt, Artificial Sequence
  derived and/or modified sequence opt6 from anti-HIV-1_HeavyChain
caaguacaauuaguacaaaguggagcagaaguaagaacaccaggagcaaguguaaaaguaaguuguaaagcaaguggauauaauuuuauagcauaucauguacauuggguaagacaagcaccaggacaaggauuaacauggaugggauggauaaauccagauaguggagauacaguauaugcacaaaauuuuguagauagaguaaugaugacaagaaauacaaguauacaaacaguauauuuagaauuaaauguauuaacauuagaagauacagcaacauauuuuugugcaagacaaaaauuugcaagaggagaucaaggaugguuuuuugauuuauggggaagaggaacacuaauaguaguaaguagu

SEQ ID NO: 48853 - RNA, 372 nt, Artificial Sequence
  derived and/or modified sequence opt6 from anti-HIV-1_HeavyChain
caaguacaauuaguacaaaguggagcagaaguaaaaaaaccaggagcaaguguaaaaguaaguuguaaagcaaguggauauacauuuacaguauauuauaugcauuggguaagacaagcaccaggaagaggauuagaauggauaggauggguaaaagcaguaaguggagcaguaaauuauggaucauuagauuuuagacauagaguaucauuaacaagagauagagauuuauuuacagcacauauggauauaagaggauuaacacaagaugauacagcaacauauuuuugugcaagacaaaaauuugcaagaggagaucaaggaugguuuuuugaucuauggggaagaggaacauuaauaguaguaaguuca

SEQ ID NO: 48854 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaaggagauacggcaacauauuuuugugcaagacaaaaauuugaaagaggaggacaaggaugguauuuugauuuauggggaagaggaacauuaauaguaguaaguagu

SEQ ID NO: 48855 - RNA, 372 nt, Artificial Sequence
  derived and/or modified sequence opt6 from anti-HIV-1_HeavyChain
caaguacaauuaguacaaaguggagcagaaguaaaaaaaccaggagcaaguguaaaaguaaguuguaaagcaaguggauauacauucauaggauauuauaugcauuggguaagacaagcaccaggacaaggauuagaauggaugggauggguaaaaacaguaacaggagcaguaaauuuuggaucaccaaauuuuagacauagaguaucauuaacaagagauagagauuuauuuacagcacauauggauauaagaggacuaacacaaggagauacagcaacauauuuuugugcaagacaaaaauuugaaagaggaggacaaggaugguauuuugauuuauggggaagaggaacauuaauaguaguaaguuca

SEQ ID NO: 48856 - RNA, 375 nt, Artificial Sequence
  derived and/or modified sequence opt6 from anti-HIV-1_HeavyChain
caagcacaucuagaacaaaguggaaguggaguaaaaaaaccaggagcaaguguaagaguaagcuguuggacaagugaagauauauuugaaagaacagaauuaauacauuggguaagacaagcaccaggacaaggauuagaauggauaggauggguaaaaacaguaaguggagcaguaaauuuuggaaguuuaaauuuuagacauagaguaaguuuaacaagagauagagauuuauuuacagcacauauggauauaagaggauuaacacaaggagauacagcaacauauuuuugugcaagacaaaaauuugcaagaggagaucaaggaugguuuuuugaucuauggggaagaggaacauuaauaguaguaaguagu

SEQ ID NO: 48857 - RNA, 372 nt, Artificial Sequence
  derived and/or modified sequence opt6 from anti-HIV-1_HeavyChain
caagcacauuuagaacaaaguggaaguggaguaaaaaaauugggagcaaguguaagaguaaguuguuggacaagugaagauauauuuaaagauagaauagaucauuggguaagacaagcaccaggacaaggauuagaauggauaggauggguaaaagcaguaaguggagcaguaaauuauggaucauuagauuuuagacauagaguaucauuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguuca

SEQ ID NO: 48858 - RNA, 375 nt, Artificial Sequence
  derived and/or modified sequence opt6 from anti-HIV-1_HeavyChain
caaguacaauuagcacaaaguggagcagaaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcagugaauuauggaaguuuagauuuuagacauagaguaaguuuaacaagagauagagauuuauuuacagcacauauggauauaagaggauuaacacaagaugauacagcaauauauuuuugugcaagacaaaaauuugcaagaggagaucaaggaugguuuuuugauuuauggggaagaggaacacuaauaguaguaaguagu

SEQ ID NO: 48859 - RNA, 372 nt, Artificial Sequence
  derived and/or modified sequence opt6 from anti-HIV-1_HeavyChain
caagcacaucuagaacaaaguggaaguggaguaaaaaaaccaggagcaaguguaagagugaguuguuggacaagugaagauauaaguaaagcagaauuaauacauuggguaagacaagcaccaggacaaggauuagaauggauaggauggguaaaaacaguaaguggagcaguaaauuuuggaucaccaaauuuuagacauagaguaucauuaacaagagauagagaucuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguuca

SEQ ID NO: 48860 - RNA, 372 nt, Artificial Sequence
  derived and/or modified sequence opt6 from anti-HIV-1_HeavyChain
acagcacauuuagaacaaaguggaaguggaguaagaagaccaggagcaaguguaagaguaaguuguuggacaaguggagauauauuuaaaagcgaauuaauacauuggguaagacaagcaccaggacaaggauuagaauggauaggauggguaaaaacaguaacaggagcaguaaauuuuggaucaagugauuuuagacaaagaguaucauuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguuca

SEQ ID NO: 48861 - RNA, 372 nt, Artificial Sequence
  derived and/or modified sequence opt6 from anti-HIV-1_HeavyChain
caagcgcauuuagaacaaaguggaaguggaguaaaaagaccaggagcaaguguaagaguaaguuguuggacaagugaagauauauuuaauacagaauuaauacauuggguaagacaagcaccaggacaaggauuagaauggauaggauggguaaaaacaguaaguggagcaguaaauuuuggaucauuaaauuuuagacauagaguaucauuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguuca

SEQ ID NO: 48862 - RNA, 372 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuuaaaacagaauuaauacauuggguaagacaagcaccaggacaaggauuagaauggauaggauggguaaaagcaguaaguggagcagugaauuauggaucauuagauuuuagacauagaguaucauuaacaagagauagagauuuaucaacagcacauauggauauaagaggauuaacacaagaugauacagcaacauauuuuugugcaagacaaaaauuugcaagaggagaucaaggaugguuuuuugaucuauggggaagaggaacauuaauaguaguaaguuca

SEQ ID NO: 48863 - RNA, 372 nt, Artificial Sequence
  derived and/or modified sequence opt6 from anti-HIV-1_HeavyChain
caaguacaauuaguacaaaguggagcagaaguaaaaaaaccaggagcaaguguaagaguaaguuguaaagcaaguggauauacauuuacagcauauuauauacauuggguaagacaagcaccaggacaaggauuagaauggauaggauggguaaaaacaguaaguggagcaguaaauuuuggaucaccaaauuuuagacauagaguaucacuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 48864 - RNA, 372 nt, Artificial Sequence
  derived and/or modified sequence opt6 from anti-HIV-1_HeavyChain
caagcacauuuagaacaaaguggaagugaaaguaaaaaaccaggagcaaguguaagaguaaguuguuggucaagugaagauauauuuaaaacagaauuaauacauuggguaagacaagcaccaggacaaggauuagaauggauaggauggguaaaaauaguaaguggagcaguaaauuuuggaucaccaaauuuuagacaaagaguaucauuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguuca

SEQ ID NO: 48865 - RNA, 375 nt, Artificial Sequence
  derived and/or modified sequence opt6 from anti-HIV-1_HeavyChain
caagcacaucuagaacaaagcggaagugaaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagcgauuuuagacaaagaguaaguuuaacaagagauagagauuuauuuacagcacauauggauauaagaggacuaacacaaggagauacagcaacauauuuuugugcaagacaaaaauuuuaugcaggaggacaaggaugguauuuugauuuauggggaagaggaacauuaauaguaguaaguagu

SEQ ID NO: 48866 - RNA, 372 nt, Artificial Sequence
  derived and/or modified sequence opt6 from anti-HIV-1_HeavyChain
caagcacauuuagaacaaguaugggcaggaguaaaaaaauuaggagcaaguguaagaguaaguuguuggacaagugaagauauauuuaaaacagaauuaauacauuggguaagacaagcaccaggacaaggauuagaauggauaggauggguaaaagcaguaaguggagcaguaaauuauggaaguuuagauuuuagacauagaguaaguuuaacaagagauagagaucuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48867 - RNA, 372 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagugaagauauauuugaaagaucagaauuaauacauuggguaagacaagcaccaggacaaggauuagaauggauaggauggguaaaaacaguaacaggagcaguaaauuuuggaaguaauuuuagacaaagaguaucauuaacaagagauagagauuuauuuacagcacauauggauauaagaggauuaacacaaggagauacagcaacauauuuuugugcaagacaaaaauuuuaugcaggaggacaaggaugguauuuugauuuauggggaaggggaacauuaauaguaguaaguuca

SEQ ID NO: 48868 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaagcuguuggacaagugaagauauauuugauacaacagaauuaauauauuggguaagacaagcaccaggacaaggauuagaauggauaggauggguaaaaauaguaaguggaacaguaaauuuugcaaguuuagauuuuagacauagaguaaguuuaacaagagauagggauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48869 - RNA, 375 nt, Artificial Sequence
  derived and/or modified sequence opt6 from anti-HIV-1_HeavyChain
caagcacauuuagaacaaaguggaaguggaguaaaaaaaccaggaacaaguguaagaguaaguuguuggacaagcgaagauauauuugaaagaacagaauuaauacauuggguaagacaagcaccaggacaaggauuagaauggauaggguggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagu

SEQ ID NO: 48870 - RNA, 375 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaaguggaggaauauuugaaagaacagaacuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 48871 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaagcuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaagcagu

SEQ ID NO: 48872 - RNA, 372 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuuaaaagugaauuaauacauuggguaagacaagcaccaggacaaggauuagaauggauaggauggguaaaaacaguaacaggagcaguaaauuuuggaaguagugauuuuagacaaaggguaaguuuaacaagagauagagauuuauuuacagcacauauggauauaagaggauuaacacaaggagauacagcaacauauuuuugugcaagacaaaaauuugaaagaggaggacaaggauggauauuugaucuauggggaagaggaacauuaauagcaguaaguagu

SEQ ID NO: 48873 - RNA, 375 nt, Artificial Sequence
  derived and/or modified sequence opt6 from anti-HIV-1_HeavyChain
caagcacauuuagaacaaaguggaaguggaguaaaaagaccaggagcaaguguaagaguaagcuguuggacaagugaagauauauuugaaacaacagaauuaauacauuggguaagacaagcaccaggacaaggauuagaauggauaggauggguaaaaacaguaaguggagcaguaaauuuuggaaguuuaaauuuuagacauagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagu

SEQ ID NO: 48874 - RNA, 375 nt, Artificial Sequence
  derived and/or modified sequence opt6 from anti-HIV-1_HeavyChain
caagcacauuuagaacaaaguggaaguggaguaaaaaaauuaggagcaagcguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacaaagagugaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48875 - RNA, 372 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggacaagugaagauauauuugaaaaaucagaauuaauacauuggguaagacaagcaccaggacaaggauuagaauggauaggauggguaaaaacaguaacaggagcaguaaauuuaguacaucaaauaucagauagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguuca

SEQ ID NO: 48876 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaaaaagugaauuaauacauuggguaagacaagcaccaggacaaggauuagaauggauaggauggguaaaaacaguaacaggagcaguaaauuuuggaagcagugauuuuagacaaagaguaaguuuaacaagaggaagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48877 - RNA, 375 nt, Artificial Sequence
  derived and/or modified sequence opt6 from anti-HIV-1_HeavyChain
caagcacaucuagaacaaaguggagcaggaguaaaaaaaccaggagcaaguguaagaguaaguuguuggacaagugaagauauauuugaaagaacagaacuaauacauuggguaagacaagcaccaggacaaggauuagaauggauaggauggguaaaaacaguaacaggagcaguaaauuuuggaagcccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagc

SEQ ID NO: 48878 - RNA, 375 nt, Artificial Sequence
  derived and/or modified sequence opt6 from anti-HIV-1_HeavyChain
caaagucauuuagaacaaaguggaagcgcaaugaaaaaaccaggagcaaguguaaggguaaguuguuggacaagugaagauauauuugauacaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48879 - RNA, 372 nt, Artificial Sequence
  derived and/or modified sequence opt6 from anti-HIV-1_HeavyChain
caagcacauuuagaacaaagcggaaguggaguaaaaaaaccaggagcaaguguaagaguaagcuguuggacaagugaagauauauuuaaaacagaauuaauacauuggguaagacaagcaccaggacaaggauuagaauggauaggauggguaaaaacaguaaguggagcaguaaauuuuggaaguccaaauuuuagacauagaguaucauuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacacuaauaguaguaaguuca

SEQ ID NO: 48880 - RNA, 375 nt, Artificial Sequence
  derived and/or modified sequence opt6 from anti-HIV-1_HeavyChain
caaguacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuaggcauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacacuaauaguaguaaguagu

SEQ ID NO: 48881 - RNA, 372 nt, Artificial Sequence
  derived and/or modified sequence opt6 from anti-HIV-1_HeavyChain
caagcacauuuagaacaaagugcaaguggaguaaaaagaccgggagcaaguguaagaguaaguuguuggacaagugaagauauauuugaaagaucagaauuaauauauuggguaagacaagcaccaggacaaggauuagaauggauaggauggguaaaaacaguaucaggagcaguaaauuuagcaccaaauuuuagacaaagaguaucauuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguuca

SEQ ID NO: 48882 - RNA, 372 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuuaaaagugaauuaauacauuggguaagacaagcaccaggacaaggauuagaauggauaggauggguaaaaacaguaacaggagcaguaaauuuuggaucaagugauuuuagacaaagaguaucauuaacaagagauggagauuuauuuacagcacauauggauauaagaggauuaacacaaggagauacagcaacauauuuuugugcaagacaaaaauuuuaugcaggaggacaaggaugguauuuugauuuauggggaagaggaacguuaauaauaguaaguuca

SEQ ID NO: 48883 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggacuagaauggauaggauggguaaaagcaguaaguggagcaguaaauuauggaagcuuagauuuuagacauagaguaaguuuaacaagugauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48884 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauugggugagacaagcaccaggacaaggauuagaauggauaggauggguaaaaacaguaacgggagcaguaaauuuuggaaguagugacuuuagacaaagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaagcagu

SEQ ID NO: 48885 - RNA, 372 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuuaaaagugaacuaauacauuggguaagacaagcaccaggacaaggauuagaauggauaggauggguaaaaacaguaacaggagcaguaaauuuuggaucaagugauuuuagacaaagaguaucacuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguuca

SEQ ID NO: 48886 - RNA, 372 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggacaagugaagauauauuugaaaaaucagaauuaauacauuggguaagacaagcaccaggacaaggauuagaauggauaggauggguaaaaacaguaacaggagcaguaaauuuuggacaucaaauaucagauagaguaaguuuaacaagagauagagauuuauuuacagcacauauggauauaagaggauuaacacaaggagauacagcaacauauuuuugugcaagacaaaaauuuuaugcaggaggacaaggaugguauuuugaucuauggggaagaggaacauuaauaguaguaaguuca

SEQ ID NO: 48887 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaagucuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48888 - RNA, 372 nt, Artificial Sequence
  derived and/or modified sequence opt6 from anti-HIV-1_HeavyChain
caagcgcauuuagaacaaaguggaaguggaguaaaaaaauuaggagcaaguguaagaguaagcuguuggacaagcgaagauauauuaaaaacagaauuaauacauuggguaagacaagcaccaggacaaggauuagaauggauaggauggguaaaagcaguaaguggagcaguaaauuauggaucauuagauuuuagacauagaguaucauuaacaagagauagagauuuauuuacagcacauauggauauaagaggacuaacacaagaugauacagcaacauauuuuugugcaagacaaaaauuugcaagaggagaucaaggaugguuuuuugauuuauggggaagaggaacauuaauaguaguaagcuca

SEQ ID NO: 48889 - RNA, 372 nt, Artificial Sequence
  derived and/or modified sequence opt6 from anti-HIV-1_HeavyChain
guaagaaguguaguacaaugugaagcaggaguaaaaaaaccaggagcaaguguaaaaauaaguugugcaacaaguggauaugcauuuacauuauauuauuuacauuggguaagacaagcaccaggacaaggauuagaauggauaggauggguaaaaacaguaacaggagcaguaaauuuuggaucagcauauuuuagacauagaguaucauuaacaccagauagagauuuauuuacagcacauauggauauaagaggauuaacacaaggagauacagcaacauauuuuugugcaagacaaaaauuuuauaaaggaggacaaggaugguauuuugauuuauggggaagaggaacauuaauaguaguaagcagu

SEQ ID NO: 48890 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuuagauagugaagauauauuugaaagaacagaauuaauacauuggguaagacaagcaccaggacaaggauuagaauggauaggauggguaaaagcaguaaguggagcagugaauuauggaaguuuagauuuuagacauagaguaaguuuaacaagagauagagauuuauuuacagcgcauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48891 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagcgaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaaguagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48892 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaaaaaguaguuguuggacaagcgaagauauauuugaaagaacagaauuaauacauuggguaagacaagcaccaggacaaggauuagaauggauaggauggguaaaagcaguaaguggagcaguaaauuauggaaguuuagauuuuagacauagaguaagcuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48893 - RNA, 375 nt, Artificial Sequence
  derived and/or modified sequence opt6 from anti-HIV-1_HeavyChain
caagcacauuuagaacaaaguggagcaggaguaaaaaaaccaggagcaaguguaagaguaaguuguuggacaagugaagauauauuugaaagaacagaauuaauacauuggguaagacaagcaccagggcaaggauuagaauggauaggauggguaaaaauaguaaguggagcaguaaauuuuggaaguccaaauuuuagacaaagaguaagcuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaucaagu

SEQ ID NO: 48894 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggaugaaaacaguaacaggagcaguaaauuuuggaaguccaaauuuuagacauagaguaaguuuaacaagagauagagauuuauuuacagcacauauggauauaagaggauuaacgcaaggagauacagcaacauauuuuugugcaagacaaaaauuugaaagaggaggacaaggaugguauuuugaucuauggggaagaggaacauuaauaguaguaaguagu

SEQ ID NO: 48895 - RNA, 375 nt, Artificial Sequence
  derived and/or modified sequence opt6 from anti-HIV-1_HeavyChain
caagcacauuuagaacaaaguggaagugaaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagacagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 48896 - RNA, 375 nt, Artificial Sequence
  derived and/or modified sequence opt6 from anti-HIV-1_HeavyChain
caagcacauuuagaacaaagcggagcaggaguaaaaaaauuaggagcaaguguaagaguaaguuguuggacaaguggagauauauuugaaagaacagaauuaauacauuggguaagacaagcaccaggacaaggacuagaauggauaggauggguaaaagcaguaagcggagcaguaaauuauggaaguuuagauuuuagacaaagaguaaguuuaacaagagauagagauuuauuuacagcacauauagauauaagaggacuaacacaaggggauacagcaacauauuuuugugcaagacaaaaauuugaaagaggaggacaaggauggauauuugauuuauggggaagaggaacauuaauagcaguaaguagu

SEQ ID NO: 48897 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguugggcaagugaagauauauuugaaagaacagaauuaauacauuggguaagacaagcaccaggacaaggauuagaauggauaggauggguaaaagcaguaaguggagcaguaaauuauggaagucuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48898 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggaacaguaaauuuuggaagucaaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacacuaauagcaguaaguagu

SEQ ID NO: 48899 - RNA, 375 nt, Artificial Sequence
  derived and/or modified sequence opt6 from anti-HIV-1_HeavyChain
caagcacauuuagaacaaaguggaaguggaguaaaaagaccaggagcaaguguaagaguaaguuguuggacaagugaagauauauuugaaacaacagaauuaauacauuggguaagacaagcaccaggacaaggauuagaauggauaggauggguaaaaacaguaacaggagcaguaaauuuuggaaguccaaauuuuagacauaggguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 48900 - RNA, 375 nt, Artificial Sequence
  derived and/or modified sequence opt6 from anti-HIV-1_HeavyChain
caagcacauuuagaacaaaguggaaguggaguaaaaaaaccaggagcaucaguaagaguaaguuguuggacaagugaagauauauuaagaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggacuaacacaaggagauacagcaacauauuuuugugcaagacaaaaauuuuaugcaggaggacaaggaugguauuuugauuuauggggaagaggaacauuaauaguaguaagcagc

SEQ ID NO: 48901 - RNA, 372 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuuaaaacagaauuaauacauuggguaagacaagcaccaggacaaggauuagaauggauaggauggguaaaaacaguaacaggaacaguaaauuuuggaucauuaaauuuuagacaaagaguaucauuaacaagagauagagauuuauuuacagcacauauggauauaagaggauuaacacaaggagacacagcaacauauuuuugugcaagacaaaaauuuuaugcaggaggacaaggaugguauuuugauuuauggggaagaggaacauuaauaguaguaaguuca

SEQ ID NO: 48902 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48903 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggacuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48904 - RNA, 375 nt, Artificial Sequence
  derived and/or modified sequence opt6 from anti-HIV-1_HeavyChain
caaguacaauuaguacaaaguggagcagaaguaaaaaaaccaggagcaaguguaagaguaaguuguuggacaagugaagauauauuugaaagaagugaauuaauauauuggguaagacaagcaccaggaagaggauuagaauggauaggauggauaaaauuaguaaguggagcaguaaauuuuggaaguguagauuuuagagauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48905 - RNA, 375 nt, Artificial Sequence
  derived and/or modified sequence opt6 from anti-HIV-1_HeavyChain
caagcacauuuagaacaaaguagaaguggaguaaaaaaaccaggagcaaguguaagaguaagcuguuggacaagcgaagauauauuugaaagaacggaauuaauacauuggguaagacaagcaccaggacaaggauuagaauggauaggauggguaaaagcaguaaguggagcaguaaauuuuggaaguccaaauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaagcagu

SEQ ID NO: 48906 - RNA, 375 nt, Artificial Sequence
  derived and/or modified sequence opt6 from anti-HIV-1_HeavyChain
caaaguuauuuagaacaaaguggaagugcaaugaaaaaaccaggagcaagcguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaagcagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48907 - RNA, 375 nt, Artificial Sequence
  derived and/or modified sequence opt6 from anti-HIV-1_HeavyChain
caagcacaucuagaacaaaguggaaguggaguaaaaaaaccaggagcaaguguaagaguaaguuguuggacaagugaagauauauuugaaaaaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuaugggggagaggaacauuaauaguaguaaguagu

SEQ ID NO: 48908 - RNA, 372 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagugaagauauauuuaaaagugaauuaauacauuggguaagacaagcaccaggacaaggauuagaauggauaggauggguaaaaacaguaacaggagcaguaaauuuuggaucaagugauuuuagacaaagaguaucauuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguuca

SEQ ID NO: 48909 - RNA, 375 nt, Artificial Sequence
  derived and/or modified sequence opt6 from anti-HIV-1_HeavyChain
caagcacauuuagaacaaaguggaaguggagugaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48910 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaagcccaaauuuuagacaaagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagu

SEQ ID NO: 48911 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaaggacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48912 - RNA, 375 nt, Artificial Sequence
  derived and/or modified sequence opt6 from anti-HIV-1_HeavyChain
caaagucauuuagaacaaagcggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacagugaauuuugcaaguuuagauuuuagaaauagaauaaguuuaaguagagauagagauuuaagcacagcacauauggauauaagaggacuaacacaaggagauacagcaacauauuuuugugcaagacaaaaauuugaaagaggaggacaaggaugguauuuugauuuauggggaagaggaacauuaauaguaguaaguagu

SEQ ID NO: 48913 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaagcuguuggacaagugaagauauauuugauacaacagaauuaauauauuggguaagacaagcaccaggacaaggauuagaauggauaggauggguaaaaauaguaaguggaacaguaaauuuugcaaguuuagauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 48914 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggaacaguaaauuuuggaaguuuaaauuuuagacaaagaguaaguuuaacaagggauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 48915 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggacuaacacaaggagauacagcaacauauuuuugugcaagacaaaaauuugaaagaggaggacaaggaugguauuuugauuuauggggaagaggaacauuaauaguaguaaguagu

SEQ ID NO: 48916 - RNA, 375 nt, Artificial Sequence
  derived and/or modified sequence opt6 from anti-HIV-1_HeavyChain
agacauacaguagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacgagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 48917 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuucagacaaagaguaaguuuaacaagagauagagauuuauuuacagcacauauggauauaagaggauuaacacaaggagauacagcaacauauuucugugcaagacaaaaauuugaaagaggaggacaaggaugguauuuugauuuauggggaagaggaacauuaauaguaguaaguagu

SEQ ID NO: 48918 - RNA, 375 nt, Artificial Sequence
  derived and/or modified sequence opt6 from anti-HIV-1_HeavyChain
agacauacaugggaacaaagcggaaguggaguaaaaaaauuaggagcaaguguaagaguaagcuguuggacaagugaagauauauuugaaagaacagaauuaauacauuggguaagacaagcaccaggacaaggauuagaauggauaggauggaugaaagcaguaaguggagcaguaaauuauggaagucuagauuuuagacauagaguaaguuuaacaagagauagagauuuaaguacagcacauauagauauaagaggauuaacgcaagaugauacagcaacauauuuuugugcaagacaaaaauuugcaagaggagaucaaggaugguuuuuugaucuauggggaagaggaacauuaauaguaguaaguagu

SEQ ID NO: 48919 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccgggacaaggauuagaauggauaggauggguaaaaacaguaacaggagcaguaaauuuuggaaguccaaauuuuaggcauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacacuaauaguaguaaguagu

SEQ ID NO: 48920 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 48921 - RNA, 375 nt, Artificial Sequence
  derived and/or modified sequence opt6 from anti-HIV-1_HeavyChain
caagcacaucuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggaugggugaaaacaguaacaggggcaguaaauuuuggaucaagugauuuuagacauagaguaaguuuaacaagagauagagauuuauuuacagcacauauggauauaagaggauuaacacaaggagauacagcaacauauuuuugugcaagacaaaaauauuaugcaggaggacaaggaugguauuuugauuuauggggaagaggaacauuaauaguaguaagcagu

SEQ ID NO: 48922 - RNA, 375 nt, Artificial Sequence
  derived and/or modified sequence opt6 from anti-HIV-1_HeavyChain
caagcacauuuagaacaaaguggaucaggaguaaaaaaaccaggagcaaguguaagaguaagcuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaagcuuaacaagagauagagauuuauuuacagcacauaugggaauaagaggauuaacacaaggagauacagcaacauauuuuugugcaagacaaaaauuuuaugcaggaggacaaggaugguauuuugauuuauggggaagaggaacauuaauaguaguaaguagc

SEQ ID NO: 48923 - RNA, 375 nt, Artificial Sequence
  derived and/or modified sequence opt6 from anti-HIV-1_HeavyChain
caagcacauuuagaacaaaguggaagcggaguaaaaaaaccaggagcaagcguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguauuuuuaacaagagauagagauuuauuuacagcacauauggauauaagaggauuaacacaaggagauacggcaacauauuuuugugcaagacaaaaauuuuaugcaggaggacaaggaugguauuuugauuuauggggaagaggaacauuaauaguaguaaguagu

SEQ ID NO: 48924 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaagaacagaauuaauacauuggguaagacaagcaccagggcaaggauuagaauggauaggauggguaaaagcaguaaguggagcaguaaauuauggaaguuuagauuuuagacauagaguaagucuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48925 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaagucaagauuuuagagauagauuuaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacacuaauaguaguaaguagu

SEQ ID NO: 48926 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugaugcaacaggauuaauauauuggguaagacaagcaccaggacaaggauuagaauggauaggauggguaaaaauaguaaguggaacaguaaauuuugcaaguuuagauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48927 - RNA, 375 nt, Artificial Sequence
  derived and/or modified sequence opt6 from anti-HIV-1_HeavyChain
caagcacauuuagaacaaagcggaaguggaguaaaaaaauuaggagcaaguguaagaguaagcuguuggacaagugaagauauauuugaaagaacagaauuaauacauuggguaagacaagcaccaggacaaggauuagaauggauaggauggguaaaagcaguaagcggagcaguaaauuauggaaguuuagauuuuagacauagaguaaguuuaacaagagauagagauuuaaguacagcauauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48928 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaauauauuuaugugcaagacaaaaauuugcaagaggagaucaaggaugguuuuuugauuuauggggaagaggaacauuaauaguaguaaguagu

SEQ ID NO: 48929 - RNA, 375 nt, Artificial Sequence
  derived and/or modified sequence opt6 from anti-HIV-1_HeavyChain
caaucacauuuagaacaaagcgggagugcaaugaaaaaaccaggagcaaguguaagaguaagcuguuggacaagugaagauauauuugauacaacagaauuaauauauuggguaagacaagcaccaggacaaggauuagaauggauaggauggguaaaaauaguaucaggaacaguaaauuuugcaaguuuagacuuuagaaauagaauaaguuuaaguagagacagagauuuaaguacagcacauauggauauaagaggauuaacacaaggagauacagcaacauauuucugugcaagacaaaaauuugaaagaggaggacaaggauggauauuugacuuauggggaagaggaacauuaauagcaguaaguagc

SEQ ID NO: 48930 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaaaaagugaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacguuaauaguaguaaguagu

SEQ ID NO: 48931 - RNA, 375 nt, Artificial Sequence
  derived and/or modified sequence opt6 from anti-HIV-1_HeavyChain
caagcacauccagaacaaaguggaaguggaguaaaaaaaccaggagcaaguguaagaguaucauguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugaucuauggggaagaggaacauuaauaguaguaaguagu

SEQ ID NO: 48932 - RNA, 375 nt, Artificial Sequence
  derived and/or modified sequence opt6 from anti-HIV-1_HeavyChain
agagcacauuuagaacaaaguggaaguggaguaagaaaaccaggagcaagcguaagaguaaguuguuggacaagugaagauauauuugaaaaaagugaauuaauacauuggguaaggcaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagc

SEQ ID NO: 48933 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaaggggaacacuaauagcaguaagcagu

SEQ ID NO: 48934 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugaaaaaagugaauuaauacauuggguaaggcaagcaccaggacaaggacuagaauggauaggauggguaaaaacaguaacaggagcaguaaauuuuggaaguagugauuuuagacaaagaguaagucuaacaagagauagagauuuauuuacagcgcauauggauauaagaggacuaacacaaggagauacagcaacauauuuuugugcaagacaaaaauuuuaugcaggaggacaaggaugguauuuugauuuauggggaagaggaacauuaauaguaguaaguagu

SEQ ID NO: 48935 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggacuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacacauauaguaguaaguagu

SEQ ID NO: 48936 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaggacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 48937 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguagugauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48938 - RNA, 375 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48939 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaagugaauuaauacauuggguaagacaagcaccaggacaaggauuagaauggauaggauggguaaaaacaguaacaggagcaguaaauuuuggaaguccaaauuuuagacaaagaguaaguuuaacaagagauagagauuuauuuacagcacauauggauauaagaggacuaacagaaggagauacagcaacauauuuuugugcaagacaaaaauuuuaugcaggaggacaaggaugguauuuugauuuauggggaagaggaacauuaauaguaguaaguagu

SEQ ID NO: 48940 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcagcaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48941 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaaguggagcaguaaauuuuggaaguccaaauuuuagacauagaguaagcuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 48942 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaagcggagcaguaaauuuuggaaguccaaauuuuaggcauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaagcagu

SEQ ID NO: 48943 - RNA, 375 nt, Artificial Sequence
  derived and/or modified sequence opt6 from anti-HIV-1_HeavyChain
caagcacauuuagaacaaaguggaagcgggguaaaaaaaccaggagcaagcguaagaguaaguuguuggacaagugaagauauauuugaaagaacagaauuaauacauuggguaagacaagcaccaggacaaggauuagaauggauaggauggguaaaaauaguaaguggagcaguaaauuuuggaagcccaaauuuuagacaaagaguaaguuuaacaagagauagagauuuauuuacagcacauauggauauaagaggauuaacacaaggagauacagcaacauauuuaugugcaagacaaaaauuugaaagaggaggacaaggauggauauuugauuuauggggaagaggaacauuaauagcaguaaguagu

SEQ ID NO: 48944 - RNA, 375 nt, Artificial Sequence
  derived and/or modified sequence opt6 from anti-HIV-1_HeavyChain
caagcacauuuagaacaaaguggaaguggagugaaaaaaccaggagcaaguguaagaguaaguuguuggaguagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagc

SEQ ID NO: 48945 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggaacaguaaauuuuggaaguuuaaauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48946 - RNA, 375 nt, Artificial Sequence
  derived and/or modified sequence opt6 from anti-HIV-1_HeavyChain
caagcacauuuagaacaaagugcaaguggaguaaaaagaccaggagcaaguguaagaguaaguuguuggacaagugaagauauauuugaaagaagugaacuaauauauuggguaagacaagcaccaggacaaggauuagaauggauaggauggguaaaaacaguaaguggagcaguaaauuuuggaaguacagauuuuagagaaagaguaaguuuaacaagagauagagaucuauuuacagcacauauggauauaagaggauuaacacaaggagauacagcaacauauuuuugugcaagacaaaaauuugcaagaggagaucaaggaugguucuuugauuuauggggaagaggaacauuaauaguaguaaguagu

SEQ ID NO: 48947 - RNA, 375 nt, Artificial Sequence
  derived and/or modified sequence opt6 from anti-HIV-1_HeavyChain
caaguacaucuagaacaaaguggaaguggaguaaaaaaaccaggagcaagcguaagaguaucauguuggacaagugaagauauauuugaaagaagugaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauauuaugcaggaggacaaggaugguauuuugauuuauggggaagaggaacauuaauaguaguaaguagu

SEQ ID NO: 48948 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaagcagugauuuuagacaaagaguaaguuuaacaagagauagagauuuauuuacagcacauauggauauauguggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48949 - RNA, 375 nt, Artificial Sequence
  derived and/or modified sequence opt6 from anti-HIV-1_HeavyChain
caagcacauuuagaacaaaguggaaguggaguaaaaaaaccagaagcaucaguaagaguaaguuguuggacaagugaagauauauuugaaaaaagugaauuaauacauuggguaagacaagcaccaggacaaggauuagaauggauaggauggguaaaaacagugacaggagcaguaaauuuuggaaguagugauuuuagacaaagaguaagucuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48950 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacaaagaguaagcuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 48951 - RNA, 375 nt, Artificial Sequence
  derived and/or modified sequence opt6 from anti-HIV-1_HeavyChain
caagcacaucuagaacaaagugcaaguggaguaaaaagaccaggagcaaguguaagaguaaguuguuggacaagugaagauauauuugaaagaacagaacuaauauauuggguaagacaagcaccaggacaaggauuagaauggauaggauggguaaaaacaguaaguggagcaguaaauuuuggaagucaagauuuuagagauagauuuaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 48952 - RNA, 375 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaaaaagugaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 48953 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauccauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 48954 - RNA, 375 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagugaagauauauuugaaaaaaguggacuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48955 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaaaaagugaauuaauacauuggguaagacaagcaccaggacaaggauuagaauggauaggauggguaaaagcaguaaguggaacaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaagcagu

SEQ ID NO: 48956 - RNA, 375 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagugaagauauauuugaaggaagugaauuaauacauuggguaagacaagcaccaggacaaggauuagaauggauaggauggguaaaaacaguaacaggagcaguaaauuuuggaagugcauauuuuagacauagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48957 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggaguagugaagauauauuugaaagaacagaacuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48958 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaaggcaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggauuaacacaagaugauacagcaacacauuuuugugcaagacaaaaauuugcaagaggagaucaaggaugguuuuuugauuuauggggaagaggaacauuaauaguaguaaguagu

SEQ ID NO: 48959 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaggaacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 48960 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48961 - RNA, 375 nt, Artificial Sequence
  derived and/or modified sequence opt6 from anti-HIV-1_HeavyChain
caagcacauuuagaacaaaguggaaguggaguaaaaaaaccaggagcaagugugagaguaaguuguuggacaagugaagauauauuugaaggaagugaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 48962 - RNA, 375 nt, Artificial Sequence
  derived and/or modified sequence opt6 from anti-HIV-1_HeavyChain
caagcacauuuagaacaaaguggaaguggaguaaaaaaaccaggagcaucaguaagaguaagcuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaucaagu

SEQ ID NO: 48963 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaaggaauauuugaaagaacagaauuaauacauuggguaagacaagcaccaggacaaggauuagaauggauaggauggguaaaaauaguaaguggagcaguaaauuuuggaaguccaaauuuuagacaaagaguaagucuaacaagagauagagauuuauuugcagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 48964 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaagcuguuggacaagugaagauauauuugaaagagcagaauuaauacauuggguaaggcaagcaccaggacaaggauuagaauggauaggauggguaaaagcaguaaguggagcaguaaauuauggaagucuagauuuuagacauagaguaaguuuaacaagagauagagauuuauuuacagcacauauggauauaagaggauuaacacaagaugauacagcaauauauuuuugugcaagacaaaaauuuuaugcaggaggacaaggaugguauuuugauuuauggggaagaggaacauuaauaguaguaaguagu

SEQ ID NO: 48965 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacguuaauagcaguaaguagc

SEQ ID NO: 48966 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuauggaaguuuaaauuuuagaagcagaauaaguuuaacaagagauagagauuuauuuacagcacauauggauauaagaggauuaacagaaggagauacagcaacauauuuuugugcaagacaaaaauuuuaugcaggaggacaaggaugguauuuugauuuauggggaagaggaacauuaauaguaguaaguagu

SEQ ID NO: 48967 - RNA, 375 nt, Artificial Sequence
  derived and/or modified sequence opt6 from anti-HIV-1_HeavyChain
caagcacaucuagaacaaagcggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaagcggagcaguaaauuuuggaagcccaaauuuuagacaaagaguaaguuuaacaagggauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 48968 - RNA, 375 nt, Artificial Sequence
  derived and/or modified sequence opt6 from anti-HIV-1_HeavyChain
caagcacauuuagaacaaaguggaagcggaguaaaaaaauuaggagcaaguguaagaguaaguuguuggacaagugaagauauauuugaaagaacagaacuaauacauugggugagacaagcaccaggacaaggauuagaauggauaagauggguaaaagcaguaaguggagcaguaaauuauggaaguuuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48969 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguagugauuuuagacaaagaguaucauuaacaagagauagagauuuauuuacagcacaaauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48970 - RNA, 372 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacgagugaagauauauuugaaaaaucagaauuaauacauuggguaagacaagcaccaggucaaggauuagaauggauaggauggguaaaaacaguaacaggagcaguaaauuuugcacaucaaauaucagauagaguaucauuaacaagagauagagauuuauuuacagcgcauauggauauaagaggauuaacacaaggagauacagcaacauauuuuugugcaagacaaaaauuuuaugcaggaggacaaggaugguauuuugauuuauggggaagaggaacauuaauaguaguaaguuca

SEQ ID NO: 48971 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaguaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 48972 - RNA, 375 nt, Artificial Sequence
  derived and/or modified sequence opt6 from anti-HIV-1_HeavyChain
caaguacauuuagaacaaaguggaucaggaguaaaaaaaccaggagcaaguguaagaguaaguuguuggacaagugaagauauauuugaaaaaagugaacuaauacauuggguaagacaagcaccaggacaaggauuagaauggauaggauggguaaaaacaguaacaggagcaguaaauuuuggaagcagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48973 - RNA, 375 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggaguagcgaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 48974 - RNA, 375 nt, Artificial Sequence
  derived and/or modified sequence opt6 from anti-HIV-1_HeavyChain
caaagucauuuagaacaaucaggaucagcaaugaaaaaaccaggagcaucaguaagaguaucaugcuggacaucagaagauauauuugacacaacagaauuaauauacuggguaagacaagcaccaggacaaggacuagaauggauaggauggguaaaaauaguaagcggaacaguaaauuuugcaucacuagauuucagaaacagaauaucacuaucaagagauagagauuuaucaacagcauacauggacauaagaggacuaacacaagaugacacagcaacauauuuuugcgcaagacaaaaauuugcaagaggagaucaaggaugguuuuuugauuuauggggaagaggaacacuaauaguaguaagcuca

SEQ ID NO: 48975 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaacaguaacaggagcaguaaauuuuggaagcccaaauuuuagacauaggguaaguuuaacaagagauagagauuuauuuacagcacauauggauauaagaggauuaacacaaggagauacagcaacauauuuaugugcaagacaaaaauuugaaagaggaggacaaggaugguauuuugauuuauggggaagaggaacauuaauaguaguaaguagu

SEQ ID NO: 48976 - RNA, 372 nt, Artificial Sequence
  derived and/or modified sequence opt6 from anti-HIV-1_HeavyChain
agacauacaugggaacaaaguggaaguggaguaaaaaaaccaggagcaaguguaagaguaaguuguuggacaagugaagauauauuuaaaagugaauuaauacauuggguaagacaagcaccaggacaaggauuagaauggauaggauggguaaaaacaguaacaggagcaguaaauuuuggaucaagugauuuuaggcaaagaguaucauuaacaagagauagagauuuauuuacagcacauauggauauaagaggacuaacacaaggagauacagcaacauauuuuugugcaagacaaaaauuuuaugcaggaggacaaggaugguauuuugauuuauggggaagaggaacauuaauaguaguaaguuca

SEQ ID NO: 48977 - RNA, 375 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacagaaggagauacagcaacauauuuuugugcaagacaaaaauuuuaugcaggaggacaaggaugguauuuugauuuauggggaagaggaacauuaauaguaguaaguagu

SEQ ID NO: 48978 - RNA, 375 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaagugcauauuuuagacauagaguaaguuuaacaagagauagagauuuauuuacagcacauauggauauaagaggauuaacacaaggagauacagcaacguauuuuugugcaagacaaaaauuuuauaaaggaggacaaggaugguauuuugauuuauggggaagaggaacauuaauaguaguaaguagu

SEQ ID NO: 48979 - RNA, 375 nt, Artificial Sequence
  derived and/or modified sequence opt6 from anti-HIV-1_HeavyChain
caagcacauuuagaacaaaguggaccaggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 48980 - RNA, 375 nt, Artificial Sequence
  derived and/or modified sequence opt6 from anti-HIV-1_HeavyChain
agagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaaguuuaacaagggauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 48981 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48982 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaauauauuuuugugcaagacaaaaauuugcaagaggagaucaaggaugguuuuuugauuuauggggaagaggaacauuaauaguaguaaguagu

SEQ ID NO: 48983 - RNA, 375 nt, Artificial Sequence
  derived and/or modified sequence opt6 from anti-HIV-1_HeavyChain
caagcacauuuagaacaaaguggaaguggaguaaaaaaaguaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaagucuagauuuuagacauagaguaaguuuaacaagagauagagaucuauuuacagcacauauggauauaagaggauuaacacaagaugauacagcaauauauuuuugugcaagacaaaaauuugcaagaggagaucaaggaugguuuuuugauuuauggggaagaggaacauuaauaguaguaaguagu

SEQ ID NO: 48984 - RNA, 375 nt, Artificial Sequence
  derived and/or modified sequence opt6 from anti-HIV-1_HeavyChain
caaguacaauuaguacaaaguggagcagaauuaaaaaaaccaggaaguaguguaagaguaaguuguuggacaagugaagauauauuugaaggaagugaauuaauacauuggguaagacaagcaccaggacaaggauuagaauggauaggauggguaaaaacaguaacaggagcaguaaauuuuggaagugcauauuuuagacauagaguaaguuuaacaagagauagagauuuauuuacagcacauauggauauaagaggacuaacacaaggagauacagcaacauauuuuugugcaagacaaaaauuuuauaaaggaggacaaggaugguacuuugauuuauggggaagaggaacauuaauaguaguaaguagu

SEQ ID NO: 48985 - RNA, 375 nt, Artificial Sequence
  derived and/or modified sequence opt6 from anti-HIV-1_HeavyChain
caagcacauuuagaacaaagcggaaguggaguaaaaaaaccaggaguaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 48986 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaaguaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaagcagu

SEQ ID NO: 48987 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcagcauauuuuugugcaagacaaaaauuugcaagaggagaucaaggaugguuuuuugauuuauggggaagaggaacauuaauaguaguaaguagu

SEQ ID NO: 48988 - RNA, 375 nt, Artificial Sequence
  derived and/or modified sequence opt6 from anti-HIV-1_HeavyChain
caagcacauuuagaacaaaguggaaguggaguaagaaaaccaggagcaaguguaagaguaaguuguuggacaagugaagauauauuugaaaaaucagaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48989 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggaacaguaaauuuuggaaguuuaaauuuuagacaaagaguaaguuuaacaagagauagagauuuauuuacagcacauauggauauaagaggauuaacacaaggagauacagcaacauauuuuugugcaagacaaaaauuuuauaaaggaggacaaggaugguauuuugaucuauggggaagaggaacauuaauaguaguaaguagu

SEQ ID NO: 48990 - RNA, 375 nt, Artificial Sequence
  derived and/or modified sequence opt6 from anti-HIV-1_HeavyChain
caaagccauuuagaacaaaguggaagugcaaugaaaaaaccaggagcaagcguaagaguaaguuguuggacaagugaagauauauuugaaagaacagaauuaauacauuggguaagacaagcaccaggacaaggauuagaauggauaggauggguaaaagcaguaaguggagcaguaaauuauggaagcuuagauuuuagacauagaguaaguuuaacaagagauagagauuuauuuacagcacauauggauauaagaggacuaacacaagaugauacagcaacauauuuuugugcaagacaaaaauuugcaagaggagaucaaggaugguuuuuugauuuauggggaagaggaacauuaauaguaguaaguagu

SEQ ID NO: 48991 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagu

SEQ ID NO: 48992 - RNA, 375 nt, Artificial Sequence
  derived and/or modified sequence opt6 from anti-HIV-1_HeavyChain
caagcacauuuagaacaaaguggaaguggaguaaaaagaccaggagcaaguguaagaguaaguuguuggacaagugaagauauauuugaaacaacagaauuaauacauuggguaagacaagcaccaggacaaggauuagaauggauaggauggguaaaaacaguaaguggagcaguaaauuuuggaaguuuaaauuuuagacauagaguaaguuuaacaagagauagagauuuauuuacagcacauauggauauaagaggauuaacacaaggagauacagcaacauauuuuugugcaagacaaaaauuuuauaaaggaggacaaggaugguauuuugacuuauggggaagaggaacauuaauaguaguaaguagu

SEQ ID NO: 48993 - RNA, 375 nt, Artificial Sequence
  derived and/or modified sequence opt6 from anti-HIV-1_HeavyChain
caagcacauuuagaacaaagugcaaguggaguaagaagaccaggagcaaguguaagaguaaguuguuggacaagugaagauauauuugaaagaagugaauuaauauauuggguaagacaagcaccaggaagaggauuagaauggauaggauggauaaaauuaguaaguggagcaguaaauuuuggaaguguagauuuuagagauagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 48994 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagcgaagauauauuugaaagaacagaauuaauacauuggguaagacaagcaccaggacaaggacuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 48995 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 48996 - RNA, 375 nt, Artificial Sequence
  derived and/or modified sequence opt6 from anti-HIV-1_HeavyChain
caagcacauuuagaacaaucaggaucaggaguaaaaagaccaggagcaucaguaagaguaucauguuggacaucagaagauauauuugaaaaaucagaauuaauacauuggguaagacaagcaccaggacaaggauuagaauggauaggauggguaaaaacaguaacaggagcaguaaauuuuggaaguagugauuuuagacaaagaguaucauuaacaagagauagagauuuauuuacagcacauaugggaauaagaggauuaacacaaggagauacagcaacauauuuuugugcaagacaaaaauuuuaugcaggaggacaaggaugguauuuugaucuauggggaagaggaacauuaauaguaguaagcuca

SEQ ID NO: 48997 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagaucuauuuacagcacauauggauauaagaggauuaacacaagacgauacagcaauauauuuuugugcaagacaaaaauuugcaagaggagaucaaggaugguuuuuugauuuauggggaagaggaacauuaauaguaguaaguagu

SEQ ID NO: 48998 - RNA, 375 nt, Artificial Sequence
  derived and/or modified sequence opt6 from anti-HIV-1_HeavyChain
caaagucauuuagaacaaaguggaagugcaaugaaaaaauuaggagcaaguguaagaguaccauguuggacaagugaagauauauuugaaagaacagaauuaauacauuggguaagacaagcaccaggacaaggauuagaauggauaggauggguaaaagcaguaagcggagcaguaaauuauggaaguuuagauuuuagacauagaguaaguuuaacaagagauagagauuuauuuacagcacauauggauauaagaggauuaacacaagaugauacagcaacauauuuuugcgcaagacaaaaauuugcaagaggagaucaaggaugguuuuuugauuuauggggaagaggaacauuaauaguaguaaguagu

SEQ ID NO: 48999 - RNA, 375 nt, Artificial Sequence
  derived and/or modified sequence opt6 from anti-HIV-1_HeavyChain
caaguacauuuagaacaaaguggaaguggaguaaaaaaaccaggagcaagcguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 49000 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49001 - RNA, 375 nt, Artificial Sequence
  derived and/or modified sequence opt6 from anti-HIV-1_HeavyChain
caagcacauuuagaacaaagugcaaguggaguaagaagaccaggagcaaguguaaggguaaguuguuggacaagugaagauauauuugaaagaagugaauuaauauauuggguaagacaagcaccaggaagaggauuagaauggauaggauggguaaaaacaguaaguggagcaguaaauuuuggaaguccaaauuuuaggcauagaguaaguuuaacaagagauagggauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49002 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggagggcaaggaugguauuuugauuuauggggaagaggaacauuaauaguaguaucaagc

SEQ ID NO: 49003 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugaaagaacagaauuaauauauuggguaagacaagcaccaggaagaggauuagaauggauaggauggguaaaaacaguaaguggaacaguaaauuuuggaaguagugauuuuagaaauagaauaaguuuaacaagagauagagauuuaaguacagcacauauggauauaagaggauuaacacaagaugauacagcaacauauuuuugugcaagacaaaaauuuuaugcaggaggacaaggaugguauuuugauuuauggggaagaggaacauuaauaguaguaagcagu

SEQ ID NO: 49004 - RNA, 375 nt, Artificial Sequence
  derived and/or modified sequence opt6 from anti-HIV-1_HeavyChain
caaguacaauuagaacaaucaggaaguggaguaaaaaaaccaggagcaucaguaagaguaucauguuggacaagugaagauauauuugaaaaaagcgaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacacuaauaguaguaaguagu

SEQ ID NO: 49005 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggaagaggauuagaauggauaggauggguaaaagcaguaaguggagcaguaaauuauggaagcuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49006 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaagcuguuggacaagugaagauauauuugaaagaacagaauuaauacauuggguaagacaagcaccaggacaaggauuagaauggauaggauggguaaaaacaguaacaggagcagugaauuuuggaaguccaaauuuuagacauagaguaagcuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaucaagu

SEQ ID NO: 49007 - RNA, 375 nt, Artificial Sequence
  derived and/or modified sequence opt6 from anti-HIV-1_HeavyChain
caagcacauuuagaacaaagugcaaguggaguaaaaagaccaggagcaaguguaagaguaaguuguuggacaagugaagauauauuugaaagaagugaauuaauauauuggguaagacaagcaccaggacaaggauuagaauggacaggauggguaaaaacaguaaguggggcaguaaauuuuggaaguacagauuuuagagaaagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagu

SEQ ID NO: 49008 - RNA, 375 nt, Artificial Sequence
  derived and/or modified sequence opt6 from anti-HIV-1_HeavyChain
caaguacauuuagaacaaaguggaaguggaguaaaaaaauugggagcaaguguaagaguaaguuguuggacaagugaagauauauuugaaagaacagaauuaauacauuggguaagacaagcaccaggaagaggacuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagc

SEQ ID NO: 49009 - RNA, 375 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaagaagugaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauauuaugcaggaggacaaggaugguauuuugauuuauggggaagaggaacauuaauaguaguaaguagu

SEQ ID NO: 49010 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49011 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagagugaguuuaacaagagauagagacuuauuuacagcacauauggauauaagaggauuaacacaaggaggaacagcaacauauuuuugugcaagacaaaaauuuuaugcaggaggacaaggaugguauuuugauuuauggggaagaggaacauuaauaguaguaaguagu

SEQ ID NO: 49012 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauauguggauuaacacaaggagauacagcaacauauuuuugugcaagacaaaaauuugaaagaggaggacaaggaugguauuuugauuuauggggaagaggaacauuaauaguaguaagcagu

SEQ ID NO: 49013 - RNA, 375 nt, Artificial Sequence
  derived and/or modified sequence opt6 from anti-HIV-1_HeavyChain
caagcacauuuagaacaaaguggaaguggaguaagaaaaguaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaagcuuaacaagagauagagauuuauuuacagcacauauggauauaagaggauuaacacaagaugauacagcaauauauuuuugugcaagacaaaaauuugcaagaggagaucaaggaugguuuuuugauuuauggggaaggggaacauuaauaguaguaaguagu

SEQ ID NO: 49014 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaaggguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauauuaugcaggaggacaaggaugguauuuugauuuauggggaagaggaacauuaauaguaguaaguagu

SEQ ID NO: 49015 - RNA, 375 nt, Artificial Sequence
  derived and/or modified sequence opt6 from anti-HIV-1_HeavyChain
caaguacaauuaguacaaaguggagcagaaguaaaaaaaccaggagcaaguguaagaguaaguuguuggacaagugaagauauauuugaaagaacagaauuaauacauuggguaagacaagcaccaggacaaggauuagaauggauaggauggguaaaaacagugacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49016 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggauuaagugauuuuagacaaagaguaaguuuaacaagagauagaggauuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49017 - RNA, 375 nt, Artificial Sequence
  derived and/or modified sequence opt6 from anti-HIV-1_HeavyChain
caagcacauuuagaacaaaguggaaguggaguaaaaaaaccaggaacaagcgugagaguaaguuguuggacaagugaagauauauuugaaagaacagaauuaauacauuggguaagacaagcaccagggcaaggauuagaauggauaggauggguaaaaacaguaacaggagcaguaaauuuuggaaguccaaauuuuaggcaaaggguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 49018 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcgaguuuagauuuuagaaauagaauaaguuuaaguagagauagagauuuaaguacagcacauauggauauaagaggauuaacacaagaugauacagcaacauauuuuugugcaagacaaaaauuugaaagaggaggacaaggaugguauuuugauuuauggggaagaggaacauuaauaguaguaaguagu

SEQ ID NO: 49019 - RNA, 375 nt, Artificial Sequence
  derived and/or modified sequence opt6 from anti-HIV-1_HeavyChain
caaguacaacuaguacaaaguggagcagaaguaaaaaaaccaggagcaaguguaagaguaaguuguuggacaagcgaagauauauuugaaggaagugaauuaauacauuggguaagacaagcaccaggacaaggauuagaauggauaggauggguaaaaacaguaacaggagcaguaaauuuuggaagugcauauuuuagacauagaguaaguuuaacaagagauagagauuuauuuacagcacauauggauauaagaggauuaacacaaggagauacagcaacauauuuuugugcaagacaaaaauuuuauaaaggaggacaaggaugguauuuugauuuauggggaagaggaacauuaauaguaguaaguagu

SEQ ID NO: 49020 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguagugauuuuagaaauagaauaaguuuaaguagagauagagauuuaaguacagcacauauggauauaagaggauuaacacaagaugauacagcaacauauuuuugugcaagacaaaaauuugaaagaggaggacaaggauggauauuugauuuauggggaagaggaacauuaauagcaguaaguagu

SEQ ID NO: 49021 - RNA, 375 nt, Artificial Sequence
  derived and/or modified sequence opt6 from anti-HIV-1_HeavyChain
caaguacaauuaguacaaucaggaacagaaguaaaaaaaccaggagcaucaguaagaguaucauguaaagcaucaggauauacauuugaaaaaagugaauuaauacauuggguaagacaagcaccaggacaaggauuagaauggauaggauggguaaaaacaguaacaggagcaguaaauuuuggaucaagugauuuuagacaaagaguaucauuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguuca

SEQ ID NO: 49022 - RNA, 375 nt, Artificial Sequence
  derived and/or modified sequence opt6 from anti-HIV-1_HeavyChain
caaagucauuuagaacaaucaggaagugcaaugaaaaaaccaggagcaaguguaagaguaaguuguuggacaagugaagauauauuugaaagaacagaauuaauauauuggguaagacaagcaccaggaagaggauuagaauggauaggauggguaaaaacaguaaguggaacaguaaauuuuggaaguagugauuuuagaaauagaauaaguuuaacaagagauagagauuuaaguacagcacauauggauauaagaggauuaacacaagaugauacagcaacauauuuuugugcaagacaaaaauuugaaagaggaggacaaggauggauauuugauuuauggggaagaggaacauuaauagcaguaaguagu

SEQ ID NO: 49023 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggacuagaauggauaggauggguaaaagcaguaaguggagcaguaaauuauggaaguuuagauuuuaggcauagaguaaguuuaacaagagauagagauuuaaguacagcacauauggauauaagaggauuaacgcaagaugauacagcaacauauuuuugugcaagacaaaaauuugcaagaggagaucaaggaugguuuuuugauuuauggggaagaggaacauuaauaguaguaaguagu

SEQ ID NO: 49024 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaagaugauacggcaauauauuuuugugcaagacaaaaauuugcaagaggagaucaaggaugguuuuuugauuuauggggaagaggaacauuaauaguaguaaguagu

SEQ ID NO: 49025 - RNA, 375 nt, Artificial Sequence
  derived and/or modified sequence opt6 from anti-HIV-1_HeavyChain
caagcacauuuagaacaaucaggaaguggaguaaaaaaaccaggagcaaguguaagaguaucauguuggacaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggacuaacacaaggagauacagcaacauauuuuugugcaagacaaaaauuuuaugcaggaggacaaggaugguauuuugauuuauggggaagaggaacauuaauaguagugaguagu

SEQ ID NO: 49026 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagcgaauuaguacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaucaagc

SEQ ID NO: 49027 - RNA, 375 nt, Artificial Sequence
  derived and/or modified sequence opt6 from anti-HIV-1_HeavyChain
caagcacaucuagaacaaaguggaagcggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagaucuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagu

SEQ ID NO: 49028 - RNA, 375 nt, Artificial Sequence
  derived and/or modified sequence opt6 from anti-HIV-1_HeavyChain
caagcacauagagaacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaacaguaacaggagcagugaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49029 - RNA, 372 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuuagcaagcgaagauauauuuaaaacagaauuaauacauuggguaagacaagcaccaggacaaggauuagaauggauaggauggguaaaaauaguaaguggagcaguaaauuuuggaucaccaaauuuuagacaaagaguaucauuaacaagagauagagauuuauuuacagcacauauggauauaagaggauuaacacaaggagauacggcaacauauuuuugugcaagacaaaaauuugaaagaggaggacaaggauggauauuugauuuauggggaagaggaacacuaauagcaguaaguucg

SEQ ID NO: 49030 - RNA, 375 nt, Artificial Sequence
  derived and/or modified sequence opt6 from anti-HIV-1_HeavyChain
caagcacauuuagaacaaaguggaaguggaguaaaaaaaguaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaauauauuuuugugcaagacaaaaauuugaaagaggaggacaaggauggauauuugauuuauggggaagaggaacauuaauagcaguaaguagu

SEQ ID NO: 49031 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagaucuauuuacagcacauauggauauaagaggauuaacacaaggagauacagcaacauauuuuugugcaaggcaaaaauuugcaagaggagaucaagggugguuuuuugauuuauggggaagaggaacauuaauaguaguaaguagu

SEQ ID NO: 49032 - RNA, 375 nt, Artificial Sequence
  derived and/or modified sequence opt6 from anti-HIV-1_HeavyChain
caagcacauuuagaacaaagugcaaguggaguaaaaagaccaggagcaaguguaagaguaaguuguuggacaagugaagauauauuugaaagaagugaauuaauauauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49033 - RNA, 375 nt, Artificial Sequence
  derived and/or modified sequence opt6 from anti-HIV-1_HeavyChain
caagcacauuuagaacaaagcggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcgagacaaaaauauuaugcaggaggacaaggaugguauuuugauuuauggggaagaggaacauuaauaguaguaaguagu

SEQ ID NO: 49034 - RNA, 375 nt, Artificial Sequence
  derived and/or modified sequence opt6 from anti-HIV-1_HeavyChain
caaguacaauuaguacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggagggcaaggauggauauuugauuuauggggaagaggaacauuaauagcaguaagcagu

SEQ ID NO: 49035 - RNA, 375 nt, Artificial Sequence
  derived and/or modified sequence opt6 from anti-HIV-1_HeavyChain
agacauacaugggaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaagcuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 49036 - RNA, 372 nt, Artificial Sequence
  derived and/or modified sequence opt6 from anti-HIV-1_HeavyChain
agacauacaugggaacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaacaguaacaggagcaguaaauuuagcaccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49037 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaggaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49038 - RNA, 375 nt, Artificial Sequence
  derived and/or modified sequence opt6 from anti-HIV-1_HeavyChain
caaagucauuuagaacaaaguggaagcgcaaugaaaaaaccaggagcaaguguaagaguaaguuguuggacaagugaagauauauuugauacaacagaauugauauauuggguaagacaagcaccaggacaaggauuagaauggauaggauggguaaaaauaguaaguggaacaguaaauuuugcaaguagugauuuuagaaauagaauaaguuuaaguagagauagagauuuaaguacagcacauauggauauaagaggauuaacacaaggagauacagcaacauauuuuugugcaagacaaaaauauuaugcaggaggacaaggaugguauuuugauuuauggggaagaggaacauuaauaguaguaaguagu

SEQ ID NO: 49039 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuaggcaaagaguaagccuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 49040 - RNA, 375 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagugaagauauauuugaaaaaagcgaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuauaaaggaggacaaggaugguauuuugauuuauggggaagaggaacauuaauaguaguaaguagu

SEQ ID NO: 49041 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagu

SEQ ID NO: 49042 - RNA, 375 nt, Artificial Sequence
  derived and/or modified sequence opt6 from anti-HIV-1_HeavyChain
caagcacauuuagaacaaaguggaucaggaguaaaaaaauuaggagcaaguguaagaguaaguuguuggacaagugaagacauauuugaaagaacagaauuaauacauuggguaagacaagcaccaggaagaggauuagaauggauaggauggguaaaagcaguaaguggagcaguaaauuauggaaguuuagauuuuagacauagaguaaguuugacaagagauagagauuuauuuacagcacauauggauauaagaggauuaacacaaggagauacagcaacauauuuuugugcaagacaaaaauuugaaaggggaggacaaggaugguauuuugauuuauggggaagaggaacauuaauaguaguaaguagu

SEQ ID NO: 49043 - RNA, 375 nt, Artificial Sequence
  derived and/or modified sequence opt6 from anti-HIV-1_HeavyChain
caagcaagaccaggaacaaguggaaguggaguaaaaaaaccaggagcaaguguaagaguaaguuguuggagcagugaagauauauucgaaagaacagaauuaauacauuggguaagacaagcaccaggacaaggauuagaauggauaggauggguaaaaacaguaacaggagcaguaaauuuuggaaguuuagauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 49044 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacagaaggagauacagcaacauauuuuugugcaagacaaaaauuugaaagaggaggacaaggauggauauuugauuuauggggaagaggaacauuaauagcaguaaguagu

SEQ ID NO: 49045 - RNA, 375 nt, Artificial Sequence
  derived and/or modified sequence opt6 from anti-HIV-1_HeavyChain
caagcacauuuagaacaaaguggaaguggaguaaaaaaaccaggagcaagcguaagaguaagcuguuggacaagugaagauauauuugaaagaacagaauuaauacauuggguaagacaagcaccaggacaaggauuagaauggauaggauggguaaaagcaauaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguuca

SEQ ID NO: 49046 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauaguggaaguccaaauuuuagacauagaguaaguuuaacaagagauagagauuuauuuacagcacauauggauauaagaggauuaacacaaggagauacagcaacauauuuuugugcaagacaaaaauuugaaagaggagggcaaggaugguauuuugauuuauggggaagaggaacauuaauaguaguaaguagu

SEQ ID NO: 49047 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagagcagaauuaauacauuggguaagacaagcaccaggacaaggauuagaauggauaggauggguaaaaacaguaaguggggcaguaaauuuuggaaguuuaaauuuuagacauagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagu

SEQ ID NO: 49048 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaguaacaguaaguagu

SEQ ID NO: 49049 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguuuaaauuuuagacauagaguaagucuaacaagagauagagauuuauuuacagcacauauggauauaagaggauuaacacaaggagauacagcaacauauuuuugugcaagacaaaaauuugaaagagggggacaaggaugguauuuugacuuauggggaagaggaacauuaauaguaguaaguagu

SEQ ID NO: 49050 - RNA, 375 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49051 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaacaguaacaggagcaguaaauuuuggaaguccaaauuuuagacauagagugagucuaacaagagauagagauuuauuuacagcacauauggauauaagaggauuaacacaaggagauacagcaacauauuuuugugcaagacaaaaauauuaugcaggaggacaaggaugguauuuugauuuauggggaagaggaacauuaauaguaguaagcagu

SEQ ID NO: 49052 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaacagcaaguggagcaguaaauuuuggaaguccaaauuuuagacauagaguaaguuuaacaagagauagagauuuauuuacagcacauauggauauaagaggguuaacacaaggagauacagcaacauauuuuugugcaagacaaaaauuugaaagaggaggacaaggaugguauuuugauuuauggggaagaggaacauuaauaguaguaaguagu

SEQ ID NO: 49053 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaucagaagauauauuugaaagaacagaauuaauacauuggguaagacaagcaccaggacaaggauuagaauggauaggauggguaaaagcaguaaguggagcaguaaauuauggaagcuuagauuuuagacauaggguaagcuuaacaagagauagagauuuauuuacagcacauauggacauaagaggauuaacacaagaugauacagcaacauauuuuugugcaagacaaaaauuugaaagaggaggacaaggaugguauuuugauuuauggggaagaggaacauuaauaguaguaaguagu

SEQ ID NO: 49054 - RNA, 375 nt, Artificial Sequence
  derived and/or modified sequence opt6 from anti-HIV-1_HeavyChain
caagcacauuuagaacaaagugcaaguggaguaaaaagaccaggagcaaguguaagaguaaguuguuggacaagugaagauauauuugaaagaagugaauuaauauauuggguaagacaagcaccaggacaaggacuagaauggauaggauggguaaaaacaguaaguggagcaguaaauuuuggaaguacagauuuuagagaaagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49055 - RNA, 375 nt, Artificial Sequence
  derived and/or modified sequence opt6 from anti-HIV-1_HeavyChain
caagcacauuuagaacaaaguggaagcggaguaaaaaaauuaggagcaagcguaagaguaagcuguuggacaagugaagauauauuugaaagaacagaauuaauacauuggguaagacaagcaccaggacaaggauuagaauggauaggauggguaaaagcaguaaguggaguaguaaauuauggaaguuuagauuuuagacauagaguaaguuuaacaagagauagagauuuaaguacagcacauauggauauaagaggauuaacacaagaugauacagcaacauauuuuugugcaaggcaaaaauuugcaagaggagaucaaggaugguuuuuugauuuauggggaagaggaacauuaauaguaguaaguagu

SEQ ID NO: 49056 - RNA, 375 nt, Artificial Sequence
  derived and/or modified sequence opt6 from anti-HIV-1_HeavyChain
caagcacauuuagaacaaaguggaaguggaguaaaaaaaguaggagcaaguguaagaguaaguuguuggacaagugaagauauauuugaaagaacagaauuaauacauuggguaagacaagcaccaggacaaggacuagaauggauaggauggguaaaaacaguaagcggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49057 - RNA, 375 nt, Artificial Sequence
  derived and/or modified sequence opt6 from anti-HIV-1_HeavyChain
caagcauauuuagaacaaaguggaaguauaaugaaaaaaccaggagcaaguguaagaguaaguuguuggacaagugaagauauauuugauagaacagaauuaauacauuggguaagacaagcaccaggacaaggauuagaauggauaggauggguaaaaacaguaacaggagcaguaaauuuuggaaguagugauuuuagacaaagaguaagcuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49058 - RNA, 375 nt, Artificial Sequence
  derived and/or modified sequence opt6 from anti-HIV-1_HeavyChain
caagcacaucuagaacaaucaggaaguggaguaaaaaaaccaggagcaaguguaagaguaaguuguuggacaucagaagauauauuugaaaaaagugaauuaauacauuggguaagauuagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcgggaggacaaggaugguauuuugauuuauggggaagaggaacauuaauaguaguaaguagc

SEQ ID NO: 49059 - RNA, 375 nt, Artificial Sequence
  derived and/or modified sequence opt6 from anti-HIV-1_HeavyChain
gaagcacauuuagaacaaaguggaaguggaguaaaaaaaccaggagcaaguguaagaguaaguuguuggacaagugaagauauauuugaaagaacagaauuaacacauuggguaagacaagcaccaggacaaggauuagaauggauaggauggguaaaaacaguaacaggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 49060 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauaugaaagaacagaauuaauacauuggguaagacaagcaccaggacaaggauuagaauggauaggauggguaaaagcaguaaguggagcaguaaauuauggaagcuuagauuuuagacauagaguaaguuuaacaagagauagagauuuauuuacagcacauauggauauaagaggauuaacacaagaugauacagcaauauauuuuugugcaagacaaaaauuugcaagaggagaucaaggaugguuuuuugauuuauggggaagaggaacauuaauaguaguaaguagu

SEQ ID NO: 49061 - RNA, 375 nt, Artificial Sequence
  derived and/or modified sequence opt6 from anti-HIV-1_HeavyChain
caaguacauuuagaacaaaguggaaguggaguaaaaaaaccaggagcaaguguaagaguaaguuguuggacaagugaagauauauuugaaagaacagaauuaauacauuggguaagacaagcgccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaagcagu

SEQ ID NO: 49062 - RNA, 375 nt, Artificial Sequence
  derived and/or modified sequence opt6 from anti-HIV-1_HeavyChain
caagcacauuuagaacaaaguggaaguggaguaaaaaaaguaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaagucuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaagcagu

SEQ ID NO: 49063 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaccaccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49064 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggacuaacacaagaugauacagcaacauauuuuugugcaagacaaaaauuugaaagaggaggacaaggauggauauuugauuuauggggaagaggaacauuaauagcaguaaguagu

SEQ ID NO: 49065 - RNA, 375 nt, Artificial Sequence
  derived and/or modified sequence opt6 from anti-HIV-1_HeavyChain
caagcacauuuagaacaaaguggaaguggaguaagaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaagcagugauuuuagacaaagaguaaguuuaacaagagacagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49066 - RNA, 375 nt, Artificial Sequence
  derived and/or modified sequence opt6 from anti-HIV-1_HeavyChain
caagcacauuuagaacaaaguggaaguggagugaaaaaauuaggagcaaguguaagaguaaguuguuggacaagugaagauauauuugaaagaacagaauuaauacauuggguaagacaagcaccaggaagaggauuagaauggauaggauggguaaaagcaguaaguggagcaguaaauuauggaaguccaaauuuuagacauagaguaagcuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49067 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggacuagaauggauaggauggguaaaaacaguaaguggagcaguaaauuuuggaaguccaaauuuuagacauagaguaaguuuaacaagagauagagauuuauuuacagcacauauggauauaagaggacuaacacaaggagauacagcaacauauuuuugugcaagacaaaaauuugaaagaggaggacaaggaugguauuuugauuuauggggaagaggggcauuaauaguaguaaguagu

SEQ ID NO: 49068 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaagugcauauuuuagacauagaguaaguuuaacaagagauagagauuuauuuacagcacauauggauauaagaggauuaacacaaggagauacagcaacauauuuuugugcaagacaaaaauuuuauaaaggaggacaaggaugguauuuugacuuauggggaagaggaacauuaauaguaguaagcagu

SEQ ID NO: 49069 - RNA, 375 nt, Artificial Sequence
  derived and/or modified sequence opt6 from anti-HIV-1_HeavyChain
caaagucaucuagaacaaaguggaagugcaaugaaaaaaccaggagcaaguguaagaguaaguuguuggacaagugaagauauauuugaaagaacagaauuaauauauuggguaagacaagcaccaggaagaggauuagaauggauaggauggguaaaaacaguaaguggaacaguaaauuuuggaagcuuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49070 - RNA, 375 nt, Artificial Sequence
  derived and/or modified sequence opt6 from anti-HIV-1_HeavyChain
caaagucauuuagaacaaucaggaucagcaaugaaaaaaccaggagcaucaguaagaguaucaugcuggacaucagaagauauauuugacacaacagaauuaauauacuggguaagacaagcaccaggacaaggacuagaauggauaggauggguaaaaauaguaagcggaacaguaaauuuugcaucaagugauuucagaaacagaauaucauuaucaagagauagagauuuaucaacagcacauauggacauaagaggacuaacacaagaugacacagcaacauauuuuugugcaagacaaaaauuuuaugcaggaggacaaggaugguauuuugauuuauggggaagaggaacacuaauaguaguaagcagu

SEQ ID NO: 49071 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguuagaguaaguuguuggacaagugaagauauauuugaaagaacagaauuaauacauuggguaagacaagcaccaggacaaggauuagaauggauaggauggguaaaagcaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49072 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugaaagaacagaauuaauauauuggguaagacaagcaccaggaagaggauuagaauggauaggauggguaaaaacaguaaguggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49073 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcgcauauggauauaagaggauuaacacaaggagaugcagcaacauauuuuugugcaagacaaaaauuugaaagaggaggacaaggaugguauuuugauuuauggggaagaggaacauuaauaguaguaaguagu

SEQ ID NO: 49074 - RNA, 375 nt, Artificial Sequence
  derived and/or modified sequence opt6 from anti-HIV-1_HeavyChain
caagcacauuuagaacaaaguggaagcggaguaaaaaaauuaggagcaaguguaagaguaaguuguuggacaagugaagauauauuugaaagaacagaauuaauacauuggguaagacaagcaccaggaagaggauuagaauggauaggauggguaaaagcaguaaguggagcaguaaauuauggaaguuuagauuuuagacauagaguaaguuuaacaagagauagagauuuauuuacagcacauauggauauaagaggauuaacgcaagaugauacagcaacauauuuuugugcaagacaaaaauuuuaugcaggaggacaaggaugguauuuugauuuauggggaagaggaacauuaauaguaguaagcagc

SEQ ID NO: 49075 - RNA, 375 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaagaacagaauuaauacauuggguaagacaagcgccaggacaaggauuagaauggauaggauggguaaaaauaguaaguggagcaguaaauuuuggaaguccaaauuuuagacaaagaguaaguuuaacaagagauagagauuuauuugcagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 49076 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaacuaauacauuggguaagacaagcaccaggacaaggauuagaauggauaggauggguaaaaacaguaacaggagcaguaaauuuuggaagcccaaauuuuagacauagaguaaguuuaacaagagauagagauuuauuuacagcacauauggauauaagaggauuagcacaaggagauacagcaacauauuuuugugcaagacaaaaauuugaaagaggaggacaaggaugguauuuugauuuauggggaagaggaacauuaauaguaguaaguagu

SEQ ID NO: 49077 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaaggcaagcaccaggacaaggauuagaauggauaggauggguaaaaauaguaaguggaacaguaaauuuugcaaguagugauuuuagaaauagaauaaguuuaaguagagauagagauuuaaguacagcacauauggauauaagaggacuaacacaagaugauacagcaacauauuuuugugcaagacaaaaauuugaaagaggaggacaaggaugguauuuugauuuauggggaagaggaacauuaauaguaguaaguagu

SEQ ID NO: 49078 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaguaagucuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49079 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagc

SEQ ID NO: 49080 - RNA, 375 nt, Artificial Sequence
  derived and/or modified sequence opt6 from anti-HIV-1_HeavyChain
caagcacauuuagaacaaucaggaaguggaguaaaaaaaccaggagcaaguguaagaguaagcuguuggacaagugaagauauauuugaaaaaagugaauuaauacauuggguaagaagagcaccaggacaaggauuagaauggauaggauggguaaaaacaguaacaggagcaguaaacuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49081 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacaaagaguaaguuuaacaagagauagagauuuauuuacagcacauauggauauaagaggauuaacacaaggagauacagcaacauauuuuugugcaagacaaaaauuugaaagaggagggcaaggauggauauuugauuuauggggaagaggaacauuaauagcaguaaguagu

SEQ ID NO: 49082 - RNA, 375 nt, Artificial Sequence
  derived and/or modified sequence opt6 from anti-HIV-1_HeavyChain
caagcacauuuagaacaaaguggaaguggaguaaaaaaaccaggagcaucaguaaggguaaguuguuggaguagugaagauauauuugaaagaacagaauuaauacauuggguaagacaagcaccaggacaaggauuagaauggauaggauggguaaaaacaguaacaggagcaguaaauuuuggaagucuagauuuuagacauagaauaaguuuaacaagagauagagauuuauuuacagcacauauggauauaagaggauuaacacaaggagauacagcaacauauuuuugugcaagacaaaaauuuuauaaaggaggacaaggaugguauuuugauuuauggggaagaggaacauuaauaguaguaaguagu

SEQ ID NO: 49083 - RNA, 375 nt, Artificial Sequence
  derived and/or modified sequence opt6 from anti-HIV-1_HeavyChain
caagcacauuuagaacaaaguggaaguggaguaaaaaaaccaggaacaaguguaagaguaucauguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagggauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49084 - RNA, 375 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaagucuagauuuuagaaauagaauaagucuaaguagagauagagauuuaaguacagcacauauggauauaagaggauuaacacaagaugauacagcaacauauuuuugugcaagacaaaaauuuuaugcaggaggacaaggaugguauuuugauuuauggggaagaggaacauuaauaguaguaaguagu

SEQ ID NO: 49085 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagcgaagauauauuugaaagaacaggauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49086 - RNA, 375 nt, Artificial Sequence
  derived and/or modified sequence opt6 from anti-HIV-1_HeavyChain
caagcacauuuagaacaaagcggaaguggaguaaaaaaaccaggaacaaguguaagaguaaguuguuggacaagugaagauguauuugaaagaacagaauuaauacauuggguaagacaagcaccaggacaaggauuagaauggauaggauggguaaaaacaguaauaggagcagugaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49087 - RNA, 372 nt, Artificial Sequence
  derived and/or modified sequence opt6 from anti-HIV-1_HeavyChain
caagcacauuuagaacaaaguggagcaggaguaaaaaaaccaggagcaaguguaagagugaguuguuggacaagugaagauauauuuaaaacagaauuaauacauuggguaagacaagcaccaggacaaggauuagaauggauaggauggguaaaaauaguaaguggagcaguaaauuuuggaaguccaaauuuuagacaaagaguuaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguuca

SEQ ID NO: 49088 - RNA, 375 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccagauuuuagacauagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagu

SEQ ID NO: 49089 - RNA, 375 nt, Artificial Sequence
  derived and/or modified sequence opt6 from anti-HIV-1_HeavyChain
caagcacaucuagaacaaagcggaaguggaguaaaaagaccaggagcaaguguaagaguaaguuguuggacaagcgaagauauauuugaaacaacagaauuaauacauuggguaagacaagcaccaggacaaggauuagaauggauaggauggguaaaaacaguaaguggagcaguaaauuuuggaaguuuaaauuuuagacauagaauaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagu

SEQ ID NO: 49090 - RNA, 375 nt, Artificial Sequence
  derived and/or modified sequence opt6 from anti-HIV-1_HeavyChain
caggcacauuuagaacaaagcggaaguggaguaaaaaaauuaggagcaaguguaagaguaagcuguuggacaagcgaagauauauuugaaagaacagaauuaauacauuggguaagacaagcaccaggacaaggacuagaauggauaggauggguaaaagcaguaaguggagcaguaaauuauggaaguuuagauuuuagacauagaguaaguuuaacaagagauagagauuuaaguacagcacauauggauauaagaggauuaacacaagaugauacagcaauauauuuuugugcaagacaaaaauuugcaagaggagaucaaggaugguuuuuugauuuauggggaagaggaacauuaauaguaguaaguagu

SEQ ID NO: 49091 - RNA, 375 nt, Artificial Sequence
  derived and/or modified sequence opt6 from anti-HIV-1_HeavyChain
caagcacauuuagaacaaaguggaaguggaguaaaaaaauuaggagcaagcguaagaguaaguuguuggacaagugaagauauauuugaaagaacagaauuaauacauuggguaagacaagcaccaggacaaggauuagaauggacaggauggguaaaagcaguaaguggagcaguaaauuauggaaguuuagauuuuagacauagaguaaguuuaacaagggauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49092 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaagcuuaacaagagauagagauuuauuuacagcacauauggauauaagaggaccaacacaagaugauacagcaacauauuuuugugcaagacaaaaauuugcaagaggagaucaaggaugguuuuuugauuuauggggaagaggaacauuaauaguaguaaguagu

SEQ ID NO: 49093 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaaggacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49094 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaagucuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauagugguaaguagu

SEQ ID NO: 49095 - RNA, 375 nt, Artificial Sequence
  derived and/or modified sequence opt6 from anti-HIV-1_HeavyChain
agacauacauggaaugaaagcggaaguggaguaaaaaaaccaggagcaaguguaagaguaaguuguuggacaagugaagauauauuugaaagaacagaauuaauacauuggguaagacaagcaccaggacaaggauuggaauggauaggauggguaaaaacaguaacaggaacaguaaauuuuggaaguuuaaauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49096 - RNA, 375 nt, Artificial Sequence
  derived and/or modified sequence opt6 from anti-HIV-1_HeavyChain
caagcacaucuagaacaaaguggagcaggaguaaaaagaccaggagcaaguguaagaguaaguuguuggacaagugaagauauauuugaaacaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugaucuauggggaagaggaacauuaauaguaguaaguagu

SEQ ID NO: 49097 - RNA, 375 nt, Artificial Sequence
  derived and/or modified sequence opt6 from anti-HIV-1_HeavyChain
caagcacauuuagaacaaagcggaaguggaguaaaaaaaccaggagcaagcguaagaguaaguuguuggacaagugaagauauauuugaaagaacagaauuaauacauuggguaagacaagcaccaggacaaggauuagaauggauaggauggguaaaagcaguaaguggagcaguaaauuuuggaaguccaaauuuuagacauagaguaaguuuaacaagagauagagaucuauuuacagcacauauggauauaagaggauuaacacaaggagauacagcaacauauuuuugugcaagacaaaaauuugaaagaggaggacaaggaugguauuuugauuuauggggaagaggaacauuaauaguaguaagcagu

SEQ ID NO: 49098 - RNA, 375 nt, Artificial Sequence
  derived and/or modified sequence opt6 from anti-HIV-1_HeavyChain
caagcacauuuaggaacaauauuaggauuagaaaguaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaaguauacuagcaccaaauuucagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguuca

SEQ ID NO: 49099 - RNA, 375 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagcauuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagu

SEQ ID NO: 49100 - RNA, 375 nt, Artificial Sequence
  derived and/or modified sequence opt6 from anti-HIV-1_HeavyChain
agaguacauuuagaacaaagcggaaguggaguaaaaaaaccaggagcaaguguaagaguaaguuguuggacaagugaagauauauuugaaagaacagaauuaauacauuggguaagacaagcaccaggacaaggacuagaauggauaggauggguaaaaacaguaacgggagcaguaaauuuuggaaguccaaauuuuagacauagaguaaguuuaacaagagacagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaucaagu

SEQ ID NO: 49101 - RNA, 375 nt, Artificial Sequence
  derived and/or modified sequence opt6 from anti-HIV-1_HeavyChain
caagcacauuuagaacaaaguggagcaggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacaaagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49102 - RNA, 375 nt, Artificial Sequence
  derived and/or modified sequence opt6 from anti-HIV-1_HeavyChain
caaguacaauuaguacaaagcggagcagaaguaaaaagaccaggagcaaguguaaaaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagaucuauuuacagcacauauggauauaagaggauuaacacaaggagauacagcaacauauuuuugugcaagacaaaaauuugaaagaggaggacaaggaugguauuuugauuuauggggaagaggaacauuaauaguaguaagcagu

SEQ ID NO: 49103 - RNA, 375 nt, Artificial Sequence
  derived and/or modified sequence opt6 from anti-HIV-1_HeavyChain
agacaugauuuagaacaaaguggaagcggagugaaaaaaccaggagcaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 49104 - RNA, 375 nt, Artificial Sequence
  derived and/or modified sequence opt6 from anti-HIV-1_HeavyChain
agacauacaugggaacaaguauggaguggaguaaaaaaaccaggagcaaguguaagaguaaguuguuggacaucagaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49105 - RNA, 375 nt, Artificial Sequence
  derived and/or modified sequence opt6 from anti-HIV-1_HeavyChain
agacauacauggaauaaaaguggaaguggaguaaaaaaaccaggagcaaguguaagaguaaguuguuggacaagugaagauauauuugaaaggacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggauuaacgcaagaugauacagcaacauauuuuugugcaagacaaaaauuugcaagaggagaucaaggaugguuuuuugauuuauggggaagaggaacauuaauaguaguaaguagu

SEQ ID NO: 49106 - RNA, 375 nt, Artificial Sequence
  derived and/or modified sequence opt6 from anti-HIV-1_HeavyChain
agacauacaugggaacaaaguggaaguggaguaaaaaaaccaggagcaaguguaaggguaaguuguuggacaagcgaagauauauuugaaaaaagugaauuaauacauuggguaagacaagcaccaggacaaggauuagaauggauaggauggguaaaaacaguaacgggagcaguaaauuuuggaaguagugauuuuagacaaagaguaagcuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 49107 - RNA, 375 nt, Artificial Sequence
  derived and/or modified sequence opt6 from anti-HIV-1_HeavyChain
caagcacauuuagaacaaaguggaaguggaguaaaaaggccaggagcaaguguaagaguaaguuguuggacaagugaagauauauuugaaacaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49108 - RNA, 375 nt, Artificial Sequence
  derived and/or modified sequence opt6 from anti-HIV-1_HeavyChain
agacaugauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagaucuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49109 - RNA, 375 nt, Artificial Sequence
  derived and/or modified sequence opt6 from anti-HIV-1_HeavyChain
agacauacaugggaacaaaguggaaguggaguaaaaaaauuaggagcaaguguaagaguaaguuguuggacaagugaagauauauuugaaagaacagaacuaauacauuggguaagacaagcaccaggacaaggauuagaauggauaggauggguaaaagcaguaaguggagcaguaaauuauggaaguuuagacuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaaggggaacauuaauaguaguaaguagu

SEQ ID NO: 49110 - RNA, 375 nt, Artificial Sequence
  derived and/or modified sequence opt6 from anti-HIV-1_HeavyChain
caagcacauuuagaacaaaguggaucaggaguaaaaaaaccaggagcaaguguaagaguaaguugucuagcaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugaucuauggggaagaggaacacuaauaguaguaaguagu

SEQ ID NO: 49111 - RNA, 375 nt, Artificial Sequence
  derived and/or modified sequence opt6 from anti-HIV-1_HeavyChain
caagcacauuuagaacaaaguggagcaggaguaaaaaaaccaggagcaagcguaagaguaaguuguuggacaagugaagauauauuugaaaaaagugaauuaauacauuggguaagacaagcaccaggacaaggauuagaauggauaggauggguaaaaacaguaacaggagcaguaaauuuuggaucaagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49112 - RNA, 375 nt, Artificial Sequence
  derived and/or modified sequence opt6 from anti-HIV-1_HeavyChain
agacauacaugggaacaaucaggaucaggaguaaaaaaaccaggagcaucaguaagaguaucauguuggacaucagaagauauauuugaaaaaagcgaauuaauacauuggguaagacaagcaccaggacaaggacuagaauggauaggauggguaaaaacaguaacaggagcaguaaauuuuggaucaagugauuuuaggcaaagaguaucauuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguuca

SEQ ID NO: 49113 - RNA, 375 nt, Artificial Sequence
  derived and/or modified sequence opt6 from anti-HIV-1_HeavyChain
agacauacaugggaacaaaguggaagcggaguaaaaaaaccaggggcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaagcuuaacaagagauagagauuuauuuacagcacauauggauauaaggggauuaacacauggagauacagcaacauauuuuugugcaagacaaaaauuugaaagaggaggacaaggaugguauuuugauuuauggggaagaggaacauuaauaguaguaaguagu

SEQ ID NO: 49114 - RNA, 375 nt, Artificial Sequence
  derived and/or modified sequence opt6 from anti-HIV-1_HeavyChain
aggcauacaugggaacaaaguggaaguggaguaaaaaaauuaggagcaaguguaagaguaaguuguuggacaagugaagauauauuugaaagaacagaauuaauacauugggugagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49115 - RNA, 375 nt, Artificial Sequence
  derived and/or modified sequence opt6 from anti-HIV-1_HeavyChain
caagcacaucuagaacaaaguggagcaggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaagcagu

SEQ ID NO: 49116 - RNA, 375 nt, Artificial Sequence
  derived and/or modified sequence opt6 from anti-HIV-1_HeavyChain
caagcacauuuagaacaaaguggaagcggaguaaaaaaaccaggagcaaguguagaaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcgagacaaaaauuugcaagaggagaucaaggaugguuuuuugauuuauggggaagaggaacauuaauaguagugaguagu

SEQ ID NO: 49117 - RNA, 372 nt, Artificial Sequence
  derived and/or modified sequence opt6 from anti-HIV-1_HeavyChain
caagcacauuuagaacaaaguggagcaggaguaaaaaaauuaggagcaaguguaagaguaaguuguuggacaagugaagauauauuuaaaacagaauuaauacauuggguaagacaagcaccaggacaaggauuagaauggauaggauggguaaaagcaguaaguggggcaguaaauuauggaucacuagauuuuagacauagaguaucauuaacaagagauagagauuuaucaacagcacauauggauauaagaggauuaacacaagaugauacagcaacauauuuuugugcaagacaaaaauuugcaagaggagaucaaggaugguuuuuugauuuauggggaagaggaacauuaauaguaguaaguuca

SEQ ID NO: 49118 - RNA, 375 nt, Artificial Sequence
  derived and/or modified sequence opt6 from anti-HIV-1_HeavyChain
agacauacaugggaacaaucaggaaguggaguaaaaaaaccaggagcaagcguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcgcauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49119 - RNA, 375 nt, Artificial Sequence
  derived and/or modified sequence opt6 from anti-HIV-1_HeavyChain
agacauacaugggaaagaauauggaguggaguaaaaaaaccaggagcaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaagcagu

SEQ ID NO: 49120 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaagauuaacacaagaugauacagcaacauauuuuugugcaagacaaaaauuugcaaggggagaucaaggaugguuuuuugauuuauggggaagaggaacauuaauaguaguaaguagu

SEQ ID NO: 49121 - RNA, 375 nt, Artificial Sequence
  derived and/or modified sequence opt6 from anti-HIV-1_HeavyChain
agacauacaguagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggacuaacacaaggggauacagcaacauauuuuugugcgagacaaaaauuugaaagaggagggcaaggaugguauuuugauuuauggggaagaggaacauuaauaguaguaaguagu

SEQ ID NO: 49122 - RNA, 375 nt, Artificial Sequence
  derived and/or modified sequence opt6 from anti-HIV-1_HeavyChain
caagcacaucuagaacaaaguggaaguggagugaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaccagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49123 - RNA, 375 nt, Artificial Sequence
  derived and/or modified sequence opt6 from anti-HIV-1_HeavyChain
agacauacaguagaacaaaguggaaguggaguaaaaaaaguaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaauauauuuuugugcaagacaaaaauuugcaagaggagaucaaggaugguuuuuugauuuauggggaagaggaacauuaauaguaguaaguagu

SEQ ID NO: 49124 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguugggcaagcgaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49125 - RNA, 375 nt, Artificial Sequence
  derived and/or modified sequence opt6 from anti-HIV-1_HeavyChain
agacauacaugggaacaaguauggaguggaguaaaaaaaccaggagcaaguguaagaguaaguuguuggacaagugaagauauauuugaaaggacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49126 - RNA, 375 nt, Artificial Sequence
  derived and/or modified sequence opt6 from anti-HIV-1_HeavyChain
agacauacauggagacaaaguggaaguggaguaaaaaaauuaggagcaagcguaagagugaguuguuggacaagugaagauauauuugaaagaacagaauuaauacauuggguaagacaagcaccaggacaaggauuagaauggauaggauggguaaaagcaguaagcggaguaguaaauuauggaaguuuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49127 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaucauguuggacaaguggagauauauuugaaagaacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugaucuauggggaagaggaacauuaauagcaguaaguagu

SEQ ID NO: 49128 - RNA, 375 nt, Artificial Sequence
  derived and/or modified sequence opt6 from anti-HIV-1_HeavyChain
agacauacaguggaacaaaguggaaguggaguaaaaaaaccaggagcgaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49129 - RNA, 375 nt, Artificial Sequence
  derived and/or modified sequence opt6 from anti-HIV-1_HeavyChain
caagcacauuuagaacaaaguggaaguggaguaaaaaaaagaugggcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaagcuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49130 - RNA, 375 nt, Artificial Sequence
  derived and/or modified sequence opt6 from anti-HIV-1_HeavyChain
agacauacaguagaacaaaguggaaguggaguaaaaagaccaggagcaaguguaagaguaaguuguuggacaagugaagauauauuugaaacaacagaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49131 - RNA, 375 nt, Artificial Sequence
  derived and/or modified sequence opt6 from anti-HIV-1_HeavyChain
caagcacauuuagaacaaaguggaagugggguaaaaaaauuaggagcaagcguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagaggauuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49132 - RNA, 375 nt, Artificial Sequence
  derived and/or modified sequence opt6 from anti-HIV-1_HeavyChain
caaguacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcagcaaauuuuggaaguagugauuuuagacaaagaguaaguuuaacaccagauagagauuuauuuacagcacauauggauauaagaggauuaacacaaggagauacagcaacauauuuuugugcaagacaaaaauuuuauaaaggaggacaaggaugguauuuugauuuauggggaagaggaacauuaauaguaguaaguagu

SEQ ID NO: 49133 - RNA, 375 nt, Artificial Sequence
  derived and/or modified sequence opt6 from anti-HIV-1_HeavyChain
caggcacauuuagaacaaagcggagcaggaguaaaaaaaccaggagcaaguguaagaguaaguuguuggacaagcgaagauauauuugauacaacagaauuaauacauuggguaagacaagcaccaggacaaggauuagaauggauaggauggguaaaaauaguaaguggagcaguaaauuuuggaaguccaaauuuuagacaaagaguaagcuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacacuaauagcaguaaguagu

SEQ ID NO: 49134 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaaguagagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcgcauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49135 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuuagcaagugaagauauauuugaaagaacagaacuaauacauuggguaagacaagcaccaggacaaggauuagaauggauaggauggguaaaagcaguaaguggagcaguaaauuauggaaguuuagauuuuagacauagaguaagcuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49136 - RNA, 375 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggccaagcgaagauauauuugaaagaacagaauuaauacauuggguaagacaagcaccaggacaaggauuagaauggauaggauggguaaaaacaguaacaggaacaguaaauuuuggaaguuuaaauuuuagacaaagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagc

SEQ ID NO: 49137 - RNA, 375 nt, Artificial Sequence
  derived and/or modified sequence opt6 from anti-HIV-1_HeavyChain
agagcacaucuagaacaaaguggaagcgaauggaaaaaacuaggagcaaguguaagaguaaguuguuggacaaguggagauauauuugaaaggacagaauuaauacauuggguaagacaagcaccaggacaaggauuagaauggauaggauggguaaaagcaguaaguggagcaguaaauuauggaagcuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49138 - RNA, 375 nt, Artificial Sequence
  derived and/or modified sequence opt6 from anti-HIV-1_HeavyChain
agacauacaguagaacaaaguggaaguggaguaaaaaaauuaggagcaaguguaaauguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaagcuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49139 - RNA, 375 nt, Artificial Sequence
  derived and/or modified sequence opt6 from anti-HIV-1_HeavyChain
caagcacauuuagaacaaaguggaaguggagugaaaaaaccaggagcaaguguaagaguaucauguuggacaagugaagauauauuugaaaaaagugaauuaauacauuggguaagacaagcaccaggacaaggauuagaauggauaggauggguaaaaccaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49140 - RNA, 375 nt, Artificial Sequence
  derived and/or modified sequence opt6 from anti-HIV-1_HeavyChain
agacauacauggaauaaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagacagagauuuauucacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49141 - RNA, 375 nt, Artificial Sequence
  derived and/or modified sequence opt6 from anti-HIV-1_HeavyChain
caagcacauagugaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaagccuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagc

SEQ ID NO: 49142 - RNA, 375 nt, Artificial Sequence
  derived and/or modified sequence opt6 from anti-HIV-1_HeavyChain
caagcacauuuagaacaaaguggagcaggaguaaaaagaccaggagcaaguguaagaguaaguuguuggacaagugaagauauauuugaaacaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49143 - RNA, 375 nt, Artificial Sequence
  derived and/or modified sequence opt6 from anti-HIV-1_HeavyChain
ggacauacaugggaacaaagcggagcaggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaagucuaacaagagauagagauuuauuuacagcacauauggauauaagaggauuaacacaagaugauacagcaauauauuuuugugcaagacaaaaauuugcaagaggagaucaaggaugguuuuuugauuuauggggaaggggaacauuaauaguaguaaguagc

SEQ ID NO: 49144 - RNA, 375 nt, Artificial Sequence
  derived and/or modified sequence opt6 from anti-HIV-1_HeavyChain
ggaacaccaggaagugaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49145 - RNA, 375 nt, Artificial Sequence
  derived and/or modified sequence opt6 from anti-HIV-1_HeavyChain
ggaacaccaggaagugaaaguggaaguggaguaaaaaugccaggagcaaguguaagaguaaguuguuggacaagugaagauauauuugaaagaacagaacuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49146 - RNA, 375 nt, Artificial Sequence
  derived and/or modified sequence opt6 from anti-HIV-1_HeavyChain
agacauacaugggaacaaaguggagcaggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49147 - RNA, 375 nt, Artificial Sequence
  derived and/or modified sequence opt6 from anti-HIV-1_HeavyChain
ggaacaccaggaaauaaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaaggggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49148 - RNA, 375 nt, Artificial Sequence
  derived and/or modified sequence opt6 from anti-HIV-1_HeavyChain
caagcacauuuagaacaaaguggagcaggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagacuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49149 - RNA, 375 nt, Artificial Sequence
  derived and/or modified sequence opt6 from anti-HIV-1_HeavyChain
ggaacaccaggaaauaaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 49150 - RNA, 375 nt, Artificial Sequence
  derived and/or modified sequence opt6 from anti-HIV-1_HeavyChain
ggaacaccaggaaauaaaagcggaaguggaguaaaaaaaccaggagcaaguguaaggguaagcuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 49151 - RNA, 375 nt, Artificial Sequence
  derived and/or modified sequence opt6 from anti-HIV-1_HeavyChain
caagcacauuuagaacaaagugcaaguggaguaaaaagaccaggaggauggguaagaguaaguuguuggacaagugaagauauauuugaaagaagugaauuaauauauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaaggggaggacaaggaugguauuuugauuuauggggaagaggaacauuaauaguaguaaguagu

SEQ ID NO: 49152 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaaguaguggagcaguaaauuuuggaaguccaaauuuuagaacaagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49153 - RNA, 375 nt, Artificial Sequence
  derived and/or modified sequence opt6 from anti-HIV-1_HeavyChain
caagcacauuuagaacaaaguggagcaggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcgacauauuuuugugcaagacaaaaauuugaaagaggaggacaaggaugguauuuugauuuauggggaagaggaacauuaauaguaguaaguagu

SEQ ID NO: 49154 - RNA, 375 nt, Artificial Sequence
  derived and/or modified sequence opt6 from anti-HIV-1_HeavyChain
agacauacaugggaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugaucuauggggaagaggaacauuaauaguaguaaguagu

SEQ ID NO: 49155 - RNA, 375 nt, Artificial Sequence
  derived and/or modified sequence opt6 from anti-HIV-1_HeavyChain
ggaacaacauggaauaaaaguggaaguggaguaaaaaaaccaggagcaaguguaagaguaaguuguuggacaagugaagauauauuugaaagaacagaauuaauacauuggguaagacaagcaccaggacaaggacuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49156 - RNA, 375 nt, Artificial Sequence
  derived and/or modified sequence opt6 from anti-HIV-1_HeavyChain
agacauacauggaaugaaaguggaagugggguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugaucuauggggaagaggaacauuaauaguaguaaguagc

SEQ ID NO: 49157 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaaguggaaauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49158 - RNA, 378 nt, Artificial Sequence
  derived and/or modified sequence opt6 from anti-HIV-1_HeavyChain
agauguaguauggaacaaccaggauggagugaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49159 - RNA, 375 nt, Artificial Sequence
  derived and/or modified sequence opt6 from anti-HIV-1_HeavyChain
agacauacaagugaacaaucaggaucaggaguaaaaaaaccaggagcaucaguaagaguaucauguuggacaucagaagauauauuugaaagaagugaauuaauacauuggguaagacaagcaccaggacaaggacuagaauggauaggauggguaaaaacaguaacaggagcaguaaauuucggaucaccaaauuuuagacauagaguaucauuaacaagagauagagauuuauuuacagcacauauggauauaagaggauuaacacaaggagauacagcaacauauuuuugugcaagacaaaaauauuaugcaggaggacaaggaugguauuuugauuuauggggaagaggaacauuaauaguaguaaguuca

SEQ ID NO: 49160 - RNA, 375 nt, Artificial Sequence
  derived and/or modified sequence opt6 from anti-HIV-1_HeavyChain
aggcauacaguagaacaaaguggagcaggaguaaaaaaaccaggagcaagcguaagaguaaguuguuggacaagugaagauauauuugaaagaacagaauuaauacauuggguaagacaagcaccaggacaaggacuagaauggauaggauggguaaaaacaguaaguggagcaguaaauuuuggaaguccaaauuuuagacauagaguaagcuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49161 - RNA, 375 nt, Artificial Sequence
  derived and/or modified sequence opt6 from anti-HIV-1_HeavyChain
ggaacaccauggaaugaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49162 - RNA, 375 nt, Artificial Sequence
  derived and/or modified sequence opt6 from anti-HIV-1_HeavyChain
agacaugauuuagaaccaucaggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaucaagauauacaggaggacaaggaugguauuuugauuuauggggaagaggaacacauauagua

SEQ ID NO: 49163 - RNA, 375 nt, Artificial Sequence
  derived and/or modified sequence opt6 from anti-HIV-1_HeavyChain
agacauacaguagaacaaaguggaaguggaguaaaaaaauuaggagcaaguguaagaguaaguuguuuagcaagugaagauauauuugaaagaacagaauuaauacauuggguaagacaagcgccaggacaaggauuagaauggauaggauggguaaaagcaguaaguggagcaguaaauuauggaaguuuagauuuuagacauagaguaaguuuaacaagagauagagauuuaaguacagcgcauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49164 - RNA, 375 nt, Artificial Sequence
  derived and/or modified sequence opt6 from anti-HIV-1_HeavyChain
caagcacauuuagaacaaaguggaagugaaaguaaaaaaccaggagcaaguguaagaguaagcuguuggacaagugaagauauauuugaaaaaagugaacuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49165 - RNA, 375 nt, Artificial Sequence
  derived and/or modified sequence opt6 from anti-HIV-1_HeavyChain
ggaacaccaggaagugaaagugcaaguggaguaagaagaccaggagcaaguguaagaguaaguuguuggacaagugaagauauauuugaaagaagugaauuaauauauuggguaagacaagcaccaggaagaggauuagaauggauaggauggauaaaauuaguaaguggagcaguaaauuuuggaaguguagauuuuagagauagaguaaguuugacaagagauagagauuuauuuacagcacauauggauauaagaggauuaacacaaggagauacagcaacauauuuuugugcaagacaaaaauuugaaaggggagggcaaggaugguauuuugauuuauggggaagaggaacauuaauaguaguaaguagu

SEQ ID NO: 49166 - RNA, 375 nt, Artificial Sequence
  derived and/or modified sequence opt6 from anti-HIV-1_HeavyChain
caaguacauuuagaacaaaguggaaguggaguaaaaaaaccaggagcaaguguaagaguaaguuguuggacaagugaagauauauuugaaaaaagugaacuaauacaauggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49167 - RNA, 375 nt, Artificial Sequence
  derived and/or modified sequence opt6 from anti-HIV-1_HeavyChain
ggaacaccaggaagugaaaguggaaguggaguaaaaaaaguaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcaagaauggauauaagaggauuaacacaagaugauacagcaauauauuuuugugcaagacaaaaauuugcaagaggagaucaaggaugguuuuuugauuuauggggaagaggaacauuaauaguaguaaguagu

SEQ ID NO: 49168 - RNA, 375 nt, Artificial Sequence
  derived and/or modified sequence opt6 from anti-HIV-1_HeavyChain
ggaacaccaggaagugaaaguggaagcggaguaaaaaggccaggagcaaguguaagaguaaguuguuggacaagugaagauauauuugaaacaacagaauuaauacauuggguaagacaagcaccaggacaaggauuagaauggauaggauggguaaaaacaguaaguggagcaguaaauuuuggaaguuuaaauuuuagacauagaguaaguuuaacaagagauagagauuuaaguacagcacauauggauauaagaggauuaacacaagaugauacagcaacauauuuuugugcaagacaaaaauuugcaagaggagaucaaggaugguucuuugauuuauggggaagaggaacauuaauaguaguaaguagu

SEQ ID NO: 49169 - RNA, 372 nt, Artificial Sequence
  derived and/or modified sequence opt6 from anti-HIV-1_HeavyChain
agagcacauuuagaacaaaguggagcaggaguaaaaaaaccaggaggauggguaagaguaaguuguuggacaagugaagauauauuuaaaacagaauuaauacauuggguaagacaagcaccaggacaaggauuagaauggauaggauggguaaaaacaguaacaggagcaguaaauuuuggaucaccaaauuuuagacauagaguaaguuuaacacgagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguuca

SEQ ID NO: 49170 - RNA, 378 nt, Artificial Sequence
  derived and/or modified sequence opt6 from anti-HIV-1_HeavyChain
caaguacaauuaaugcaaaguggagcagaaguaaaaagaccaggagcaaguguaaaaauaaguuguacagcaaguggauuuacauuaacagaucauuauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaagcagaguaauaguaaguagu

SEQ ID NO: 49171 - RNA, 378 nt, Artificial Sequence
  derived and/or modified sequence opt6 from anti-HIV-1_HeavyChain
caaguacaauuaguacaaaguggagcagaaguaaaaaaaccaggagcaaguguaaaaguaaguuguaaagcaaguggauauaauuuuacaggauauuauuuacauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaagcggagauaauagaggauauuuuuuugauuuauggggaaggggaaguagaguaauaguaaguagu

SEQ ID NO: 49172 - RNA, 375 nt, Artificial Sequence
  derived and/or modified sequence opt6 from anti-HIV-1_HeavyChain
ggaacaccaggaaguaaaaguggaaguggaguaaaaaaaccaggggcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaagcccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49173 - RNA, 378 nt, Artificial Sequence
  derived and/or modified sequence opt6 from anti-HIV-1_HeavyChain
caaguacaauuaguacaaucaggagcggaauuaaaaaaaccaggggcaucaguaaaaguaucaugcgaagcaucaggauauagcuuuacagaucaccauauacauuggguaagacaagcaccaggacaaggacuagaauggcuaggauggaugaacccaaauaauggagauacagcauacgcacaaacauucuuaggaagaguaacaaugacaagagauacaucaauaaauacagcauacauggaauuaagcagacuaacaagcgaugacacagcaguauacuuuugcgcaagaaaaacagcaggagauguaucaggagauaaaagaggauuuuucuuugacuuauggggaagaggaagcagaguaauaguaucaagc

SEQ ID NO: 49174 - RNA, 378 nt, Artificial Sequence
  derived and/or modified sequence opt6 from anti-HIV-1_HeavyChain
caaguauauaugaguaguagaggaggaaugaaaaaaccaggagcaaguaugacaguaaguuguaaaacagcagaugaagauauauuugaugcggcauauaugcauuggguaagacaagcaccaggacaaacauuugaaugguuaggauggaugaaaccaguaacaggagcaguaaauuaugcaagacaauuucaaggaagaguaaguuuuuauaggacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagu

SEQ ID NO: 49175 - RNA, 378 nt, Artificial Sequence
  derived and/or modified sequence opt6 from anti-HIV-1_HeavyChain
caaguacaauuaguacaaagcggagcagaaguaaaaaaaccaggagcaagcguaaaaguaagcuguaaagcaagcggguacacauucacagcauauuacaugcacuggcuaagacaagcaccaggacaaggacuagaauggaugggauggauaaauccacauagcggaggaacaaacuuugcacaaaaauuucaaggaagaguaacaaugacaagagacacaagcauaacaacagcauauauggaacuaucaagauuaagaucagacgauacagcaacauauuucugugcaagacaaaaauucgcaagcagauacucaggagaucaaggaagcuauuucgaucuauggggaagaggaacacuaauaguaguaagcuca

SEQ ID NO: 49176 - RNA, 375 nt, Artificial Sequence
  derived and/or modified sequence opt6 from anti-HIV-1_HeavyChain
agagcacauuuagaacaaaguggagcaggaguaaaaaaauuaggagcaaguguaagaguaaguuguuggacaagugaagauauauuugaaagaacagaacuaauacauuggguaagacaagcaccaggacaaggauuagaauggauaggauggguaaaagcaguaaguggagcaguaaauuauggaaguuuagauuuuagacauagaguaagcuuaacaagagauagagaucuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaagcagu

SEQ ID NO: 49177 - RNA, 378 nt, Artificial Sequence
  derived and/or modified sequence opt6 from anti-HIV-1_HeavyChain
caaguaagauuaguacaaaguggagcagauguaaaacaaccaggagcaaguguaaaaguaaguuguaaagcaaguggauauacauuuacagauuauuauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49178 - RNA, 378 nt, Artificial Sequence
  derived and/or modified sequence opt6 from anti-HIV-1_HeavyChain
caagcacauuuaggaaauaaaucaggaucaggaguaaaaaaaccaggagcaucaguaagaguaucauguuggacaucagaagauauauuugaaaaaagugaacuaauacauuggguaagacaagcaccaggacaaggauuagaauggauaggauggguaaaaacaguaacaggagcaguaaauuuuggaucaagugauuuuagacaaagaguaucauuaacaagagauagagauuuauuuacagcacauauggauauaagaggauuaacacaaggagauacagcaacauauuuuugugcaagacaaaaauuuuaugcaggaggacaaggaugguauuuugaucuauggggaagaggaacauuaauaguaguaagcuca

SEQ ID NO: 49179 - RNA, 381 nt, Artificial Sequence
  derived and/or modified sequence opt6 from anti-HIV-1_HeavyChain
caaguauauauggaacaaaguggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuuguacaagaaaaacagcaggagauguaaguggagauaaaagaggauuuuuuuuugauuuauggggaagaggaaguagaguaauaguaaguagu

SEQ ID NO: 49180 - RNA, 381 nt, Artificial Sequence
  derived and/or modified sequence opt6 from anti-HIV-1_HeavyChain
caaguauauguagaacaaccaggaggaggaguaaaaaaaccaggagcaaguguaacauuaaguuguaaaacagcagaugaagauguauuugaugcaacauauaugcauuggguaagacaagcaccaggacaaacauuugaaugguuaggauggaugaaaccaguaacaggagcaguaaauuaugcaagaaaauuucaaggaagaguaucauuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49181 - RNA, 381 nt, Artificial Sequence
  derived and/or modified sequence opt6 from anti-HIV-1_HeavyChain
caaguauauauggaacaagcaggaguagaaguagaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaaucuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49182 - RNA, 381 nt, Artificial Sequence
  derived and/or modified sequence opt6 from anti-HIV-1_HeavyChain
caaguauauauggaacaagcaggagcaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaagcuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49183 - RNA, 381 nt, Artificial Sequence
  derived and/or modified sequence opt6 from anti-HIV-1_HeavyChain
caaguacauauggaacaagcaggagcaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuucuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49184 - RNA, 381 nt, Artificial Sequence
  derived and/or modified sequence opt6 from anti-HIV-1_HeavyChain
caaguauauauggaacaagcaggagcagaaguaaaaaaaccaggagcaaguguaacauuaaguugugaaacagcagaugaagauguauuugaugcagcauauaugcauuggguaagacaagcaccaggacaaacauuugaaugguuaggauggaugaaaccaguaacaggagcaguaaauuaugcaaggaaauuucaagggagaguaaguuuuuauagaacaagagaacuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49185 - RNA, 381 nt, Artificial Sequence
  derived and/or modified sequence opt6 from anti-HIV-1_HeavyChain
caaguauauauggaacaaccaggaggaggaguaaaaaaaccgggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49186 - RNA, 372 nt, Artificial Sequence
  derived and/or modified sequence opt6 from anti-HIV-1_HeavyChain
gcaacaccauggaauaaaaguggaaguggaguaaaaaaaccaggagcaagugugagaguaaguuguuggacaagugaagauauauuugaaagaacagaauuaaguuuaguaagacaagcaccaggacaaggauuagaauggauaggauggaugaaaacaguaacaggagcaguaaauuuuggaaguccaaauuuuagacauggaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49187 - RNA, 381 nt, Artificial Sequence
  derived and/or modified sequence opt6 from anti-HIV-1_HeavyChain
caaguauauauggaacaagcaggagcaggaaugaaaaaaccaggagcaaguaugacagcaaguuguaaaacagcagaugaagauauauuugaugcagcauauaugcauuggguaagacaagcaccaggacaaacauuugaaugguuaggauggaugaaaccaguaacaggagcaguaaauuaugcaaggcaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagu

SEQ ID NO: 49188 - RNA, 378 nt, Artificial Sequence
  derived and/or modified sequence opt6 from anti-HIV-1_HeavyChain
caaguacaauuaguacaaaguggagcagaaguaaaaaaaccaggagcaaguguaaaaguaaguuguaaagcaaguggauauacauuuacaggauauuauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaauuugaugauacagcaguauauuuuugugcaagaaaaacaaaagcagauguaaguggagaugauagaggauuuuuuuuugauuuauggggaagaggaacaagaguaauaguaaguagu

SEQ ID NO: 49189 - RNA, 381 nt, Artificial Sequence
  derived and/or modified sequence opt6 from anti-HIV-1_HeavyChain
agaguauauauggaacaagcaggagcaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcagugaguuaugcaagaaaauuucaaggaagaguaaguuuuacaaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49190 - RNA, 381 nt, Artificial Sequence
  derived and/or modified sequence opt6 from anti-HIV-1_HeavyChain
caaguauauauggaacaaaguggaggaggaguaaaaaaaccaggaccaaguguaacauuaaguuguaaaacagcagaugaagauguauuugaugcagcauauaugcauuggguaagacaagcaccaggacaaacauuugaauggcuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49191 - RNA, 378 nt, Artificial Sequence
  derived and/or modified sequence opt6 from anti-HIV-1_HeavyChain
caaguacaauuaguacaaaguggagcagaaguaaaaaaaccaggagcgaguguaaaaguaaguuguaaagcaaguggauauacauuuacaggauauuauauacauuggaugagacaagcaccaggacaaggauuagaauggaugggauggauaaauccaaauaguggagcaguaaguuaugcaagaaaauuucaaggaagaguaaguuuuuuacaugaucaaggaauaagaauggcauauauggauuuaagaaauuuaagauuugaugauacagcaguauauuuuugugcaagaaaaacagcaggagauguaaguggagauaauagaggauauuuuuuugauuuauggggaagaggaucaagaguaauaguaaguagu

SEQ ID NO: 49192 - RNA, 381 nt, Artificial Sequence
  derived and/or modified sequence opt6 from anti-HIV-1_HeavyChain
caaguacauauggaacaagcaggaguagaaguagaaaaaccaggagcaagcguaacauuaaguuguaaaacagcagaugaagauguauuugaugcagcauauaugcauuggguaagacaagcaccaggacaaacauuugaaugguuaggauggaugaaaccaguaacaggggcaguaaauuaugcaagaaaauuucaaggaagaguaaguuuuuauagaacaagagaauuaggaauagcauauauggauuuaagaaauuuaagauuugaugauacagcaguauacuuuugugcaagaaaaacagcaggagauguaaguggagauaaaagaggauuuuuuuuugauuuauggggaagaggaaguagaguaauaguaaguagu

SEQ ID NO: 49193 - RNA, 381 nt, Artificial Sequence
  derived and/or modified sequence opt6 from anti-HIV-1_HeavyChain
caaguauauauggaacaagcaggagcaggaguaaaaaaaccaggagcaagugcaacauuaaguuguaaaacagcagaugaagauguauuugaugcagcauauaugcauuggguaagacaagcgccaggacaaacauuugaaugguuaggauggaugaaaccaguaacaggagcaguaaguuaugcaagaaaauuucaaggaagaguaaguuuuuauaugacaagagaauuaggaauggcauauauggaucuaagaaauuuaagauuugaugauacagcaguauauuuuugugcaagaaaaacagcaggagauguaaguggagauaauagaggauauuuuuuugauuuauggggaagaggaagcagaguaauaguaaguagu

SEQ ID NO: 49194 - RNA, 375 nt, Artificial Sequence
  derived and/or modified sequence opt6 from anti-HIV-1_HeavyChain
ggacaugauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaauauauuuuugugcaagacaaaaauuugcaagaggagaucaaggaugguuuuuugauuuauggggaagaggaacguuaauaguaguaaguagu

SEQ ID NO: 49195 - RNA, 378 nt, Artificial Sequence
  derived and/or modified sequence opt6 from anti-HIV-1_HeavyChain
caagcacauaggggaacaauauggggacuagaaguaaaaaaaccaggaggauggguaagaguaagcuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauucgaaagaggaggacaaggaugguauuuugauuuauggggaagaggaacauuaauaguaguaaguagu

SEQ ID NO: 49196 - RNA, 381 nt, Artificial Sequence
  derived and/or modified sequence opt6 from anti-HIV-1_HeavyChain
caaguacauauggaacaagcaggagcaggaguagaaaaaccaggagcaagcguaacauuaagcuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaagcuuuuauaugacaagagaauuaggaauggcauauauggauuuaagaaauuuaagauuugaugauacagcaguauauuuuugugcaagaaaaacagcaggagauguaagcggagauaauagaggauauuuuuuugauuuauggggaagaggaaguagaguaauaguaaguagu

SEQ ID NO: 49197 - RNA, 381 nt, Artificial Sequence
  derived and/or modified sequence opt6 from anti-HIV-1_HeavyChain
caaguauauauggaacaaaguggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49198 - RNA, 381 nt, Artificial Sequence
  derived and/or modified sequence opt6 from anti-HIV-1_HeavyChain
caaguauauauggaacaaaguggaggaggaguaaaaaaaccaggagcaaguguaacauuaaguuguaaaacagcagaugaagauguauuugaugcagcauauaugcauuggguaagacaagcaccaggacaaacauuugaauggcuaggauggaugaaaccaguaacaggagcaguaaauuaugcaagaaaauuucaaggaagaguaagcuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49199 - RNA, 381 nt, Artificial Sequence
  derived and/or modified sequence opt6 from anti-HIV-1_HeavyChain
gaaguauauauggaacaaaguggaggaggaguaaaaaaaccaggagcaaguguaacauuaaguuguaaaacagcaagugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49200 - RNA, 381 nt, Artificial Sequence
  derived and/or modified sequence opt6 from anti-HIV-1_HeavyChain
caaguacaauuaguacaaaguggagcagaaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaaucuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49201 - RNA, 381 nt, Artificial Sequence
  derived and/or modified sequence opt6 from anti-HIV-1_HeavyChain
caaguauuuauggaacaaaguggaggaggaaugaaaaaaccaggagcaaguaugacaguaagcuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49202 - RNA, 381 nt, Artificial Sequence
  derived and/or modified sequence opt6 from anti-HIV-1_HeavyChain
caaguauauauggaacaagcaggaggaggaaugaaaaaaccaggagcaaguaugacaguaagcuguaaaacagcagaugaagauauauuugaugcagcauauaugcauuggguaagacaagcaccaggacaaacauuugaaugguuaggauggaugaaaccaguaacaggagcaguaaauuaugcaagaagauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagu

SEQ ID NO: 49203 - RNA, 381 nt, Artificial Sequence
  derived and/or modified sequence opt6 from anti-HIV-1_HeavyChain
caaguauauauggaacaagcaggagcaggaguaaaaaaaccaggagcaaguguaacauuaaguuguaaagcagcggaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49204 - RNA, 381 nt, Artificial Sequence
  derived and/or modified sequence opt6 from anti-HIV-1_HeavyChain
caaguauuuauggaacaagcaggagcaggaaugaaaaaaccaggagcaaguaugacaguaaguuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagaucuaaaauuugaugauacagcaguauauuuuugugcaagaaaaacaaaaggagauguaaguggagaugauagaggauuuuuuuuugauuuauggggaagaggaacaagaguaauaguaaguagu

SEQ ID NO: 49205 - RNA, 381 nt, Artificial Sequence
  derived and/or modified sequence opt6 from anti-HIV-1_HeavyChain
caaguauauauggaacaaccaggaggagaaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49206 - RNA, 381 nt, Artificial Sequence
  derived and/or modified sequence opt6 from anti-HIV-1_HeavyChain
caaguacauauggaacaagcaggagcaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaaggaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaagcagaguaauaguaaguagu

SEQ ID NO: 49207 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggggauguaaguggagauaaaagaggauuuuuuuuugauuuauggggaagaggaccaagaguaauaguaaguagu

SEQ ID NO: 49208 - RNA, 381 nt, Artificial Sequence
  derived and/or modified sequence opt6 from anti-HIV-1_HeavyChain
caaguacaauuaguacaaagcggagcagaaguaaaaaaaccaggagcaagcguaaaaguaagcuguaaagcaagcggacacacauucacaaacuaugacauaaacuggguaagacaagcaccaggacaaggacuagaauggauaggauggguaaaaauaguaagcggaacaguaaacuucgcaucacuagauuucagaaacagaauaucacuaucaagagauagagaucuaucaacagcauacauggacauaagaggacuaacacaagaugacacggcaacauacuuuugcgcaagacaaaaauuugcaucaagauauagcggagaccaaggaucauacuuugacuuauggggaagaggaacauuaauaguaguaucaagc

SEQ ID NO: 49209 - RNA, 381 nt, Artificial Sequence
  derived and/or modified sequence opt6 from anti-HIV-1_HeavyChain
caaguauauauggaacaagcaggaggaggaaugaaaaaaccaggagcaaguaugacaguaaguuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauacagauuuaagagauuuaaaauuugaugauacagcaguauauuuuugugcaagaaaaacaaaaggagauguaaguggagaugauagaggauuuuuuuuugauuuauggggaagaggaacaagaguaauaguaaguuca

SEQ ID NO: 49210 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacacuaaguuguaaaacagcagaugaagauguauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagu

SEQ ID NO: 49211 - RNA, 381 nt, Artificial Sequence
  derived and/or modified sequence opt6 from anti-HIV-1_HeavyChain
caaguauauauggaacaagcaggaggaggaguaaaaaaaccaggagcaagcguaacauuaaguuguaaaacagcagaugaagauguauuugaugcagcauauaugcauuggguaagacaagcaccaggacaaacauuugaauggccaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaagcagu

SEQ ID NO: 49212 - RNA, 381 nt, Artificial Sequence
  derived and/or modified sequence opt6 from anti-HIV-1_HeavyChain
caaguauauauggaacaagcaggaggaggaguaaaaaaaccaggagcaagugcaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49213 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugagauggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49214 - RNA, 381 nt, Artificial Sequence
  derived and/or modified sequence opt6 from anti-HIV-1_HeavyChain
caaguacaacuaguacaaucaggcgcagaaguaaaaaaaccaggagcaucaguaaaaguaucaugcagagcaucaggauauacauuuggaaaucacgcaauaucauggguaagacaagcaccaggacaaggauuagaauggaugggauggauaagaccaaaaacaggagcaagaaaucaagcaagacaauuccaaccaagaauaucauuaacaagagauagagcauuaucaacagcauacuuagacuuaaacucucuaacaagcgcagacucaggaacauacuuuugcgcaagacaaacauuuaaaccagacuuuuacuuugcagaucaaggauggucauucaaucuauggggaagaggagcacacuuuauaguaagcuca

SEQ ID NO: 49215 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaccaggaucaagaguaauaguaaguagu

SEQ ID NO: 49216 - RNA, 381 nt, Artificial Sequence
  derived and/or modified sequence opt6 from anti-HIV-1_HeavyChain
caaguauauauggaacaagcaggagcaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaagcagaguaauaguaagcagu

SEQ ID NO: 49217 - RNA, 381 nt, Artificial Sequence
  derived and/or modified sequence opt6 from anti-HIV-1_HeavyChain
caaguacauauggaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaagcagaguaauaguaaguagu

SEQ ID NO: 49218 - RNA, 381 nt, Artificial Sequence
  derived and/or modified sequence opt6 from anti-HIV-1_HeavyChain
caaguauauauggaacaagcaggagauggaaugaaaaaaccaggagcaaguaugacaguaaguuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagu

SEQ ID NO: 49219 - RNA, 381 nt, Artificial Sequence
  derived and/or modified sequence opt6 from anti-HIV-1_HeavyChain
caaguacaauuaguacaaaguggagcagaaguaaaaaaaccaggagcaagcguaacauuaaguuguaaaacagcagaugaagauguauuugaugcagcauauaugcauuggguaagacaagcacaaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaaucuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49220 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaagucaaguaauaguaaguagu

SEQ ID NO: 49221 - RNA, 381 nt, Artificial Sequence
  derived and/or modified sequence opt6 from anti-HIV-1_HeavyChain
caaguacaauuaguacaaaguggagcagaaguaagaaaaccaggagcaagcguaaaaguaaguuguaaagcaaguggauacacauucacaaacuauuacaugcacuggguaagacaagcaccaggacaaggacuagaauggauaggauggguaaaaauaguaagcggaacaguaaacuuugcaucacuagauuucagaaacagaauaucacuaucaagagauagagaucuaucaacagcauacauggacauaagaggacuaacacaagaugacacagcaacauacuuuugcgcaagacaaaaauuugcaucaagauauagcggagaccaaggaucauacuuugacuuauggggaagaggaacauuaauaguaguaucaagc

SEQ ID NO: 49222 - RNA, 381 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggaacaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49223 - RNA, 381 nt, Artificial Sequence
  derived and/or modified sequence opt6 from anti-HIV-1_HeavyChain
uuaauacauuuagcacaaaguggagcagaaguaaaaaaaccaggagcaaguguaacauuaaguuguaaaacagcagaugaagauguauuugaugcagcauauaugcauuggguaaggcaagcaccaggacaaacauuugaaugguuaggauggaugaaaccaguaacaggagcaguaaguuaugcaagaaaauuucaaggaagaguaaguuuuuauaugacgagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaagcagaguaauaguaaguuca

SEQ ID NO: 49224 - RNA, 381 nt, Artificial Sequence
  derived and/or modified sequence opt6 from anti-HIV-1_HeavyChain
caaguacaauuaguacaaaguggagcagaaguaaaaaaaccaggagcaaguaugacaguaaguuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauucuuuuuugauuuauggggaagaggaacaagaguaauaguaaguagu

SEQ ID NO: 49225 - RNA, 381 nt, Artificial Sequence
  derived and/or modified sequence opt6 from anti-HIV-1_HeavyChain
caaguauauauggaacaaggaagaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuacagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49226 - RNA, 381 nt, Artificial Sequence
  derived and/or modified sequence opt6 from anti-HIV-1_HeavyChain
caaguauauauggaacaagcaggaggaggaaugaaaaaaccaggagcaaguaugacaguaaguuguaaaacagcagaugaagauguauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaaagugaugauacagcaguauauuuuugugcaagaaaaacagcaggagauguaaguggagauaaaagaggauuuuuuuuugauuuauggggaagaggaaguagaguaauaguaaguagu

SEQ ID NO: 49227 - RNA, 381 nt, Artificial Sequence
  derived and/or modified sequence opt6 from anti-HIV-1_HeavyChain
caaguacaauuaguacaaagcggagcagaaguaaaaaaaccaggaucaagcauaaaaguaagcuguaaagcaaguggagacacaauaucaagauaugcaauaaacuggguaagacaagcaccaggacaaggacuagaauggauaggauggguaaaaacaguaacaggagcaguaaacuuuggaucacuagauuucagacacagaauaucacuaacaagagauagagaucuauuuacagcacacaugggaauaagaggacuaacacaaggagacacagcaacauacuuuugcgcaagacaaaaauuugaaucaagauauacaggaggacaaggaugguacuuugacuuauggggaagaggaacacauauaguaguaucaagu

SEQ ID NO: 49228 - RNA, 381 nt, Artificial Sequence
  derived and/or modified sequence opt6 from anti-HIV-1_HeavyChain
caaguauauauggaacaagcaggaggaggaguaaaaaaaccaggagcaagcguaacauuaaguuguaaaacagcagaugaagauauauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49229 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaccaggacaaacauuugaauggcuaggauggaugaaaccaguaacaggagcaguaaauuaugcaagaaauuuucaaggaagaguaaguuuuuauagaacaagagaauuaggaauagcauauauggauuuaagaaauuuaagauuugaugauacagcaguauauuuuugugcaagacaaaaauuugaaaguagauauaguggagaucaaggaaguuauuuugauuuauggggaagaggaacauuaauaauaguaaguagu

SEQ ID NO: 49230 - RNA, 381 nt, Artificial Sequence
  derived and/or modified sequence opt6 from anti-HIV-1_HeavyChain
caaguauauauggaacaagcaggaggaggaguaaaaagaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49231 - RNA, 381 nt, Artificial Sequence
  derived and/or modified sequence opt6 from anti-HIV-1_HeavyChain
caagugcaauuaguacaaaguggagaugaaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaacuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49232 - RNA, 381 nt, Artificial Sequence
  derived and/or modified sequence opt6 from anti-HIV-1_HeavyChain
caaguacaauuaguacaaucaggagcaggaguaaaaaaaccaggaagcucaguaaaaguaucgugcaaagcaucaggaggaacauuuagcucauacgcaauaaauugguuaagacaaguaccaggacaaagaccagaauggaugggauggauaagaccaaaaacaggagcgagaaaucaagcaagacaauuccaaccaagaauaucacuaacaagagauagagcacuaucaacagcauacuuagacuuaaacucacuaacaagcgcagacucaggaacauacuuuugcgcaagacaaacauuuaaaccagacuuuuacuuugcagaucaaggauggucauucaaucuauggggaagaggagcacacuuuauaguaagcuca

SEQ ID NO: 49233 - RNA, 381 nt, Artificial Sequence
  derived and/or modified sequence opt6 from anti-HIV-1_HeavyChain
caaguauauauggaaagagcaggaggaggaguaaaaaaaccaggagcaagcguaacauuaaguugugaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49234 - RNA, 381 nt, Artificial Sequence
  derived and/or modified sequence opt6 from anti-HIV-1_HeavyChain
caaguauauauggaacaagcaggagcaggaaugaaaaaaccaggagcaaguaugacaguaaguuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaagcuuuuuacaagaucaaggaauaagaauagcauauauggaucuaagagaucuaaaauuugaugauacagcaguauauuuuugugcaagaaaaacaaaaggagauguaaguggagaugauagaggauuuuuuuuugaucuauggggaagaggaacaagaguaauaguaaguagu

SEQ ID NO: 49235 - RNA, 381 nt, Artificial Sequence
  derived and/or modified sequence opt6 from anti-HIV-1_HeavyChain
caaguauauaugggagcaggaagaggaggaguaaaaaaaccaggagcaaguguaacauuaagcuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49236 - RNA, 381 nt, Artificial Sequence
  derived and/or modified sequence opt6 from anti-HIV-1_HeavyChain
caaguauauauggaacaagcaggagcaggaguaaaaaaaccaggagcaaguguaacauuaaguuguaaaacagcggaugaagauguauuugaugcagcauauaugcauuggguaagacaagcaccaggacaaccauuugaaugguuaggauggaugaaaccaguaacaggagcaguaaguuaugcaagaaaauuucaaggaagaguaagcuuuuauaugacaagagaauuaggaauggcauauauggauuuaagaaauuuaagauuugaugauacagcaguauauuuuugugcaagaaaaacagcaggagacguaagcggagauaauagaggauauuuuuuugauuuauggggaagaggaaguagaguaauaguaaguagu

SEQ ID NO: 49237 - RNA, 381 nt, Artificial Sequence
  derived and/or modified sequence opt6 from anti-HIV-1_HeavyChain
caaguacaacuaguacaaucaggagcagaaguaaaaaaaccaggagcaucaguaaaaauaucaugcaaagcaucaggauauacauuuauaagacacggaauacauugguuaagacaaguaccaggacaaagaccagaauggaugggauggauaagaccaaaaacaggagcaagaaaucaagcaagacaauuccaaccaagaauaucacuagcaagagauagagcacuaucaacagcauacuuagacuuaaacucacuaacaagugcagacucaggaacauacuuuugcgcaagacaaacauuuaaaccagacuuuuacuuugcagaucaaggauggucauucaauuuauggggaagaggagcacacuuuauaguaagcuca

SEQ ID NO: 49238 - RNA, 381 nt, Artificial Sequence
  derived and/or modified sequence opt6 from anti-HIV-1_HeavyChain
caaguauuacuaguacaaucaggagcagaaguaaaaaaaccaggaagcucaguaaaaguaucaugcaaagcaucaggagauagcuuaacaaaauacgcauucucauggguaagacaagcaccaggacaaggaccagaauggaugggauggauaagaccaaaaacaggagcaagaaauagagcaagacaauuccaaccaagaauaucacuaacaagagauagagcacuaucaacagcauacuuagacuuaaacucacuaacaagcgcagacucaggaacauacuuuugcgcaagacaaacauuuaaaccagacuuuuacuuugcagaucaaggauggucauucaaucuauggggaagaggagcacacuuuauaguaagcuca

SEQ ID NO: 49239 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaagaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagc

SEQ ID NO: 49240 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggaucuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49241 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacguuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugaucuauggggaccaggaaguagaguaauaguaaguagc

SEQ ID NO: 49242 - RNA, 381 nt, Artificial Sequence
  derived and/or modified sequence opt6 from anti-HIV-1_HeavyChain
caaguauauauggaacaagcaggaggaggaaugaaaaaaccaggagcaaguaugacaguaaguuguaaaacagcagaugaagauauauuugaugcagcguauaugagauggguaagacaagcaccaggacaaacauuugaaugguuaggauggaugaaaccaguaacaggagcaguaaauuaugcaagacaauuucaaggaagaguaaguuuuuauagaacaagagaauuaggaauagcguauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagu

SEQ ID NO: 49243 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacggcagaugaagauguauuugaugcagcauauaugcauuggguaagacaagcaccaggacaaacauuugaaugguuaggauggaugaaaccaguaacaggagcaguaagcuaugcaagaaaauuucaaggaagaguaaguuuuuauaugacaagagaauuaggaauggcauauuuagauuuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49244 - RNA, 381 nt, Artificial Sequence
  derived and/or modified sequence opt6 from anti-HIV-1_HeavyChain
caaguacaauuaguacaaaguggagcagaaguaaaaaaaccaggagcaaguguaaaaguaagcuguaaagcaagcggauacacauucacaggauauuacaugcacuggguaagacaagcaccaggacaaggacuagaauggauaggauggguaaaaacaguaacaggagcaguaaacuuuggaucacuagauuucagacacagaauaucacuaacaagagauagagauuuauuuacagcacacauggacauaagaggacuaacacaaggagacacagcaacauacuuuugugcaagacaaaaauuugaaucaagauauacaggaggacaaggaugguauuuugacuuauggggaagaggaacacauauaguaguaucaagu

SEQ ID NO: 49245 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcggaugaagauguauuugaugcagcauauaugcauuggguaagacaagcaccaggacaaacauuugaaugguuaggauggauaaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaagcagaguaauaguaagcagu

SEQ ID NO: 49246 - RNA, 381 nt, Artificial Sequence
  derived and/or modified sequence opt6 from anti-HIV-1_HeavyChain
caaguauauauggaacaagcaggaggaggaaugaaaaaaccaggagcaaguguaacaguaagcuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaauuugaugauacagcaguguauuuuugugcaagaaaaacaaaaggagauguaaguggagaugauagaggauuuuuuuuugauuuauggggaagaggaacaagaguaauaguaaguagu

SEQ ID NO: 49247 - RNA, 381 nt, Artificial Sequence
  derived and/or modified sequence opt6 from anti-HIV-1_HeavyChain
caagcacauuuagaacaaagcggaagcggaguaaaaaaaccaggagcaaguguaagaguaagcuguuggucaagugaagacauaaguaaagcagaauuaauacauuggguaagacaagcgccaggacaaggacuagaauggauaggauggguaaaaacaguaacaggagcaguaaauuuuggaucauuagauuucagacauagaauaucauuaacaagagauagagauuuauuuacagcacauauggacauaagaggacuaacacaaggagauacagcaacauauuuuugugcaagacaaaaauuugaaucaagauauacaggaggacaaggaugguauuuugacuuauggggaagaggaacacauauaguaguaucaagu

SEQ ID NO: 49248 - RNA, 381 nt, Artificial Sequence
  derived and/or modified sequence opt6 from anti-HIV-1_HeavyChain
caaguauauauggaagcaggaagaggaggaguaaaaaaaccaggagcaagugcaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcgagaaaaacagcaggagauguaaguggagauaauagaggauauuuuuuugauuuauggggaagaggaaguagaguaauaguaaguagu

SEQ ID NO: 49249 - RNA, 381 nt, Artificial Sequence
  derived and/or modified sequence opt6 from anti-HIV-1_HeavyChain
agauguauauggaggcaagcaggaggaggaguaaaaaaaccaggagcaaguguaacacuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaagcagaguaauaguaaguagu

SEQ ID NO: 49250 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacacuaaguuguaaaacagcagacgaagauguauuugaugcagcauauaugcauuggguaagacaagcaccaggacaaacauuugaaugguuaggauggauaaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaagcagu

SEQ ID NO: 49251 - RNA, 384 nt, Artificial Sequence
  derived and/or modified sequence opt6 from anti-HIV-1_HeavyChain
caaagccaucuagaacaaucaggaucagcaaugaaaaaaccaggagcaucaguaaaaagcucaugcuggacaucagaagauauauuugacacaacagaacuaauauacuggguaagacaagcaccaggacaaggacuagaauggauaggauggguaaaaauaguaaguggaacaguaaacuuugcaucauuagauuucagaaacagaauaucacuaucaagagauagagaucuaucaacagcauacauggacauaagaggacuaacacaagaugacacagcaacauacuuuugcgcaagacaaaaauuugcaucaagauauagcggagaccaaggaucauacuuugacuuauggggaagaggaacauuaauaguaguaucaagc

SEQ ID NO: 49252 - RNA, 381 nt, Artificial Sequence
  derived and/or modified sequence opt6 from anti-HIV-1_HeavyChain
agauguuuauggagacaagcaggaggaggaaugaaaaaaccaggagcaaguaugacaguaaguuguaaaacagcagaugaagauguauuugaugcagcauauaugcauuggguaagacaagcaccaggacaaacauuugaauggcuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaagcggagauaaaagaggauuuuuuuuugauuuauggggaagaggaaguagaguaauaguaaguagu

SEQ ID NO: 49253 - RNA, 381 nt, Artificial Sequence
  derived and/or modified sequence opt6 from anti-HIV-1_HeavyChain
agauguauaugggaaagagcaggaggaggaaugaaaaaaccaggagcaaguaugacaguaaguuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggaucuaagagauuuaaaauuugaugauacagcaguauauuuuugugcaagaaaaacaaaaggagauguaaguggagaugauagaggauuuuuuuuugauuuauggggaagaggaacaagaguaauaguaaguagu

SEQ ID NO: 49254 - RNA, 381 nt, Artificial Sequence
  derived and/or modified sequence opt6 from anti-HIV-1_HeavyChain
caaguacaauuagaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49255 - RNA, 381 nt, Artificial Sequence
  derived and/or modified sequence opt6 from anti-HIV-1_HeavyChain
caaguauauauggaacaagcaggaggaggaaugaaaaaaccaggagcaaguaugacaguaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuccaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49256 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugagauggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49257 - RNA, 381 nt, Artificial Sequence
  derived and/or modified sequence opt6 from anti-HIV-1_HeavyChain
caaguauauauggaacaaccaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaagcggagauaauagaggauauuuuuuugauuuauggggaagaggaaguagaguaauaguaaguagu

SEQ ID NO: 49258 - RNA, 381 nt, Artificial Sequence
  derived and/or modified sequence opt6 from anti-HIV-1_HeavyChain
caaguauauauggaacaagcaggaggagaaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguaggguaauaguaaguagu

SEQ ID NO: 49259 - RNA, 381 nt, Artificial Sequence
  derived and/or modified sequence opt6 from anti-HIV-1_HeavyChain
caaguacaacuaguacaaucaggagcagaaguaaaaaaaccaggagcaucaguaagaguaucaugccaagcaucaggauauauauuuacaggauacuuuguaaauugguuaagacaacuaccaggacaaagaccagaauggaugggauggauaagaccaaaaucaggagcaagaaaucaagcaagacaauuccaaccaagaauaucacuaacaagagauagagcauuaucaacagcauacuuagacucaaacucacuaacaagcgcagacucaggaacauacuuuugcgcaagacaaacauuuaaaccagacuuuuacuuugcagaucaaggauggucauucaaucuauggggaagaggagcacacuuuauaguaagcuca

SEQ ID NO: 49260 - RNA, 381 nt, Artificial Sequence
  derived and/or modified sequence opt6 from anti-HIV-1_HeavyChain
ggauguauauggacacaagcaggaggaggaguaaaaaaaccgggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49261 - RNA, 381 nt, Artificial Sequence
  derived and/or modified sequence opt6 from anti-HIV-1_HeavyChain
agauguauauggagacaagcaggaggaggaaugaaaaaaccaggagcaaguaugacaguaaguuguaaaacagcagaugaagauauauuugaugcagcauauaugcauuggguaagacaagcaccaggacaaacauuugaauggcuaggauggaugaaaccaguaacaggagcaguaaauuaugcaagacaauuucaaggaagaguaaguuuuuauagaacaagagaacuaggaauagcauauauggauuuaagagauuuaaaauuugaugauacagcaguguauuuuugugcaagaaaaacaaaaggagauguaaguggagaugauagaggauuuuuuuuugauuuauggggaagaggaacaagaguaauaguaaguagu

SEQ ID NO: 49262 - RNA, 381 nt, Artificial Sequence
  derived and/or modified sequence opt6 from anti-HIV-1_HeavyChain
caaguauauauggaacaagcaggaggaggaguaaaaaaaccaggagcaagcguaacauuaaguuguaaaacagcagaugaagauguauuugaugcagcauauaugcauuggguaagacaagcaccaggacaaacauuugaauggguaggauggaugaaaccaguaacaggagcaguaaguuaugcaagaaaauuucaaggaagaguaaguuuuuauaugacaagagaauuaggaauggcguauauggaucuaagaaauuuaagauuugaugauacagcaguauauuuuugugcaagaaaaacagcaggagauguaaguggagauaauagaggauauuuuuuugauuuauggggaagaggaagcagaguaauaguaaguagu

SEQ ID NO: 49263 - RNA, 381 nt, Artificial Sequence
  derived and/or modified sequence opt6 from anti-HIV-1_HeavyChain
caaguauauauggaacaagcaggaggaggaguaaaagaaccaggagcaaguguaacacuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggaucuaagaaauuuaagauuugaugauacagcaguauauuuuugugcaagaaaaacagcaggagauguaaguggagauaaaagaggauuuuuuuuugauuuauggggaagaggaaguagaguaauaguaaguagu

SEQ ID NO: 49264 - RNA, 381 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggaguagugaagauauauuuaaaacagaauuaauacauuggguaagacaagcaccagggcaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaucaagu

SEQ ID NO: 49265 - RNA, 384 nt, Artificial Sequence
  derived and/or modified sequence opt6 from anti-HIV-1_HeavyChain
caagcucauuuagaacaaaguggaaguggaguaaaaaaaccaggagcaaguguaagaguaaguuguuggaguagugaagauauauuugaaagaacagaacuaauacauuggguaagacaagcaccaggacaaggauuagaauggauaggauggaugaaaacaguaacaggagcaguaaauuuuggaagcuuagauuuuagacauagaauaaguuuaacaagggauagagaucuauuuacagcacauauggauauaagaggauuagcacaaggagauacagcaacauauuuuugugcaagacaaaaauuugaaaguagauauacaggaggacaaggaugguauuuugauuuauggggaagaggaacacauauaguaguaaguagu

SEQ ID NO: 49266 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagaucuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagc

SEQ ID NO: 49267 - RNA, 384 nt, Artificial Sequence
  derived and/or modified sequence opt6 from anti-HIV-1_HeavyChain
caaagucauuuagaacaaaguggaagugcaaugaaaaaaccaggagcaagcguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaagcuuaaguagagauagagauuuaaguacagcauauauggauauaagaggacuaacacaagaugauacagcaacauauuuuugugcaagacaaaaauuugcaaguagauauaguggagaucaagggaguuauuuugauuuauggggaagaggaacauuaauaguaguaaguagu

SEQ ID NO: 49268 - RNA, 384 nt, Artificial Sequence
  derived and/or modified sequence opt6 from anti-HIV-1_HeavyChain
agucauacauggaauaauagaggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaagcuuaaguagagauagggauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagu

SEQ ID NO: 49269 - RNA, 381 nt, Artificial Sequence
  derived and/or modified sequence opt6 from anti-HIV-1_HeavyChain
caaucacacuuagaacaaagcggaagcgcaaugaaaaaaccaggagcaagcguaagaguaagcuguuggacaagcgaagacauauuccauaacgaacuaauauacuggguaagacaagcaccaggacaaggauuagaauggauaggauggguaaaaauaguaagcggaacaguaaacuuugcaucauuagauuucagaaacagaauaucacuaucaagagauagagaucuaucaacagcauacauggacauaagaggacuaacacaagaugacacagcaacauacuuuugcgcaagacaaaaauuugcaucaagauauagcggagaccaaggaucauacuuugacuuauggggaagaggaacauuaauaguaguaucaagu

SEQ ID NO: 49270 - RNA, 384 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaagaacagaauuaauacauuggguaagacaagcaccaggacaaggauuagaauggauaggauggaugaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49271 - RNA, 381 nt, Artificial Sequence
  derived and/or modified sequence opt6 from anti-HIV-1_HeavyChain
caaguauuuauggaacaagcaggaggagaaguaaaaaaaccaggagcaaguaugacaguaaguuguaaaacagcagaugaagauguauuugaugcagcauauaugcauuggguaagacaagcaccaggacaaacauuugaauggcuaggauggaugaaaccaguaacaggagcaguaaauuaugcaagacaauuucaaggaagaguaaguuuuuauagaacaagagaacuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagc

SEQ ID NO: 49272 - RNA, 381 nt, Artificial Sequence
  derived and/or modified sequence opt6 from anti-HIV-1_HeavyChain
caagcacacuuagaacaaagcggaagcggaguaaaaaaauuaggagcaaguguaagaguaagcuguuggacaagugaagacauauucgaagacgaacuaauacacuggguaagacaagcaccaggacaaggacuagaauggauaggauggguaaaaauaguaaguggaacaguaaacuuugcaucacuagauuucagaaacagaauaucacuaucaagagauagagaucuaucaacagcauacauggacauaagaggacuaacacaagaugacacagcaacauacuuuugcgcaagacaaaaauuugcaucgagauauagcggagaccaaggaucauacuuugacuuauggggaagaggaacauuaauaguaguaucaagc

SEQ ID NO: 49273 - RNA, 381 nt, Artificial Sequence
  derived and/or modified sequence opt6 from anti-HIV-1_HeavyChain
caaucacacuuagaacaaagcggaagcgcaaugaaaaaaccaggcgcaagcguaagaguaagcuguuggacaagcgaagacauacuaaaagcagaacuaauauacuggguaagacaagcaccaggaagaggacuagaauggauaggauggguaaaaacaguaagcggaacaguaaacuuuggaucaagcgauuucagaaacagaauaucacuaacaagagauagagaucuaucaacagcacacauggacauaagaggacuaacacaagaugacacagcaacauacuuuugcgcaagacaaaaauuugaaucacuauauagcgaugaccaaggaucauacuuugacuuaugggggagaggaacauuaauaauaguaucaagu

SEQ ID NO: 49274 - RNA, 381 nt, Artificial Sequence
  derived and/or modified sequence opt6 from anti-HIV-1_HeavyChain
caaguacaacuaguacaaucaggagcagaaguaaaaaaaccaggagcaucgguaaaaguaucaugcaaagcaucaggauauagcuuuacagauuacuauauacauugguuaagacaaguacaaggacaaagaccagaauggaugggauggauaagaccaagaacaggagcaagaaaucaagcaagacaauuccaaccaagaauaucacuaacaagagauagagcauuaucaacagcauacuuagacuuaaacucacuaacaagcgcagacucaggaacauacuuuugcgcaagacaaacauuuaaaccagacuuuuacuuugcagaucaaggauggucauucaaucuauggggaagaggagcacacuuuauaguaagcuca

SEQ ID NO: 49275 - RNA, 381 nt, Artificial Sequence
  derived and/or modified sequence opt6 from anti-HIV-1_HeavyChain
caaguauuuauggaacaagcaggaggagaaguaaaaaaaccaggagcaaguaugacaguaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagu

SEQ ID NO: 49276 - RNA, 384 nt, Artificial Sequence
  derived and/or modified sequence opt6 from anti-HIV-1_HeavyChain
caagcacauuuagaacaaaguggagcaggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagc

SEQ ID NO: 49277 - RNA, 384 nt, Artificial Sequence
  derived and/or modified sequence opt6 from anti-HIV-1_HeavyChain
caagcacauuuagaacaaaguggagcaggaguaaaaaaaccaggagcaaguguaagaguaaguuguuggagcagugaagauauauuugaaagaacagaacuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagc

SEQ ID NO: 49278 - RNA, 384 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguugggcaucagaagauauauuugauacaacagaauuaauauauuggguaagacaagcaccaggacaaggauuagaauggauaggauggguaaaaauaguaaguggaacaguaaauuuugcaaguuuagauuuuagaaauagaauaagcuuaaguagagauagagauuuaaguacagcauauauggauauaagaggauuaacacaagaugauacagcaacauauuuuugugcaagacaaaaauuugcaagcagauauaguggagaucaaggaucauauuuugauuuauggggaagaggaacauuaauaguaguaaguagu

SEQ ID NO: 49279 - RNA, 381 nt, Artificial Sequence
  derived and/or modified sequence opt6 from anti-HIV-1_HeavyChain
agauguagauuaguacaaaguggagcagaaguaaaaaaaccaggagcaaguguaagaguaaguugucaagcaaguggauauacauuuucagcauauggaguaaauuggguaagacaagcaccaggacaagaacuagaauggauaggauggguaaaaacaguaacaggggcaguaaauuuuggaaguccaaauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49280 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggaguagugaagauauauuugaaagaacagaauuaauacauuggguaugucaagcaccaggacaaggacuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49281 - RNA, 384 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggaguagugaagauauauuugaaagaacagaacuaauacauuggguaagacaagcaccaggacaaggauuagaauggauaggauggguaaaaauaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugaucuauggggaagaggaacacauauaguaguaaguagu

SEQ ID NO: 49282 - RNA, 384 nt, Artificial Sequence
  derived and/or modified sequence opt6 from anti-HIV-1_HeavyChain
caaguacaauuaguacaaagcggauuagaaguaaaaaaaccaggagcaaguguaagaguaaguuguuggacaagugaagauauauuugauacaacagaauuaauauauuggguaagacaagcaccaggacaaggacuagaauggauaggauggguaaaaauaguaaguggaacaguaaauuuugcaaguuuagauuuuagaaauagaauaaguuuaaguagagacagagauuuaagcacagcacauauggauauaagaggauuaacacaagaugauacagcaacauauuuuugugcaagacaaaaauuugcaagcagauauaguggagaucaaggaaguuauuuugauuuauggggaagaggaacauuaauaauaguaaguagu

SEQ ID NO: 49283 - RNA, 384 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaaguagagauagagauuuaaguacagcacauauggauauaagaggauuaagacaagaugauacagcaacauauuuuugugcaagacaaaaauuugaaucaagauauaguggagaucaaggaaguuauuuugauuuauggggaagaggaacauuaauaauaguaaguagu

SEQ ID NO: 49284 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuugcaaguagauauaguggagaucaaggaaguuauuuugauuuauggggaagaggaacauuaauaguaguaaguagu

SEQ ID NO: 49285 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacgagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49286 - RNA, 384 nt, Artificial Sequence
  derived and/or modified sequence opt6 from anti-HIV-1_HeavyChain
agacauacaugggaacaaaguggaagcggaguaaaaaaaccaggagcaaguguaagaguaagcuguuggacaagugaagauauauuugaaaaaagugaauuaauacauuggguaagacaagcaccaggacaaggauuagaauggauaggauggguaaaaacagugacaggagcaguaaauuuuggaaguagugauuuuagacaaagaguaaguuuaacaagagauagagaucuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagu

SEQ ID NO: 49287 - RNA, 384 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaaguagagauagagauuuaaguacagcauauauggauauaagaggauuaacacaagaugauacagcaacauauuuuugugcaagacaaaaauuugaaaguagauauacaggaggacaaggaugguauuuugauuuauggggaagaggaacacauauaguaguaaguagu

SEQ ID NO: 49288 - RNA, 384 nt, Artificial Sequence
  derived and/or modified sequence opt6 from anti-HIV-1_HeavyChain
caaguacaauuaguacaaaguggagcagaaguaaaaaaaccaggagcaaguguaagaguaaguuguuggacaagugaagauauauuugauacaacagaauuaauauauuggguaagacaagcaccaggacaaggauuagaauggauaggauggguaaaaauaguaagcggaacaguaaauuuugcaaguuuagauuuuagaaauagaauaaguuuaaguagagauagagauuuaaguacagcacauauggauauaagaggauuaacacaagaugauacagcaacauauuuuugugcaagacaaaaauuugaaaguagauauacaggaggacaaggaugguauuuugauuuauggggaagaggaacacauauaguaguaaguagu

SEQ ID NO: 49289 - RNA, 384 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaagcuuaaguagagauagagauuuaaguacagcauauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49290 - RNA, 384 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccagauuuuagacauagaauaaguuuaaguagagauagagauuuaaguacagcacauauggauauaagaggauuaacacaagaugauacagcaacauauuuuugugcaagacaaaaauuugcaaguagauauaguggagaucaaggaaguuauuuugauuuauggggaagaggaacauuaauaauaguaaguagu

SEQ ID NO: 49291 - RNA, 384 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaagaacagaauuaauacauuggguaagacaagcaccaggaagaggauuagaauggauaggauggguaaaaacaguaaguggaacaguaaauuuuggaaguagugauuuuagaaauagaguaaguuuaacaagagauagagauuuaaguacagcacauauggauauaagaggauuaacacaagaugauacagcaacauauuuuugugcaagacaaaaauuugaaaguuuauauagugaugaucaaggaaguuauuuugauuuauggggaagaggaacauuaauaauaguaaguagu

SEQ ID NO: 49292 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaggacagaauuaauacauuggguaagacaagcaccaggacaaggguuagaauggauaggauggguaaaaacaguaacaggagcaguaaauuuuggaaguccaaauuuuagaaauagaauaaguuuaacaagagauagagauuuaaguacagcacauauggauauaagaggauuaacacaagaugauacagcaacauauuuuugugcaagacaaaaauuugaaagcuuauauagcgaugaucaaggaaguuauuuugauuuauggggaagaggaacauuaauaauaguaaguagu

SEQ ID NO: 49293 - RNA, 384 nt, Artificial Sequence
  derived and/or modified sequence opt6 from anti-HIV-1_HeavyChain
caaagucauuuagaacaaaguggaagugcaaugaaaagaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaagcagagauagagauuuaaguacagcauauauggauauaagaggauuaacacaagaugauacagcaacauauuuuugugcaagacaaaaauuugcaaguagauauucaggagaucaaggaaguuauuuugauuuauggggaagaggaacauuaauaguaguaaguagc

SEQ ID NO: 49294 - RNA, 384 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacgagugaagauauauuugaaagaacagaauuaauacauuggguaagacaagcaccaggacaaggauuagaauggauaggauggguaaaagcaguaaguggagcaguaaauuacggaagucuagauuuuagaaauagaauaaguuuaaguagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaagcagu

SEQ ID NO: 49295 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaacaguaacaggagcaguaaauuuuggaagucuagauuuuagacauagaauaaguuuaacaagagauagagauuuuuuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49296 - RNA, 381 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggucaagugaagacauauucagaacagaauuaauacauuggguaagacaagcaccaggacaaggauuagaauggauaggauggguaaaaacaguaacaggagcaguaaauuuuggaucauuagauuuuagacauagaauaucauuaacaagagauagagauuuauuuacagcacauauggauauaagaggauuaacacaaggagauacagcaacauauuuuugugcaagacaaaaauuugaaucacgauauacaggaggacaaggaugguauuuugacuuauggggaagaggaacacauauaguaguaucaagu

SEQ ID NO: 49297 - RNA, 384 nt, Artificial Sequence
  derived and/or modified sequence opt6 from anti-HIV-1_HeavyChain
caagcacauuuagaacaaagcggaagcggaguaaaaaaaccaggagcaaguguaagaguaagcuguuggacaagugaagacauauucgaaagaacagaauuaauacauuggguaagacaagcaccaggacaaggacuagaauggauaggauggguaaaaacaguaacaggagcaguaaauuucggaagcccaaacuuuagacauagaguaaguuuaacaagagacagagacuuauuuacagcacauauggauauaagaggauuaacacaaggagauacagcaacauacuucugugcaagacaaaaauuugaaagcuuauacucagacgaucaaggaaguuauuucgauuuauggggaaggggaacauuaauaauaguaagcuca

SEQ ID NO: 49298 - RNA, 384 nt, Artificial Sequence
  derived and/or modified sequence opt6 from anti-HIV-1_HeavyChain
caaagccaucuagaacaaucaggaucagcaaugaaaaaaccaggagcaucaguaagaguaucaugcuggacaucagaagauauauuugacacaacagaacuaauauacuggguaagacaagcacccggacaaggacuagaauggauaggauggguaaaaauaguaagcggaacaguaaacuuugccucacuagauuucagaaacagaauaucacuaucaagagauagagaucuaucaacagcacacauggacauaagaggacuaacacaagaugacacagcaacauacuuuugcgcaagacaaaaauuugcaucaagauauagcggagaccaaggaucauacuuugacuuauggggaagaggaacauuaauaauaguaucaagc

SEQ ID NO: 49299 - RNA, 384 nt, Artificial Sequence
  derived and/or modified sequence opt6 from anti-HIV-1_HeavyChain
caaagccaucuagaacaaucaggaucggcaaugaaaaaaccaggagcaucaguaagaguaucaugcuggacaucagaagauauauuugacacaacagaacuaauauacuggguaagacaagcaccaggacaaggauuagaauggauaggauggguaaaaauaguaagcggaacaguaaacuuugcaucaagcgauuucagaaacagaauaucacuaucaagagauagagaucuaucaacagcacacauggacauaagaggacuaacacaagaugacacagcaacauauuuuugcgcaagacaaaaauuugcaucaagauauagcggagaccaaggaucauacuuugacuuauggggaagaggaacauuaauaguaguaucaagc

SEQ ID NO: 49300 - RNA, 384 nt, Artificial Sequence
  derived and/or modified sequence opt6 from anti-HIV-1_HeavyChain
caagcacaucuagaacaaucgggaucaggaguaaaaaaaccaggagcaucaguaagaguaucaugcuggacaucagaagauauauuugaaagaacagaacuaauauacuggguaagacaagcaccaggaagaggacuagaauggauaggauggguaaaaacaguaagcggaacaguaaacuuuggaucaagugauuucagaaacaggauaucacuaacaagagauagagaucuaucaacagcacacauggacauaagaggauuaacacaagaugacacagcaacauacuuuugcgcaagacaaaaauuugaaucacuauauagugaugaccaaggaucauacuuugacuuauggggaagaggaacauuaauaauaguaucaagc

SEQ ID NO: 49301 - RNA, 384 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49302 - RNA, 384 nt, Artificial Sequence
  derived and/or modified sequence opt6 from anti-HIV-1_HeavyChain
caaagccaucuagaacaaucaggaucagcaaugaaaaaaccaggagcaucaguaagaguaucaugcuggacaucagaagauauauuuggaacaaccgaacuaauauacuggguaagacaagcaccaggacaaggacuagaauggauaggauggguaaaaauaguaagcggaacaguaaacuuugcaucauuagauuucagaaacagaauaucacuaucaagagauagagaucuaucaacagcauacauggacauaagaggacuaacacaagaugacacagcaacauacuuuugcgcaagacaaaaauuugcaucaagauauagcggagaccaaggaucauacuuugacuuauggggaagaggaacauuaauaguaguaucgagu

SEQ ID NO: 49303 - RNA, 384 nt, Artificial Sequence
  derived and/or modified sequence opt6 from anti-HIV-1_HeavyChain
caaguacaauuaguacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaaguagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguuca

SEQ ID NO: 49304 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaaggaauauuugaaagaacagaauuaauacauuggguaagacaagcaccaggacaaggauuagaauggauaggauggguaaaaacaguaacaggagcaguaaauuuugggaguuuagauuuuagacauagaauaaguuuaacaagagauagagauuuauuuacagcacauauggauauaagaggauuaacacaaggagauacggcgacauauuuuugugcaagacaaaaauuugaaaguagauauacaggaggacaaggaugguauuuugauuuauggggaagaggaacacauauaguaguaaguagu

SEQ ID NO: 49305 - RNA, 384 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagcgaagauauauuugaaagaacagaauuaauacauugggcaagacaagcaccaggacaaggauuagaauggauaggauggguaaaaacaguaacaggagcaguaaauuuuggaaguccaaauuuuagacauagagcaaguuuaacaagagacagagauuuauuuacagcacauauggauauaagaggauuaacagaaggagauacagcgacauauuuuugugcaagacaaaaauuugcaaguagauauaguggagaucaaggaagcuauuuugauuuauggggaagaggaacauuaauaauaguaaguagu

SEQ ID NO: 49306 - RNA, 384 nt, Artificial Sequence
  derived and/or modified sequence opt6 from anti-HIV-1_HeavyChain
caaagucauuuagaacaaaguggaagugcaaugaaaaaaccaggagcgaguguaagaguaaguuguuggacaagcgaagauauauuugauacagcagaauuaauauauuggguaagacaagcaccaggacaaggauuagaauggauaggauggguaaaaauaguaaguggaacaguaaauuuugcaaguuuagauuuuagaaauagaauaaguuuaaguagagacagagauuuaaguacagcacauauggauauaagaggauuaagacaagaugauacagcaacauauuuuugugcaagacaaaaauuugaaaguagauauaguggagaucaaggaaguuauuuugauuuauggggaagaggaacauuaauaauaguaaguagc

SEQ ID NO: 49307 - RNA, 384 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauagaauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugaaaguagauauacaggaggacaaggaugguauuuugauuuauggggaagaggaacacauauaguaguaaguagu

SEQ ID NO: 49308 - RNA, 384 nt, Artificial Sequence
  derived and/or modified sequence opt6 from anti-HIV-1_HeavyChain
caaagucauuuagaacaaagcggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaucauuagauuuuagaaauagaauaaguuuaagcagagauagagauuuaaguacagcauauauggauauaagaggauuaacacaagaugauacagcaacauauuuuugugcaagacaaaaauuugcaaguagauauaguggagaucaaggaaguuauuuugaucuauggggaagaggaacauuagauuguguaagcuca

SEQ ID NO: 49309 - RNA, 384 nt, Artificial Sequence
  derived and/or modified sequence opt6 from anti-HIV-1_HeavyChain
caaucacaucuagaacaaaguggaagugcaaugaaaaaaccaggagcaaguguaagaguaagcuguuggacaagugaagacauauuugauacaacagaauuaauauauuggguaagacaagcaccaggacaaggauuagaauggauaggauggguaaaaauaguaucaggagcaguaaauuucgcaagcuuagacuuuagaaauagaauaaguuuaagcagagacagagauuuaagcacagcacauauggauauaagaggauuaacacaagaugauacagcaacauauuucugugcaagacaaaaauuugcaagcagauauucaggagaucaaggaaguuauuuugauuuauggggaagaggaacauuaauaauaguaaguuca

SEQ ID NO: 49310 - RNA, 384 nt, Artificial Sequence
  derived and/or modified sequence opt6 from anti-HIV-1_HeavyChain
caagcacauuuagaacaaagcggaaguggaguaaaaaaauuaggagcaaguguaagaguaaguuguuggacaagcgaagauauauuugaaagaacagaauuaauacauuggguaagacaagcaccaggacaaggacuagaauggauaggauggguaaaagcaguaaguggagcaguaaauuauggaaguuuagauuuuagacauagaguaaguuuaacaagagauagagauuuaaguacagcacauauggauauaagaggauuaacacaaggagauacagcaacauauuuuugugcaagacaaaaauuugaaagcagauauacaggaggacaaggaugguauuuugauuuauggggaagaggaacacauauaguaguaaguagu

SEQ ID NO: 49311 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuaaguacagcacauauggauauaagaggauuaacacaagaugauacagcaacauauuuuugugcaagacaaaaauuugaaaguuuauauagugaugaucaaggaaguuauuuugauuuauggggaagaggaacauuaauaauaguaagcagu

SEQ ID NO: 49312 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggaacaguaaauuuuggaagucuaaauuuuagacauagaauaaguuuaacaagagauagagauuuauuuacagcacauauggauauaagaggauuaacacaaggagauacagcaacauauuuuugugcaagacaaaaauuugaaagcagauauacaggaggacaaggaugguauuuugauuuauggggaagaggaacacauauaguaguaaguagu

SEQ ID NO: 49313 - RNA, 384 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugaaagaacagaauuaauauauuggguaagacaagcaccaggaagaggauuagaauggauaggauggguaaaaauaguaaguggaacaguaaauuuugcaaguuuagauuuuagaaauagaauaaguuuaaguagagauagagauuuaaguacagcacauauggauauaagaggauuaacacaagacgauacagcaacauauuuuugugcaagacaaaaauuugcaaguagauauaguggagaucaaggaagcuauuuugauuuauggggaagaggaacauuaauaauaguaagcagu

SEQ ID NO: 49314 - RNA, 384 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaacuaauauauuggguaagacaagcaccaggacaaggauuagaauggauaggauggguaaaaauaguaaguggaacaguaaauuuugcaagcuuagauuuuagaaauagaauaaguuuaaguagagauagagauuuaaguacagcauacauggauauaagaggauuaacacaagaugauacagcaacauauuuuugugcaagacaaaaauuugcaaguagauauaguggagaucaaggaaguuauuuugauuuauggggaagaggaacauuaauaauaguaaguagc

SEQ ID NO: 49315 - RNA, 384 nt, Artificial Sequence
  derived and/or modified sequence opt6 from anti-HIV-1_HeavyChain
caagcaagauuagaacaaaguggaaguggaguaaaaaaauuaggagcaaguguaagaguaaguuguuggacaagugaagauauauuugaaagaacagaauuaauacauuggguaagacaagcaccgggacaaggauuagaauggauaggauggguaaaagcaguaaguggagcaguaaauuauggaaguuuagauuuuagaaauagaauaaguuuaaguagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagu

SEQ ID NO: 49316 - RNA, 384 nt, Artificial Sequence
  derived and/or modified sequence opt6 from anti-HIV-1_HeavyChain
caagcacauuuagaacaaaguggaagugcaaugaaaaaaccaggagcaagcguaagaguaaguuguuggacaagugaagacauauuugauacaacagaauuaauauauugggugagacaagcaccaggacaaggauuagaauggauaggauggguaaaaauaguaucaggaacaguaaauuucgcaagcuuagacuuuagaaauagaauaaguuuaaguagagacagagauuuaaguacagcacauauggauauaagaggauuaacacaagaugauacagcaacauauuucugugcaagacaaaaauuugcaaguagauauucaggagaucaaggaaguuauuuugauuuauggggaagaggaacauuaauaauaguaaguuca

SEQ ID NO: 49317 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaagcuuagauuuuagacauagaauaaguuuaacaagggauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagu

SEQ ID NO: 49318 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcagcaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49319 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaagugaauuaauacauuggguaagacaagcaccaggacaaggauuagaauggauaggauggguaaaaacaguaacaggagcaguaaauuuuggaaguuuagauuuuaggcauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagagggacacauauaguaguaaguagc

SEQ ID NO: 49320 - RNA, 381 nt, Artificial Sequence
  derived and/or modified sequence opt6 from anti-HIV-1_HeavyChain
agauguauauggagacaagcaggaggaggagugaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagaggaauaagaauggcauauauggauuuaagaaauuuaagauuugaugauacagcaguauauuuuugugcaagaaaaacagcaggagauguaaguggagauaauagaggguauuuuuuugauuuauggggaagaggaaguagaguaauaguaaguagu

SEQ ID NO: 49321 - RNA, 384 nt, Artificial Sequence
  derived and/or modified sequence opt6 from anti-HIV-1_HeavyChain
caaagucauuuagaacaaagcggaagugcaaugaaaaaaccaggagcaaguguaagaguaagcuguuggacaagugaagauauauuugaaagaacagaauuaauauauuggguaagacaagcaccaggaagaggauuagaauggauaggauggguaaaaauaguaaguggaacaguaaauuuugcaaguuuagauuuuagaaauagaauaaguuuaaguagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagu

SEQ ID NO: 49322 - RNA, 384 nt, Artificial Sequence
  derived and/or modified sequence opt6 from anti-HIV-1_HeavyChain
caaagucauuuagaacaaucaggaagcgcaaugaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggacuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49323 - RNA, 384 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaaguagagauagagauuuaagugcagcacauauggauauaagaggauuaacacaagaugauacagcaacauauuuuugugcaagacaaaaauuugcaaguagauauaguggagaucaaggaaguuauuuugauuuauggggaagaggaacauuaauaauaguaaguagu

SEQ ID NO: 49324 - RNA, 384 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagcgaagauauauuugaaagaacagaauuaauacauuggguaagacaagcaccaggacaaggauuagaauggauaggauggguaaaaauagugaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugcaaguagauauaguggagaucaaggaaguuauuuugauuuauggggaagaggaacauuaauaguaguaaguagu

SEQ ID NO: 49325 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggacuaacacaaggagauacagcaacauauuuuuguacaagacaaaaauuugaaaguagauauacaggaggacaaggaugguauuuugauuuauggggaagaggaacacauauaguaguaaguagc

SEQ ID NO: 49326 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggaccagaauggauaggauggguaaaaacaguaacaggagcaguaaauuuuggaaguuuagauuuuagacauagaauaagccuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49327 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguugcuggaguagugaagauauauuugaaagaacagaauuaauacauuggguaagacaagcaccaggacaaggauuagaauggauaggauggguaaaaacaguaacaggagcaguaaauuuuggaccauuagauuuuagacauagaauaaguuuaacaagagauagagauuuauuuacagcacauauggauauaagaggauuaacacaaggagauacagcaacauauuuuugugcaagacaaaaauuugaaagcagauauacaggaggacaaggaugguauuuugauuuauggggaagaggaacacauauaguaguaaguagu

SEQ ID NO: 49328 - RNA, 384 nt, Artificial Sequence
  derived and/or modified sequence opt6 from anti-HIV-1_HeavyChain
caaagucauuuagaacaaucaggaccagcaaugaaaaaaccaggagcaaguguaagaguaaguuguuggacaagugaagauauauuugaaagaacagaauuaauauauuggguaagacaagcaccaggaagaggacuagaauggauaggauggguaaaaacaguaaguggaacaguaaauuuuggaagcagugauuuuagaaauagaauaaguuuaacaagagauagagauuuaaguacagcacauauggauauaagaggauuaacacaagaugauacagcaacauauuuuugugcaagacaaaaauuugaaagcuuauauagugaugaucaaggaaguuauuuugauuuauggggaagaggaacauuaauaauaguaaguagu

SEQ ID NO: 49329 - RNA, 384 nt, Artificial Sequence
  derived and/or modified sequence opt6 from anti-HIV-1_HeavyChain
caaagccaucuagaacaaucaggaucagcaaugaaaaaaccaggagcaucaguaagaguaucaugcuggacaucagaagauauauuugacacaacagaacuaauauacuggguaagacaagcaccaggacaaggacuagaauggauaggauggguaaaaauaguaaguggaacaguaaauuuugcaucacuagauuucagaaacagaauaucacuaucaagagauagaggacuaucaacagcacauauggacauaagaggacuaacacaagaugacacagcaacauacuuuugcgcaagacaaaaauuugcaucaagauauagcggagaccaaggaucauacuuugacuuauggggaagaggaacauuaauaauaguaucaagc

SEQ ID NO: 49330 - RNA, 384 nt, Artificial Sequence
  derived and/or modified sequence opt6 from anti-HIV-1_HeavyChain
caagcacauuuagaacaaagcggaagcggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugcaaguagauauaguggagaucaaggaaguuauuuugaucuauggggaagaggaacauuaauaauaguaaguagu

SEQ ID NO: 49331 - RNA, 384 nt, Artificial Sequence
  derived and/or modified sequence opt6 from anti-HIV-1_HeavyChain
caaagucauuuagaacauaguggaagugcaaugaaaaaaccaggagcaaguguaagaguaaguuguuggacaucagaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaaguagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagu

SEQ ID NO: 49332 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaauaguaaguggagcaguaaauuucggaaguccaaauuuuagacaaagaguaaguuuaacaagagacagagauuuauuuacagcacauauggauauaagaggauuaacacaaggagauacagcaacauauuuuugugcaagacaaaaauuugaaaguuuauauagugaugaucaaggaaguuauuuugauuuauggggaagaggaacauuaauaauaguaaguagu

SEQ ID NO: 49333 - RNA, 384 nt, Artificial Sequence
  derived and/or modified sequence opt6 from anti-HIV-1_HeavyChain
caagcacauuuagaacaaagcggaaguggaguaaaaaaaccaggagcaagcguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaauaaguuuaacaagagauagagaucuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaagcagu

SEQ ID NO: 49334 - RNA, 384 nt, Artificial Sequence
  derived and/or modified sequence opt6 from anti-HIV-1_HeavyChain
caagcacauuuagaacaaagugcaaguggaguaagaagaccaggagcaaguguaagaguaagcuguuggacaagugaagauauauuugaaagaagugaacuaauauauuggguaagacaagcaccaggaagaggauuagaauggauaggauggauaaaauuaguaagcggagcaguaaauuuuggaagcguagauuuuagaaauagaauaaguuuaaguagagauagagauuuaaguacagcacauauggauauaagaggauuaagacaagaugauacagcaacauauuuuugugcaagacaaaaauuugaaaguagauauaguggagaucaaggaaguuauuuugauuuauggggaagaggaacauuaauaauaguaaguagc

SEQ ID NO: 49335 - RNA, 384 nt, Artificial Sequence
  derived and/or modified sequence opt6 from anti-HIV-1_HeavyChain
caagcacauuuagaacaaagugcaagcggaguaaaaagaccaggagcaagcguaagaguaaguuguuggacaagugaagacauauuugaaagaacagaauuaauauauuggguaagacaagcaccaggacaaggacuagaauggauaggauggguaaaaacaguaucaggagcaguaaauuuuggaagucaagacuuuagagauagauuuagccuaacaagagacagagauuuaaguacagcacauauggauauaaggggacuaacacaagaugauacagcaacauauuucugugcaagacaaaaauuugcaagcagauauucaggagaucaaggaaguuauuuugauuuauggggaagaggaacacuaauaauaguaucauca

SEQ ID NO: 49336 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaaaaagugaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49337 - RNA, 384 nt, Artificial Sequence
  derived and/or modified sequence opt6 from anti-HIV-1_HeavyChain
caagcacauuuagaacaaagcggaagcggaguaaaaaaaccaggagcaaguguaagaguaagcuguuggacaagugaagacauauucgaaagaacagaauuaauacauuggguaagacaagcaccaggacaaggauuagaauggauaggauggguaaaaacaguaucaggagcaguaaauuucggaaguccaaauuuuagacauagaguaaguuuaacaagagacagagacuuauuuacggcacauauggauauaagaggauuaacacaagaugauacagcaacauauuucugugcaagacaaaaauuugaaagcuuauacucagaugaucaaggaaguuauuuugauuuauggggaagaggaacauuaauaauaguaaguuca

SEQ ID NO: 49338 - RNA, 384 nt, Artificial Sequence
  derived and/or modified sequence opt6 from anti-HIV-1_HeavyChain
caaagucauuuaaaacaaaguggaagugcaaugaaaaaaccaggagcaaguguaagaguaaguuguuggacaagugaagauauauuugaaagaacagaauuaauauauuggguaagacaagcaccaggaagaggacuagaauggauaggauggguaaaaacaguaaguggaacgguaaauuuuggaaguagugauuuuagaaauagaauaaguuuaacaagagauagagauuuaaguacagcacauauggauauaagaggauuaacacaagaugauacagcaacauauuuuugugcaagacaaaaauuugaaaguuuauauagugaugaucaaggaaguuauuuugauuuauggggaagaggaacauuaauaauaguaaguagu

SEQ ID NO: 49339 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacgguaacaggagcaguaaauuuuggaaguuuagauuuuagacauagaauaagucuaacaagagauagagauuuaaguacagcacauauggauauaagaggauuaacacaagaugauacagcaacauauuuuugugcaagacaaaaauuugcaaguagguauaguggagaucaaggaaguuauuuugauuuauggggaagaggaacauuaauaauaguaaguagu

SEQ ID NO: 49340 - RNA, 384 nt, Artificial Sequence
  derived and/or modified sequence opt6 from anti-HIV-1_HeavyChain
caagcacauuuagaacaaaguggaagcggaguaaaaaaauuaggagcaaguguaagaguaagcuguuggacaagugaagauauauuugaaagaacagaauuaauacauuggguaagacaagcaccaggacaaggauuagaauggauaggauggguaaaagcaguaaguggagcaguaaauuauggaagcuuagauuuuagacauagaguaaguuuaacaagagauagagaucuauuuacagcacauauggauauaagaggauuaacacaagaugauacagcaacauauuuuugugcaagacaaaaauuugaaaguagauauacaggaggacaaggaugguauuuugauuuauggggaagaggaacacauauaguaguaaguagu

SEQ ID NO: 49341 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagacagagauuuauuuacagcacauauggauauaagaggauuaacacaagaugacacagcaacauauuuuugugcaagacaaaaauuugaaagucuauauagugaugaucaaggaaguuauuuugauuuauggggaagaggaacauuaauaauaguaaguagu

SEQ ID NO: 49342 - RNA, 384 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuagaaagaacagaauuaauauauuggguaagacaagcaccaggaagaggauuagaauggauaggauggguaaaaacaguaaguggaacaguaaauuuuggaaguagugauuuuagaaauagaauaaguuuaacaagagauagagauuuaaguacagcacauauggauauaagaggauuaacacaagaugauacagcaacauauuuuugugcaagacaaaaauuugaaagcuuauauagugaugaucaaggaaguuauuuugauuuauggggaagaggaacauuaauaauaguaaguagu

SEQ ID NO: 49343 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacaaagaguaaguuuaacaagagauagagauuuauuuacagcacauauggauauaaggggauuaacacaaggagauacagcaacauauuuuugugcaagacaaaaauuugcaagcagauauaguggagaucaaggaaguuauuuugauuuauggggaagaggaacacuaauaguaguaaguagu

SEQ ID NO: 49344 - RNA, 384 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaagcccaaauuuuagacauagaauaaguuuaacaagagauagagauuuauucacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49345 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaugauauauuugaaagaacagaauuaauacauuggguaagacaagcaccaggacaaggauuagaauggauaggauggguaaaaacaguaacaggagcaguaaauuuuggaagcccaaauuuuagacaaagaguaagcuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaagcagu

SEQ ID NO: 49346 - RNA, 384 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaagcuuagauuuuagaaauagaauaaguuuaaguagagauagagauuuaaguacagcacauauggauauaagaggauuaacacaagaugauacagcaacauauuuuugugcaagacaaaaauuugcaaguagauauaguggagaucaaggaagcuauuuugauuuauggggaagaggaacauuaauaguaguaaguagu

SEQ ID NO: 49347 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagacauauuugaaagaacagaauuaauacauuggguaagacaagcaccaggacaaggauuagaauggauaggauggguaaaaacaguaacaggagcaguaaauuuuggaaguccaaauuuuagaaauagaauaaguuuaaguagagacagagauuuaaguacagcacauauggauauaagaggauuaacacaagaugauacagcaacauauuuuugugcaagacaaaaauuugcaagcagauauaguggagaucaaggaaguuauuucgauuuauggggaaggggaacauuaauaauaguaaguagu

SEQ ID NO: 49348 - RNA, 384 nt, Artificial Sequence
  derived and/or modified sequence opt6 from anti-HIV-1_HeavyChain
caagcacauuuagaacaaagugcaaguggaguaaaaagaccaggagcaaguguaagaguaaguuguuggacaagugaagauauauuugaaagaacagaauuaauauauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggacuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49349 - RNA, 384 nt, Artificial Sequence
  derived and/or modified sequence opt6 from anti-HIV-1_HeavyChain
caagcacauuuagaacaaagugcaaguggaguaagaagaccaggagcaaguguaagaguaaguuguuggacaagugaagauauauuugaaagaagugaauuaauauauuggguaagacaagcaccaggaagaggauuagaauggauaggauggauaaaauuaguaaguggagcaguaaauuuuggaaguguagauuuuagagauagaguaagucuaacaagagauagagauuuauuuacagcacauauggauauaagaggauuaacacaagaugauacagcaacauauuuuugugcaagacaaaaauuugcaagcagauauagcggagaucaaggaaguuauuuugauuuauggggaagaggaacauuaauaauaguaaguagu

SEQ ID NO: 49350 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggaacaguaaauuuugcaaguuuagauuuuagaaauagaauaaguuuaaguagagauagagauuuaaguacagcauauauggauauaagaggauuaacacaagaugauacagcaacauauuuuugugcaagacaaaaauuugcaaguagauacaguggagaucaaggaaguuauuuugauuuauggggaagaggaacauuaauaguaguaaguagc

SEQ ID NO: 49351 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaauaagccuaaguagagauagagauuuaaguacagcauauauggauauaagaggauuaacacaagaugauacagcaacauauuuuugugcaagacaaaaauuugcaaguagauauucaggagaucaaggaagcuauuuugauuuauggggaagaggaacauuaauaguaguaaguagu

SEQ ID NO: 49352 - RNA, 384 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggaguagugaagauauauuugaaagaacagaauuaauacauuggguaagacaagcaccaggacaaggauuagaauggauaggauggguaaaaacaguaacaggagcaguaaauuuuggaagcuuagauuuuagacauagaauaaguccaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacauuaauaguaguaaguagu

SEQ ID NO: 49353 - RNA, 384 nt, Artificial Sequence
  derived and/or modified sequence opt6 from anti-HIV-1_HeavyChain
caaagucauuuagaacaaucaggaucagcaaugaaaaaaccaggagcaucaguaagaguaaguugcuggacaucagaagauauauuugacacaacagaacuaauauacuggguaagacaagcaccaggacaaggacuagaauggauaggauggguaaaaauaguaaguggaacaguaaacuuugcaucacuagauuucagaaacagaauaucacuaucaagagauagagauuuaccaacagcauacauggacauaagaggacuaacacaagaugacacagcaacauacuuuugcgcaagacaaaaauuugcaucaagauauagcggagaccaaggaucauacuuugacuuauggggaagaggaacauuaauaguaguaucaagc

SEQ ID NO: 49354 - RNA, 384 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauagcaaguggaacaguaaauuuugcaaguuuagauuuuagaaauagaauaagucuaaguagggauagagauuuaaguacagcacauauggauauaagaggauuaacacaagaugauacagcaacauauuuuugugcaagacaaaaauuugcaaguagauauagcggagaucaaggaaguuauuuugauuuauggggaagaggaacauuaauaguaguaaguagu

SEQ ID NO: 49355 - RNA, 384 nt, Artificial Sequence
  derived and/or modified sequence opt6 from anti-HIV-1_HeavyChain
caaagucauuuagaacaaaguggaagcgcaaugaaaaaaccaggagcaagcguaagaguaaguuguuggacaagugaagauauauuugauacaacagaauuaauauauuggguaagacaagcaccaggacaaggauuagaauggauaggauggguaaaaacaguaacaggagcaguaaauuuuggaagcuuagauuuuagacauagaauaaguuuaacaagagauagagauuuauuuacagcacauauggauauaagaggauuaacacaaggagauacagcaacauacuuuugugcaagacaaaaauuugaaaguagauauacaggaggacaaggaugguauuuugaucuauggggaagaggaacacauauaguaguaaguagu

SEQ ID NO: 49356 - RNA, 384 nt, Artificial Sequence
  derived and/or modified sequence opt6 from anti-HIV-1_HeavyChain
caaguacaauuaguacaaaguggagcagaaguaaaaaaaccaggagcaaguguaagaguaagcuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaaguagagauagagauuuaaguacagcacauauggauauaagaggauuaagacaagaugauacagcaacauauuuuugugcaagacaaaaauuugaaaguagauauaguggagaucaaggaaguuauuuugauuuauggggaagaggaacauuaauaauaguaagcagu

SEQ ID NO: 49357 - RNA, 384 nt, Artificial Sequence
  derived and/or modified sequence opt6 from anti-HIV-1_HeavyChain
caaagucaucuagaacaaaguggaagugcaaugaaaaaaccaggagcaagcguaagaguaaguuguuggacaagcgaagauauauuugauacaacagaauuaauauauuggguaagacaagcaccaggacaaggauuagaauggauaggauggguaaaaauaguaaguggaacaguaaauuuugcaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49358 - RNA, 384 nt, Artificial Sequence
  derived and/or modified sequence opt6 from anti-HIV-1_HeavyChain
caagcacauuuagaacaaagugcaagcggaguaaaaagaccaggagcaaguguaagaguaaguuguuggacaagugaagauauauuugaaagaagugaauuaauauauuggguaagacaagcaccaggacaaggauuagaauggauaggauggguaaaaacaguaacaggagcaguaaauuuuggaagucuagauuuuagacauagaauaaguuuaacaagagauagagauuuauuuacagcacauauggauauaagaggacuaacacaaggagacacagcaacauauuuuugugcaagacaaaaauuugaaaguagauauacaggaggacaaggaugguauuuugauuuauggggaagaggaacacauauaguaguaagcagu

SEQ ID NO: 49359 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuucugugcaagacaaaaauuugaaaguuuauauagugaugaucaaggaaguuauuuugauuuauggggaagaggaacacuaauaauaguaaguagu

SEQ ID NO: 49360 - RNA, 384 nt, Artificial Sequence
  derived and/or modified sequence opt6 from anti-HIV-1_HeavyChain
caaagccaucuagaacaaucaggaucagcaaugaaaaaaccaggagcaucaguaagaguaaguugcuggacaucagaagauauauuugaaagaacagaacuaauauacuggguaagacaagcaccaggaagaggacuagaauggauaggauggguaaaaacaguaagcggaacaguaaacuuuggaucaagcgauuucagaaacagaauaucacuaacaagagauagagaucuuucaacagcacacauggacauaagaggacuaacacaagaugacacagcaacauacuuuugcgcaagacaaaaauuugaaucacuauauagcgaugaccaaggaucauacuuugacuuauggggaagaggaacauuaauaguaguaucaagc

SEQ ID NO: 49361 - RNA, 384 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49362 - RNA, 381 nt, Artificial Sequence
  derived and/or modified sequence opt6 from anti-HIV-1_HeavyChain
caagcacauuuagaacaaaguggaagcggaguaaaaaaaccaggagcaagcguaagaguaaguuguuggacaagugaagacauauuaagaaaaucagaauuaauacauuggguaagacaagcaccaggacaaggauuagaauggauaggauggguaaaaacaguaacaggagcaguaaauuucggacaucaaauaucagacagaguaucacuaacaagagauagagauuuaucaacagcacauauggacauaagaggauuaacacaagaugacacagcaacauauuuuugcgcaagacaaaaauuugaaucauuauauagugaugaucaaggaucauauuuugacuuauggggaagaggaacauuaauaauaguaucaagu

SEQ ID NO: 49363 - RNA, 384 nt, Artificial Sequence
  derived and/or modified sequence opt6 from anti-HIV-1_HeavyChain
ccagcacauuuagaacaaagcggaaguggaguaaaaaaaccaggagcaaguguaagaguaaguuguugggcaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49364 - RNA, 384 nt, Artificial Sequence
  derived and/or modified sequence opt6 from anti-HIV-1_HeavyChain
caagcacauuuagaacaaagcgcaagcggaguaaaaagaccaggagcaaguguaagaguaaguuguuggacaagugaagauauauuugaaagaagugaauuaauauauuggguaagacaagcaccaggacaaggauuagaauggauaggauggguaaaaacaguaaguggagcgguaaauuuuggaaguacagauuuuagagaaagaauaaguuuaaguagagauagagauuuaaguacagcauauauggauauaagaggauuaacacaagaugaugcagcaacauauuuuugugcaagacaaaaauuugcaagcagauauucaggagaucaaggaaguuauuuugauuuauggggaagaggaacacuaauaguaguaaguagu

SEQ ID NO: 49365 - RNA, 384 nt, Artificial Sequence
  derived and/or modified sequence opt6 from anti-HIV-1_HeavyChain
caagcacaucuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuaagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49366 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaacuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacauuaauaguaguaaguagu

SEQ ID NO: 49367 - RNA, 384 nt, Artificial Sequence
  derived and/or modified sequence opt6 from anti-HIV-1_HeavyChain
agucaugaucuagaacaaagcggaagugcaaugaaaaaaccaggagcaaguguaagaguaaguuguuggacaagcgaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaagcagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaagcagu

SEQ ID NO: 49368 - RNA, 384 nt, Artificial Sequence
  derived and/or modified sequence opt6 from anti-HIV-1_HeavyChain
caagcacauuuagaacaaagcggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaacaggagcaguaaauuuuggaaguuuagauuuuagacauagaauaaguuuaacaagagauagagauuuauuuacagcacauauggauauaagaggauuaacacaaggagauacagcaacauauuuuugugcaaggcaaaaauuugaaaguagauauacaggaggacaaggaugguauuuugauuuauggggaagaggaacacauauaguaguaaguagu

SEQ ID NO: 49369 - RNA, 384 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugcaaguagauauaguggagaucaaggaagcuauuuugauuuauggggaagaggaacauuaauaguaguaaguagu

SEQ ID NO: 49370 - RNA, 384 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguagugauuuuagaaauagaauaaguuuaaguagagauagagauuuaaguacagcacauaugggaauaagaggacuaagacaagaugauacagcaacauauuuuugugcaagacaaaaauuugaaaguagauauaguggagaucaaggaaguuauuuugauuuauggggaagaggaacauuaauaauaguaaguagu

SEQ ID NO: 49371 - RNA, 384 nt, Artificial Sequence
  derived and/or modified sequence opt6 from anti-HIV-1_HeavyChain
gaaguacaauuaguacaaaguggagcagauguaaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaaguagagauagagauuuaaguacagcauauauggauauaagaggacuaacacaagaugauacagcaacauauuuuugugcaagacaaaaauuugcaaguagauauagcggagaucaaggaaguuauuuugauuuauggggaagaggaacauuaauaguaguaaguagu

SEQ ID NO: 49372 - RNA, 384 nt, Artificial Sequence
  derived and/or modified sequence opt6 from anti-HIV-1_HeavyChain
caagcacaucuagaacaaaguggaaguggaguaaaaaaaccaggagcaaguguaagaguaaguuguuggaguagugaagauauauuugaaagaacagaauuaauacauuggguacaucaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49373 - RNA, 384 nt, Artificial Sequence
  derived and/or modified sequence opt6 from anti-HIV-1_HeavyChain
caaagucaucuagaacaaucaggaucagcaaugaaaaaaccaggagcaucaguaagaguaucaugcuggacaucagaagauauauuugacacaacagaacuaauauacuggguaagacaagcaccaggacaaggacuagaauggauaggauggguaaaaauaguaagcggaacaguaaacuuugcaucacuagauuucagaaacagaauaucacuaucaagagauagagcacuaucaacagcacacauggacauaagaggacuaacacaagaugacacagcaacauacuuuugcgcaagacaaaaauuugcaucaagauauagcggagaccaaggaucauacuuugacuuauggggaagaggaacacuaauaauaguaucaagc

SEQ ID NO: 49374 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuugcaaguuuagauuuuagaaauagaauaagcuuaaguagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagu

SEQ ID NO: 49375 - RNA, 384 nt, Artificial Sequence
  derived and/or modified sequence opt6 from anti-HIV-1_HeavyChain
caagcacauuuagaacaaagugcaaguggaguaagaagaccaggagcaaguguaagaguaaguuguuggacaagugaagauauauuugaaagaagugaauuaauauauuggguaagacaagcaccaggaagaggauuagaauggauaggauggauaaaauuaguaaguggagcaguaaauuuugcaaguuuagauuuuagaaauagaauaaguuuaagcagagauagagauuuaaguacagcauauauggauauaagaggauuaacacaagaugauacagcaacauauuuuugugcaagacaaaaauuugcaaguagauauagcggagaucaaggaagcuauuuugauuuauggggaagaggaacauuaauaguaguaaguagu

SEQ ID NO: 49376 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaagcuuaacaagagauagagauuuauuuacagcacauauggauauaagaggauuaacacaagaugauacagcaacauauuuuugugcaagacaaaaauuugcaaguagauauaguggagaucaaggaaguuauuuugauuuauggggaagaggaacauuaauaauaguaaguagu

SEQ ID NO: 49377 - RNA, 384 nt, Artificial Sequence
  derived and/or modified sequence opt6 from anti-HIV-1_HeavyChain
caaagucauuuagaacaaaguggaagugcaaugaaaaaaccaggggcaaguguaagaguaaguuguuggacaagugaagauauauuugauacaacagaauuaauauauuggguaagacaagcaccaggacaaggauuaggauggauaggauggguaaaaauaguaagcggaacaguaaauuuugcaagcuuagauuuuagaaguagaauaaguuuaaguagagauagagauuuaaguacagcauauauggauauaagaggauuaacacaagaugauacagcaacauauuuuugugcaagacaaaaauuugcaucaagauauagcggagaucaaggaaguuauuuugauuuauggggaagaggaacauuaauaguaguaaguagu

SEQ ID NO: 49378 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggaugggcaaaaacaguaacaggagcaguaaauuuuggaucauuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49379 - RNA, 384 nt, Artificial Sequence
  derived and/or modified sequence opt6 from anti-HIV-1_HeavyChain
caagcacauuuagaacaaaguggaagugcaaugaaaaaaccaggagcaaguguaagaguaaguuguuggacaagugaagauauauuugaaagaacagaauuaauauauuggguaagacaagcaccaggaagaggauuagaauggauaggauggguaaaaacaguaaguggaacaguaaauuuuggaaguagugauuuuagaaauagaauaaguuuaacaagagauagagauuuaaguacagcacauauggauauaagaggauuaacacaagaugauacagcaacauauuuuugugcaagacaaaaauuugaaaguuuauauagugaugaucaaggaaguuauuuugaucuauggggaagaggaacauuaauaauaguaaguagu

SEQ ID NO: 49380 - RNA, 384 nt, Artificial Sequence
  derived and/or modified sequence opt6 from anti-HIV-1_HeavyChain
caaagucauuuagaacaaucaggaagugcaaugaaaaaaccaggagcaucaguaagaguaucaugcuggacaucagaagauauauuugacacaacagaauuaauauacuggguaagacaagcaccaggacaaggauuagaauggauaggauggguaaaaauaguaagcggaacaguaaauuuuggaucacuagauuuuagacacagaauaucacuaacaagagauagagaucuauuuacagcacauauggacauaagaggauuaacacaaggagacacagcaacauauuuuugcgcaagacaaaaauuugaaucaagauauacagggggacaaggaugguauuuugacuuauggggaagaggaacacauauaguaguaucaagc

SEQ ID NO: 49381 - RNA, 384 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugauacaacagaauuaauauauuggguaagacaagcaccaggacaaggauuagaauggauaggauggguaaaaauaguaagcggaacaguaaauuuugcaaguuuagauuuuagaaauagaauaaguuuaaguagagauagagauuuaaguacggcauauauggauauaagaggauuaacacaagaugauacagcaacauauuuuugugcaagacaaaaauuugcaaguagauauaguggagaucaaggaaguuauuuugauuuauggggaagaggaacacuaauaguaguaaguagc

SEQ ID NO: 49382 - RNA, 384 nt, Artificial Sequence
  derived and/or modified sequence opt6 from anti-HIV-1_HeavyChain
agucauaauuuagaacaaaguggaagugcaaugaaaaaaccaggagcaaguguaagaguaagcuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaaguagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaagcagu

SEQ ID NO: 49383 - RNA, 384 nt, Artificial Sequence
  derived and/or modified sequence opt6 from anti-HIV-1_HeavyChain
agucauacauggaauaauagaggaagugcaaugaaaaaaccaggagcaaguguaagaguaaguuguuggacaagcgaagauauauuugaaagaacagaauuaauauauuggguaagacaagcaccaggaagaggauuagaauggauaggauggguaaaaacaguaaguggaacaguaaauuuuggaaguagugauuuuagaaauagaauaagcuuaaguagagauagagauuuaaguacagcacauauggauauaagaggauuaacacaagaugauacagcaacauauuuuugugcaagacaaaaauuugcaaguagauauaguggagaucaaggaaguuauuuugauuuauggggaagaggaacauuaauaauaguaaguagu

SEQ ID NO: 49384 - RNA, 384 nt, Artificial Sequence
  derived and/or modified sequence opt6 from anti-HIV-1_HeavyChain
agucauacauggaaugaaaguggaagugcaaugaaaaaaccaggggcaagcguaagagugaguuguuggacaagugaagacauauuugaaagaacagaauuaauauauuggguaagacaagcaccaggaagaggauuagaauggauaggauggguaaaaauaguaaguggaacaguaaauuuugcaaguuuagauuuuagaaauagaauaaguuuaaguagagauagagauuuaaguacagcauauauggauauaagagguuugacacaagaugauacagcaacauauuuuugugcaagacaaaaauuugcaagcagauauaguggagaucaaggaaguuauuuugauuuauggggaagaggaacacuaauaguaguaaguagu

SEQ ID NO: 49385 - RNA, 384 nt, Artificial Sequence
  derived and/or modified sequence opt6 from anti-HIV-1_HeavyChain
agacauacaugggaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggggcaguaaauuauggaaguuuaaauuuuagaaguagaauaaguuuaacaagagauagagauuuauuuacagcacauauggauauaagaggacuaacacaaggagauacagcaacauauuuuugugcaagacaaaaauuugaaaguagauauacagggggacaaggaugguauuuugauuuauggggaagaggaacacauauaguaguaaguagu

SEQ ID NO: 49386 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaaaaguaaguuguuggacaagugaagauauauuugaaagaacagaacuaauacauuggguaagacaagcaccaggacaaggauuagaauggauaggauggguaaaaacaguaacaggagcaguaaauuuuggaagcuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49387 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaggaagugaauuaauacauuggguaagacaagcaccaggacaaggacuagaauggauaggauggguaaaaacaguaacaggagcaguaaauuuuggaagcgcauauuuuagacauagaguaaguuuaacaagagauagagauuuaaguacagcauauauggauauaagaggauuaacacaagaugauacagcaacauauuuuugugcaagacaaaaauuugcaagcagauauaguggagaucaaggaaguuauuuugauuuauggggaagaggaacauuaauaguaguaaguagu

SEQ ID NO: 49388 - RNA, 384 nt, Artificial Sequence
  derived and/or modified sequence opt6 from anti-HIV-1_HeavyChain
ggacaugauuuagaacaaaguggaaguggaguaaaaaaaccaggagcaaguguaagaguaaguuguuggacaagugaagauauauuugaaggaucagaauuaauacauuggguaagacaagcaccaggacaaggauuagaauggauaggauggguaaaaacaguaacaggagcaguaaauuuuggaagugcauauuuuagacauagaauaaguuuaaguagagauagagauuuaaguacagcauauauggauauaagaggauuaacacaagacgauacagcaacauauuuuugugcaagacaaaaauuugcaaguagauauaguggagaucaaggaaguuauuuugauuuauggggaagaggaacauuaauaguaguaaguagu

SEQ ID NO: 49389 - RNA, 384 nt, Artificial Sequence
  derived and/or modified sequence opt6 from anti-HIV-1_HeavyChain
agucauacauggaauaauagaggaagugcaaugaaaaaaccaggagcaaguguaagaguaagcuguuggacaagugaagacauauuugauacaacagaauuaauauauuggguaagacaagcaccaggacaaggauuagaauggauaggauggguaaaaacaguaucaggaacaguaaauuucggaaguagugacuuuagaaauagaauaaguuuaacaagagacagagauuuaaguacagcacauauggauauaagaggauuaacacaagaugauacagcaacauauuucugugcaagacaaaaauuugaaaguuuauacagugaugaucaaggaaguuauuuugauuuauggggaagaggaacauuaauaauaguaaguagu

SEQ ID NO: 49390 - RNA, 384 nt, Artificial Sequence
  derived and/or modified sequence opt6 from anti-HIV-1_HeavyChain
agacauacaugggaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaaguagauauacaggaggacaaggaugguacuuugauuuauggggaagaggaacacauauaguaguaaguagu

SEQ ID NO: 49391 - RNA, 384 nt, Artificial Sequence
  derived and/or modified sequence opt6 from anti-HIV-1_HeavyChain
agucauacauggaauaauagaggaagugcaaugaaaaaaccaggagcaaguguaagaguaagcuguuggacaagugaagauauauuugaaagaacagaauuaauauauuggguaagacaagcaccaggaagaggauuagaauggauaggauggguaaaaacaguaaguggaacaguaaauuuuggaaguagugauuuuagaaauagaauaaguuuaacaagagauagagaucuaaguacagcacauauggauauaagaggauuaacacaagaugauacagcaacauauuuuugugcaagacaaaaauuugaaaguuuauauagugaugaucaaggaaguuauuuugauuuauggggaagaggaacauuaauaauaguaaguagu

SEQ ID NO: 49392 - RNA, 384 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuuagcaagugaagauauauuugauacaacagaauuaauauauuggguaagacaagcaccaggacaaggauuagaauggauaggauggguaaaaauaguaucaggaacaguaaauuuugcaaguuuagauuuuagaaauagaauaaguuuaaguagagacagagauuuaaguacagcauauauggauauaagaggauuaacacaagaugauacagcaacauauuuuugugcaagacaaaaauuugcaaguagauauucaggagaucaaggaaguuauuuugauuuauggggaagaggaacauuaauaguaguaaguagu

SEQ ID NO: 49393 - RNA, 384 nt, Artificial Sequence
  derived and/or modified sequence opt6 from anti-HIV-1_HeavyChain
caaagucauuuagaacaaaguggggcagcaaugaaaaaaccaggagcaaguguaagaguaaguuguuggacaagcgaagauauauuugauacaacagaauuaauauauuggguaagacaagcaccaggacaaggauuagaauggauaggauggguaaaaauaguaagcggaacaguaaauuuugcaagucuagauuuuagaaauagaauaaguuuaaguagagauagagauuuaaguacagcacauauggauauaagaggauuaagacaagaugauacagcaacauauuucugugcaagacaaaaauuugaaagcagauauagcggagaucaaggaaguuauuuugauuuauggggaagaggaacauuaauaauaguaaguagu

SEQ ID NO: 49394 - RNA, 384 nt, Artificial Sequence
  derived and/or modified sequence opt6 from anti-HIV-1_HeavyChain
agacauacaugggaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaagcagugauuuuagacaaagaguaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49395 - RNA, 384 nt, Artificial Sequence
  derived and/or modified sequence opt6 from anti-HIV-1_HeavyChain
agucauacauggaaugaaaguggaagugcgaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaaguagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagu

SEQ ID NO: 49396 - RNA, 384 nt, Artificial Sequence
  derived and/or modified sequence opt6 from anti-HIV-1_HeavyChain
agacauacauggaaugaaaguggaaguggaguaaaaaaaccaggagcaaguguaaggguaaguuguuggagcagugaagauauauuugaaagaacagaauuaauacauuggguaagacaagcaccaggaagaggauuagaauggauaggauggguaaaaacaguaaguggaacaguaaauuuuggaaguagugauuuuagaaauagaauaagucuaacaagagauagagauuuaaguacagcacauauggauauaagaggauuaacacaagaugauacagcaacauauuuuugugcaagacaaaaauuugaaaguuuauauagugaugaucaaggaaguuauuuugauuuauggggaagaggaacauuaauaauaguaaguagu

SEQ ID NO: 49397 - RNA, 384 nt, Artificial Sequence
  derived and/or modified sequence opt6 from anti-HIV-1_HeavyChain
caaagucauuuagaacaaaguggaagugaaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaagcuuaaguagagauagagauuuaagcacagcauauauggauauaagaggauuaacacaagaugauacagcaacauauuuuugugcaagacaaaaauuugcaaguagauauaguggagaucaaggaagcuauuucgauuuauggggaagaggaacauuaauaguaguaaguagu

SEQ ID NO: 49398 - RNA, 384 nt, Artificial Sequence
  derived and/or modified sequence opt6 from anti-HIV-1_HeavyChain
agacauacaugggaacaaaguggaagcggaguaaaaaaaccaggagcaaguguaagaguaagcuguuggacaagcgaagacauauuugaaagaacagaauuaauacauuggguaagacaagcaccaggacaaggauuagaauggauaggauggguaaaaacaguaacaggaacaguaaauuucggaaguuuaaauuuuagacaaagaguaaguuuaacaagagacagagauuuauuuacagcacauauggauauaagaggauuaacacaaggagauacagcaacauauuucugugcaagacaaaaauuugaaaguuuauacagugaugaucaaggaagcuauuuugauuuauggggaagaggaacauuaauaauaguaaguagu

SEQ ID NO: 49399 - RNA, 384 nt, Artificial Sequence
  derived and/or modified sequence opt6 from anti-HIV-1_HeavyChain
caagcacauuuagaacaaagcggaaguggaguaaaaaaaccaggagcaagcguaagaguaaguuguuggacaagugaagauauauuugaaagaagugaauuaauacauuggguaagacaagcaccaggacaaggauuagaauggauaggauggguaaaaacaguaacaggagcaguaaauuuuggaagucaaauauuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49400 - RNA, 384 nt, Artificial Sequence
  derived and/or modified sequence opt6 from anti-HIV-1_HeavyChain
agccauacauggaauaaaagugggagugcaaugaaaaaaccaggagcaaguguaagaguaaguuguuggacgagugaagauauauuugaaagaacagaauuaauauacuggguaagacaagcaccaggaagaggauuagaauggauaggauggguaaaaacaguaaguggaacaguaaauuuuggaaguagugauuuuagaaauagaauaaguuuaacaagagauagagauuuaaguacagcacauauggauauaagaggauuaacacaagaugauacagcaacauauuuuugugcaagacaaaaauuugaaaguuuauauagugaugaucaaggaaguuauuuugauuuauggggaagaggaacauuaauaauaguaagcagu

SEQ ID NO: 49401 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaagucaaauauuuagacauagaauaagccuaacaagagauagagauuuauuuacagcacauauggauauaagaggauuaacacaaggagauacagcaacauauuuuugugcaagacaaaaauuugaaaguagauauacaggaggacaaggaugguauuuugaucuauggggaagaggaccaacauuauuuguaaguagu

SEQ ID NO: 49402 - RNA, 384 nt, Artificial Sequence
  derived and/or modified sequence opt6 from anti-HIV-1_HeavyChain
caagcacauuuagaacaaagugcaaguggaguaagaagaccaggagcaaguguaagaguaaguuguuggacaagugaagauauauuugaaagaagugaauuaauauauuggguaagacaagcaccaggaagaggauuagaauggauaggauggauaaaaacauguaguggagcaguaaauuuuggaaguguagauuuuagagauagaguaaguuuaacaagagauagagauuuauuuacagcacauauggauauaagaggauuaacacaaggagauacagcaacauauuuuugugcaaggcaaaaauuugaaaguagguauacaggaggacaaggaugguauuuugauuuauggggaagaggaacacauauaguaguaaguagu
